United States Patent 11,180,807 (METHODS FOR DETECTING A GENETIC VARIATION IN ATTRACTIN-LIKE 1 (ATRNL1) GENE IN SUBJECT WITH PARKINSON'S DISEASE) - sequence listing, part 60

SEQ ID NO: 903 - DNA, 164692 bp, Homo sapiens
agcagttctttgaatttctcaccctaagatctggcctgtacattttcaaggaattcttgagaggttcttggagagattctgggagccaaacactccattgggatcctagctggtaagcttgaggcgctgataaaaactctctaccctaatgtttactccatgttttttccaaatgaaacttctgtcagctagaatccttgtcatagtgttttagaggtttttttctgctactctcttctttttttatatatattctttttgtaaataaaaatggtatgaccttcctaaaggccccacctttagaaatgggttaaatgaaaagatctttactaatgtaatagaaaagaactgatgaacatagtgcactgaatatggttacatttgacaaaccaaagttagtcctgttcttatttgagtttaagcggtaagattaggtcaaactccagacgagggaaagatattcttaaacagattttaagtcctctgttttctggtaactttaattgtcttatgctgctagtagtcatattaaatatttatttagagaagtgaaaatgcctactcttgaacagagtttcttcccctttcattttatgaaacctaagaaaagaaagttgatacactttttaaaaatatactagattttcttttttcctttctgcttttattttgaggccagtggggtgttatttagtagtaacactgaagcaaatgtattgattttcttaacgtgttcagcaagtaattcatatcctagatatgaaatatacactcgtagcagagtaatgttacccatttctcaatgatatgcttaaagaatcttgctcaatatgcatattgtttttccttttttctttactaatgaaaaactacacgctttctcaacatatttttaagtcaggttctaaactttgaactcctatgtacaatttgcttatttcaggcatgaatgtgaaactgtgtaaagattaactaccagacactcagtcatttatttaactatttagccctaaatcagtgggtgactaggagattctgaattctgtgatttcgttaaaatcaatcagtttttaattattatacaagctttttactttaaagttgtagctgtctaaataaaattgtgaaagcacaatttccaaacctaaatcgaaggcacattgatgctgtccatcagaaggtattgataatttaaaaaaatattacaaactatcttttatctttttataaaggacctaatgtcatttgagcttaaccataatcctttgaagaaagtaaaatttaactttaaataacattgacatacagagcagttaggtgatttgtctgagaccatatggtatgtatgtcccccgtcttgataaaattaacactaaatatgtaacatttgaaaatttgtaaaatatgtaaaagttgaagtttttaaaagtttggatttaagttcttcctttcagaatatgagcatgtcactttatttgcaaactaaacatggcataacattatggcttgtgaacactaattgtcttagctgctggggtgaatgcagaattaagcagcaattagtatgagtgaataaattgcatccttagagtgagtgcactatgctattctgggaactaaagactatatttgagaccatgcgaagttgtgcaagtggtggagtagggcagggtgcagtcatttggaagactatgcccatcaggtatctcaaggtaccccagatgtgacaggcccaggagcggaaccagccactttaacttttgcctggctgaaactggactgggaaggatggattaaaaaggtaaatcaattcatacgtagcttgtggtcctttgcagcttaagtgtaggactgaaaaaagaagccaaagaaaaagggaatgagctgaagaaatacacacacgtacacacacacatcaggaagcaacaggcaaggaaaaataaagtgagaggttcaaggcttcgaggaggaattgagctctgtgcattccattcatgggctttgccaaagaccagcacaatggactcagcatctcaggcatggttaagtaccctactgtgcactctgctatccttttagtccactggtttctactctgtctgtgccaggttttcatctcaatatagaggaaaaggattctgatgcctcaggattattacaagcattaaataagatacagatagaatgacgctaatgagtatcatttttaaaataaggaaagttgaattttattcagaatctgttggtaacaaactaatctctttatttaagtaaccccacttagagtttaaagtcacctccaatcaactcaaagggctgacctcccaaagaaagtctcaaatataaggcaagctctcttgattctgaatttcattagaaatgtttgtctaagtctttctcatatggtcagaatgagagagggtgcccttctagtaatatgtcattatgtcaaataattcatcaaccaattttgtttattctctcgaactgccactttggcggcaggggtactctgtctaaatgagatgtctataaagataaattaaacatgattcaggcccccaggtagagttcagttcagtagggtagaacagcaactcagtccagctaccatcagtaatatgtttgtagtaagactaatctgatagtaaggcagaaaaacatctcatggaattttaggaatagccaagaagatgggtcccctggagacttgcacatagcatgttgcatgaaggattcagtgacttgcaagatgggcttgtcttgtcaccttttcaggagacatagctgttcaatcccttgccattgtgtaactaagtgactcttacttgctgctggaatcacttcatgcttttcatgctttaacaatcagtggttctgttttactttgaaaaatgagtcattctatgacagtattcctcctagaccctagcatttcatagcttctatctatgattattttaaattctagctcctgtatctaactgaatgaataagcacatcccacagctcagattcctgaaagaatttgattatgtactcagctaaacatcatcactgtttggttagagcttttatagcaaataattcacagatctttgatgaaactacattgtctttagtgggtaagtgtccaacagaggtctaataaactatgaccaggcaattgataatgccaagcggtagagacacagtgatctctcttcaaaatgcagtttccttcatcagaaagctatgtgtggggagccatttagaatcaagtttcaggcatagcaaatgtttttgatctttcctatccatacatatgtccaaataaatatagtacctggcagaatgtattattatcgtaagtaaagtacataagtgtgctcttaattgttattggtgttcagaggaagacgggctacttttgcctgagacatcctaacaggcctcttgaaaaaagcattggagcattaggtctttgaaggttggctagaatccaaacaagttgaaggggagcaaaacattttaggcaaaggaaatggcatgagaaaaatcacagaaatagaaaatttcatgtggaggacaaataatacttatggtcagatattgaaagcaccatccatcaatgttgaaatcctacacttttgtacagaaccatggattgaagcagttaggagtcacaactgatatcaaagtaaaaaacatgcaatggtgaaccttggtatctttgtctaggaatataaagaatggcttatcagtggagaccatcgacagttgagaaaagaagaagcccaaaaagtacaagaatgaaaatcgagagtgtaagaagaatgtctgttttactggcattatctaacactcagatatgcaactctttattgccaaacactgtgtgtgttagttaaggtaaaaggtgaagggaggcagaagaatggagattgaattgaattctagagctttagttctgtgtgagtttgggcccccagaagttctagacattaagtacagtctgaattgagaaatattaaacatatcttgtgatccaatattcccctaagttatacactcaaatatccaatgaccagcttgacatttctacctgcatgttcaatacttatttgaaacttaatatatcctaaatataatttttttttaaacagtcatgctctgttgcccaggatggagtgcagtggcacaattagctcactgcaacctcagactgctggtctcctaccccatcctcctcggtagctaggaccacaggtgcatgccagtgccagcacacctggcttttcttttcttttttctttttttttttttttttttgtagagatgacatcttgctacgttgtccagactggtctcaaactcctggcttcaagcaatcccctgcctcggcctcccagtgctggggtaacaggtgtgaaccaccacaaccagcctgctaaactgaattccaatttccctcctcaaaatttttcttccccaggtatttttatttcatcatatttcacatatttgcccatatcccaaagctagaagaaagctcctttcctgtcctcactagaaataatctatccaccagtcctatctactttttctccaaactacatcataaatccacactcttctctctacctttgccctcatcaccaaatttaattcaccaccgtttctctcctgaactactgtgttatccttaatcggtctcccttttcaactttttttttttaattatactttaagttctagggtacatgtgcacaacgtgtaggtttgttatatatgtatatatgtgccatgtcagtttgctgcacccattaactcgtcatttacattacatatttctcctactgctattcctcccccatccccccactccacgacaggctccggtgtgtgatgttccccgccctgtgtccaagtgttctcattgttcagttcccacctgtgagtgagaacatgtggtgtttggttttctgtccttgcgatagtttgctcagaatgatggtttccagcttcatccatgttgctgcaaaggacatgaactcatccttttttatggctgcatagtattccatggtgtatatgtgtcacattttcttaatccagtctatcattgatggacatttgggttggttccaagtgtttgctattgtgaatagtgctgcaataaacatacatgtgcatgtgtctttatagcagcatgatttataatcctttgggtatatatgcagtaatgggattgctgggtcaaatggtatttctgcttctagatccttgaggaatcaccacactgtcttccacaatggttgaactagtttacagtcccaccaacagtgtaaaagtgttcctgtttctccacatcctctccagcacctgttgtttcctgactttttaatgatcgccattctaaccgacatgaggtggtatctcactgtttttaaaactcattacagagctaagtggtttttatttaatgtaaatttatatcacattacttttctactcaaaactccccaatggtatcccattaaacttataaaatttcagttttctttctggctcccaaatttctttttttttttttttttttttttttttgagatggagtctcgctgtcgcccaggctggagtgcagtggtgcaacctcggctcactgcaggctccaccccccggggttcacgccattctcctgcctcagcttcccgagtagctgggactacaggcgcccgccacctcgcacggctaattttttttttgtatttttagtagagacggggcttcaccgtgttagccaggacggtcttgatctcctgacctcgtgatccgcctgcctctgcctcccaaagtgctgggattacaggcgtgagccactgcgcctggccccaaatttctttatgactaccttctgcctttgttttttgcatatcacagtttgtcattcctccttccctctttttccctccctagtgcatttagttgaacaagccaagcccatttccaccccaggaactttgcacttgttgccaggttcctccaggtccaggtcttcacatgatgtagacattctcatctatcactttctcagaaggatgaacatgaccctttaaggtagctcttccacactccagtgactctgtcccattactctgctgtttcctcatagctcttaagtctgaaactacattgtttttctattcttcatttacaaataaattgtacaagggttggcacttatgcactctctcatacactgctgtcctgccattactgggagtcacataataggtaccaaataaatacttgttgaaagagtaaataaatgtataaattaaatgaaatcagcaaaactatatgtaaatctaactagcccaaagaaattttatttcctgtaatatcattttgttcaaaaaaccaaacttaggagaggagaaatataaacaaacaagcttgggtgaagtttaaaacgtatgtgattaaatctccattgtcatttatccttttccaaaaagtgggaaatgttgcatgatgattaaacagaatacaatgtggtttcaagaaacatcacacaatcctgtttgttctaagataataaatatggtgttgaaaggaagaaatttataattactaacagcagcaggtggatgaatctctttggtattcatatgaacaaaatactaacattttaagtaaagttaccttttccatgaatatggttttcactcacaaaaaaggattttgttcaggttcaatatgtccatagttttaaaaccatgatccaagaaccactgggggtgggacagtggagttgggatatggagaaagacaagctaagtgggatgctgcttttcgacactttgacaaagatcatccttaccattatctcctcataagatacctagaggaaaaggtgatgacattatatatatttggaagccacaagtgtggtacatatttctagataataagaatggaatgagctaacatttattgggaacttactctgtcctgagcactattatctaatttagtcctttcaatatctctaagttactattattttgtttctcttttccttttttttttttttttttttttttggtttgtgttttgagacagggtcttgctctgttacccaggctggagtgcggtggtacaatcccagctcactgcaacctccacctcctgggttcaagcgattctcctgcctcagcctccctagtagctgggattacaggcgcctgccaccatgccaccttttcccaacctcaggaataatatacttaaccaaccagcattaaactccatgcatgagtttttctcatatatgaaaagaagaaaataggccaagcgtggtggctcatgcctgtaatcccagcactttgggaggccgaggtgggcggatcacttgagccattttttgtatttttttagtagagatgaggtttcaccatgttggccaggctggtctcaaactcctgacctcaagtgatccgcccacctcggcctcccaaagtgctgggattacaggcatgagccaccatgcctggcctattttcttcttttcatatatgagaaaaactcatgcatggagtttaatgctggttggttaagtatattattcctgaggttgggaaaagggagtcttagtgaaaacaaaaggtgtattacctaaagggctcattttctacaggaaaattatggtggctagattatgttttattattctctttcagttttagagaacaacttgtaatggagccttcatctcttgagctgccggctgacacagtgcagcgcattgcggctgaactcaaatgccacccaacggatgagagggtggctctccacctagatgaggaagataagctgaggcacttcagggagtgcttttatattcccaaaatacaggatctgcctccaggtaagaatgctgggaaggtttttaaattttatttatttatttatttttgctactgcatgtgtttattataatctttgaaaatcattgttgtattacataatagagctgttgcaattatgtttgaaaagcagaagatccctggtgctctcaatcaacctgtcagcctaccttagcctcaaattatctgttttctcccctcctctgaatgaaatacatgcagggtacttatactgtcaactacttctctgaacaattgagtgactgattgaaaattacaggcagatacatttacttgttctctaagcacttgggattcaaagcaattattttagaatgcagtgttagaatagctcttatattctggcacttagtttataataatatgatgtttgtcttagagaaaatattgttttgtgacctggatatattagaagagatgttatatgaatagccatctttgcatgctgtaaagatggcgagtgtaagagttaccaagaaaagaaacaacaaatgcccaacaaatacatactacattttaaaataatgtagtaatctgactctgttctgggtttgaggaagtcatttaaaaaaataaaacataagtagcaaaggtataacaataaaaaatgattcatcatatttagctttactccattttacattaataaaaaaggttcccaggttgaatggaattagtctaccaaactgggtttcgcatcctttataatagtctgattccatttttattcagattaaataaggtacaattttgggtccagtactcaggagccatgaaggtcagctaatacaattttaggatgtctggtttgtataacactaatatatactatgtaataaatgttaaaaacacctatttgtcttcagctatgtacccaacaacctatagaattctggaagaatgaaagaagagaaatacctgtatctgacttaaaattgtgtagtataagttgagggagatattgatggaaatgacagctagaagagacgaaataaaatgaggctataagtgatctgagaccatagaagaaaaatcttctaggtcattctagaatcgaaaattaaaaggacatttttatttgaattgtaagggataaaatactgctatgggagtgaattgtgaggaaataaaatttaggaaaggaattcttaacggaaatgggagataaggggcttggtgatatgtgcatcacacaatgtggaaacctttagaaacagcgaggacccacatgagacaagtcaggtctggttgatggtggccctgccctgatgtgctctctggcctacagggctcctgtactgagtcagaacccagtttaaaaatagcattgtacagccgggcgcggtggctcacgcctgtaatcccagcactttgggaggccgaggcgggcgggtcacgaggtcaggagattgagaccatcctggttaacacggtgaaaccccatctctactaaaactacaaaaaattagccgggcgtagtggcgggcgcctgtagtcccagctgctcgggaggctgaggcaggagaatggcttgaacccgggaggcagagcttgcagagagcggagactgcaccactgcactccagcttgggcgacagtccgaggctccatctcaacaacaacaacaacaacaacaacaaaatagcattgtacctcactaatcaccaggaaaatgcacatcaaaaccacagtgagatatcacctcacacccttttctatgactactattaaaaagtgcaggatataaatattggctaggatatagagtgattacagcccttgtgcactcttagtgggaatgtaaaatggtgcagccactgtaggaaagagtatggcagtttcctcaaaaaccaaagaatagaattaccacatgatccagcaatctcacttcaggatatattgccaaaagaattaaaagcaagatccccaaaagatattagtacactcatgttcatcatagcattattcataatagccaaaaggtggaattaacccatcatcaatagatatgatggaaccttattaagttttaaaaagaaccatgctctacatggttcacatgaatgaactatgagaacatcatgccaagtgaaataatccagacgcaaaaagaaaaatactgtgtaattccaattataccaagtatctagattggtcaaattcataaaaaccaagtagaatggtagttgtcaggaacttggagagggagaaatgaggagttattgtttaatgggtataaaatttcaattttgcaaggtagaaaaattctggagattggttgcacaataatgtgaatgtacttaactgaattgtacacttaaaattgttaacagaataaattttaggtgcattttagcacagcattttaaatatttatcaaaaataaaaacgttttccccttagagaaaagcagcattgtacatataatcacttctgttatacttaaaagttgacttagtatcctaattataggtataatattgattttgattagttatccaatagaaagtaactgaaggattacaaccttggataagtcattgctgattcttaaagataagagatagaaattggtttaataaagaatttaaatagtttgcttgtttaaaaaatatagttttgctggacacggtggctcacatctgtaatcccagcacttagggaggcggaggctggaggatcacttgagtctagaagtttgataccagcctgggcaacatgacaaaaccccatctgtacaaataatacaaaaattaattaggcgtgatggcatgtgcttttactgccagttactctggaggctgaagtgggaggatcacctaagcccagtagttcaaggctgcagtgagccatgatcacaccactgaactccagcctgggtgacagagcaagaccctgtctctaaataacaataattattctaataattttgaatgatgtaaaactttattaaccccaagtgttcttctacatcagtgattgtcaaaatgtgatcccttgaccaaaagcatgaggttcactagagatcttattaaaaatacaagttcttgtgtcctaactcagaattactgaatcagattgttaaggtgaggcccagccttctattctagatcctctaggataagatggtatcctagagttgggtcaattaattccccttcttactattctcacgccagttgcatcttaatgtctaaggattcatgtattcggcaaatatttaatagtcagttaccctactcgagacacttctgtcagaacggttcagagaaccaaagagcaaagctgtcgcatacttgaacgtgtatctagtatgacaacagataataaccaaacttagaaacaattatgctctaccatcatgtagcactctaaatgataatgagggctgtgaagataagggtgtgaccttacccacagaaatatggtgaggtgccatctgaacaaagatgacagcacagtgaggaagtgagcctcatggagcacaggtgaagctgagcctggtcgtggtccacgtttatgctgaacagaggtaccaactcaggagcacatgatgtaggagcaaaaagataacacatttttcataaccatcacaaggggcatggctgatgtttctataacaaagacaggttagcaagagaaaaacccagggaaaacttgagattttatgctaagttgaatgaaagaaatgaatagatgtgactaaatagaattggaatgaaatatgatctaaccgtaatcaacagacagtggcggggggactcagcaagtcctgtatttttggattcttcttgctccctcggtgtagcatttcttccctctgcatatagggcaggacacctgtcatatgaaagtctatccgggagaagggaaaaggtcagtgcgtgagctttctaggttttaaggcttgctgtaggagaggatttcagtttctttgactcacctggctgcaggacacagggcaggggattggagaagatcagaaagaccttgtttctgaggccctctcaaatctccttcagttccaagtactcagcattccaaggcactgtattttagaatactatgttctgacccccaacggtgttgaaatttccttcttttttgttttgacaagatgtgaattcatcaggaaaccagtgttccctatcttattaaagccttccaagagcatctaaaaatggtaaagcatgttggattatttttggagactagcataacaccaagaaaataaactttctttagcagttctgaacaatgaaaaacagaacagaaataaacaagttttgaacaaatgaaaggatcacaactcccaatatgagatttttttttttaatcttgaagaaagtctacaggcatagcctgtacttttttgatgtttttctattatatattatgttttctctgggtttctaatataaattttattaaaataagtactttcattttctattcttagatggtgcctgagatgttatcagagaaaggggtcaaaaatatttttaatcagcttttgtacttatgttcaacattgtcctaaagagcacagctgaaaaataaacaagcaaaagaaaggaggaagagagagagagaaggaaagaaaagaaagaagggaggaaaaaaggaagatataagaaagaaataaaaagaaaagcaagagaaatgcaaggcatacatgtggaaagatatctttctaaaatttttaaaataataaatattcctgtttgaaacatcctcatacctaaatttctgaaagcatactggatagccccataagatatatggcttttgcacagacacaggacaaagacaatctttttcagagtgtcaaactgccatcccagaaacaagttgtgcaaatttacatttcctccaacagtaaagacaattgcctcactaactttggggatcagtaggattgtttttgtttctgttttttggagacagggtcttgctctgtcacccaggctggagtgcagtggcgtgatctcagctcactgcatccttgacctcccaagctgaagtaatcctcctaccttagctcctggggtagctggaactacaggtgcgtgccaccatgcccagctaatttttgtattttttgtcaaggcagagttctgccatgttgctcaggctggtctcaaactcctggactcaagtagtcctcccgcctcagcctaccaatgtgctgggattacaggtgtaagccaccatgccaggcaggattagcagttttaagaatctttgctcattagataataaaataattattccattcttctttgaatttgcagttcttagacaaccgttggagatagttttcataaactccttggtcattgctttcctttttgtcttaagttgctcataatgtatacatttaattttaaactaaaataaatataagtggtaatgtttcattttttttctcttaaggatataaactccttctctcatatatcttaggaattttaagtgaaaatgtccagttaatatagctggctaatagcagaaccagaaatgggttccaaatattgtgactgctagcccatgtgtcttgactcaatcctgcttttacttttttaaaatcactcaattgaagtataatttatggaccataaaattcatccattttaagtatacaatttaataatttttagtaattgcatatgattacagtaccattataatccaattttagaacatttcttcattccatttttttatctctagcctaggcaaacagtaatctactgaacttgctgttattttgatctatatagaagattattaactcaaagaatttttttactattaaactatatttggagaaaaaaaaacggtgctgctttcaatattcttttcatagtcaaataaccctctccttcaatcttaccacacatccaggagagagatcagtaaattgacacccaactttagtagactttagtaagtacttataaaatttaaagttatccaaacaagatcttttataattttgcacatgtaattgtttggactcagataaaattggcatagcaaaataatcatgcttcagtttgtctccagggcttccatataacataatagagagcctcttaaactcaactgcttttaggcttagaaggctgtgacagatatgagttatcagtgcatgaaatacaggaaagcatacttttctctataaactagaatcttttattcaacaacagataaagatatgttaaataaaagattttatccagctataaaaggacatgtatttataactgtaattttgatagtctgataaatctctaactttcataagaaaacaattaagagtattccttagttaaaagtttaattttgtagacattgagacttttttttttttagatggggtctcactctgtcacccaggctggagtgtagtggtgcaattttgactcagagcaacctccaccccctgaactcaaagaatcctccctcctcagccccccaattaggtgggactacagatgcataccactacacccagataactgtttgtatttttggtggagacagggtttcaccatgttgcccatgcttgtctcagactcctgagctcaagtgatctgcccatctcagactccaaagtgttgggattacaggcgtcagccgccatgcctggccaatattgggagcctttcatgttacttaaattctgcatttagtggacatatttgtaaccttgttatttcatttgcattggactgtctgctccctgagtgtaggaactgtcttctttctctgtgaatgtgtgggagtcacctaggcagaccttagtgtggagtgacgtccaatcatgaagagggaacagcatttgcaaacacacaagagaaagcatagttactttgatccctaagaatagttttacatgatcaaagaatgtcatgtaaaaagctgggtattggtaaatggtaaataataaggtacggaatagggaatatagggtactaggatgattggtataatagggtgaagagtaaatgagtgcgtgtgggtacctaacagtaagtctgaagaagtaaatgtaatagaagtggaggtaaaggaaaatattcagtaaatacatgaaatactcattaaataaacctgatttagtagtaggagaggcataccatgagccataatttctgttttaggtgaatagtggtgatattcactgatacaattaacttgttttggaaactattcattgaaagaggaactagttttttatttgtttgtttatctcttgttgccctgtcacctgtggccttgacctccgagtccaagtggcagctgttacaagcagtgagaatcaggcagtgacaaagaagaaaagacaaataatgtgtgtgcactctcccttgagaaaggtttcagtttgcctcatgagttttaacgcatatatagacctaagcccctgggccagtgtttggtcatggccctgcctatctgcaaagaagactgagtctaaaacacaatttttgttcttggtggccacatgcaaagctaacaattctatttctgtaaaggaaaaatgaaatgcatgtagggtacaactagcagttgagtttagttagaaggtagaaatttgacagtcatcagcatttaggtaatagttgaaactgtgggtacggatgatattatcttggcatcatacctaagtgagaagaaggtggtagaaacaaaattctaggcattgacaaagaaagaactctagaaagagccagagacacagaagaacaaggaaagtgtcgtgttctaaaaccaagggaagagacatattcaaagaaatcagagggcttgccatcatcagctatcacaaagactgtataagcctttcatttagcagtcaggagagctttattaaattgtcttaactttaacagcttcactggaatgacaggcagggaaactatgtacatttctagatgtcattgaaggagtaaagtatcggaaatgagatttttaggcttcttttccaagaaaccttgctgtaaaaggaaacataacaaggaacaaaaggaaatgaatgaatgcttttttcaagcaaggtgggggcttgaatatgattgtgcattgagaagatggtatgggaaaaaaaagagacagacagacagataacagaggtgaatgtgattttcagccaagcagagtgcatgctggatctgttgtctattcccacctttttcagctcatggagcccaatattctaagataatgcaaattgctgaagacaatctttccctactctctaaggatatattggccccaatgtctaaggtcaacattagccagattgagattttacaaagaaatctcaaggtcccaaccaacttttccatatttttgggcaatatgataccaggcataacatacctcagccacaggacaaaggactgggaatagaaagattcttacaaggagagtacactttcacctttgcctgggacaatgtttggtcttttctgtcttgccatatgaactctttcctcaaggaattttatccacaaaggcgtggaaaatctcttttgaaatcctcgaaatacgaagtgtctctccctcagatgccataccactcatcaatctagacctcagagagaactaatgggttcaaaattaggcaagagtatctaaggagtgtgtgcaagtagactgtagtgatcctacatttttctccatcttcttcctgaaattataggaattatattcaaagtccaagaagcttgttgggagcatagccttgtatggggcatccctattggaaaaaggacatgaatatttcctcagtgcaccaccaggaaatttaatattatgaggtacatagcaacacaaaaaaatcttcactcactaccttctgaataatagtaaaaagaatatacttttttatttagtaaaatgcagaaatcatacatctctacaaattttacaacatgagcacctctgtgtaacaagatcctagatcaagaaacataacattgccagcacttgggaaaactgcctcgtaccccctttcaggaactccttctttagggttaaccagtttttctgtagccagtatgcgagtatcaacttgtggcatgtgaatgccacaacttaatatgtatttaagaaaatatgtttaatagaaaataggtttaaaatgaaaatatgtatgtttccatatatagagagagatggaagaatatatattttcttttttaaactaatgccatagttcaattatttaagccagacagctaaaactgcttctttttgtccaagtatatggctcacccctgtaacccagtactctttggaaggctgaggcaggaggatggcttgagtccaggaattcaacaccagcctgggcaacatagtgacaccctgtcactacacacctttttctgttcatacttctatttaacaagtgatgctggaccatgatgttcccagcattttattttttaatttcatcctaagatctgctcttatcccccattaagaaggattggtagaatgttctctttcctaatgacagaagtatgaaataacttgttcatcaggagagtttattattgatattgttaatatttaaatacacattccataaattggaatattttgttgtacagtctgagatttaacacatgtatagaattatattaacacaccttctctcagtatatagaacaatttcataacccccaaaagactcctttatgctagccctttgtaaccaatctctccactatacctctaatccctgataaccactaatctattttatatccccattgtcttttccagaataacatatgaagaaattatatactgtatttagtctttggagactggtttcctttacttaaggaaatgcctttgagattaagcaaagttatgtcaatgaagtgtttcattttattgctgaatagtattctaccccaagaatggactacagtagtttattcatttgtccactaaaggccatttgagctgtgtccaattttggtgattatgaatagctactattaacattcatgtacaggattttgtgtgagtgtaaattttttatctaaattttttttttaagatcagatagtaaatatttcactcttgacaggtctcatgtattctttttttatttttatttttttagaaaaggtcttgccctgtcacccaggctggagtgcagtggcataatcacagctcactgcagccttgatctccctggctcaagcaattcttccatcttagcctcctgagtagccagggctacaggcgtgcaccaccacaccagtctcattttttaactttttgtagagatgaggtttcactgtgttgcctagtctaatcttgaacaaagctcaagcagtccttattccttggccttccaaagtgctaggattacagatgtgagctactgcatctttccaggtctcatatattctttctcttctttttttcctttgtcttctcctagtttttcttctcccatttataaatgtaaaaacattcttagctttcaggccatacaaaaacaggtcatgggcttgatttggaactcaaaccacagtttgtcaagtcgttttagaatgctataagttgattgctggatcatattataggtatatttttaactttataagaaactggcaaacttttccagagtggctgtaccattttgcattttgcattgccaccagtaatgtgtgggaatgtctgttgttccccatattcacccccagttggtattaccagttttttgttgttttgttttttagtcacatatgtttgtataagtatcttattttggtatttatatgcatgttcctaatggctaatgaacttaagcattaaacatttcataagcttatgtaccatccatgctctagagaaatgtctgctcaaatattttgactacttttttttaattggattttttgttttttaattgttgagttttgttttttggggattttggagctttttgtttttttgttttttgtttttttaaagagacaaagtcttgtttcgttagccaggctggagtgaagtggtacaatcatagctcactgcatccttgaccttcttgggctcaagcaaatctcctgctaattttaacagacagggtctcgctttgttgcccagactggtcttgaactcctgactttaagatatcctcccactttgacctcccaaggtgctaagataacaggcgtgagtcatgttttcagttttaagagttctttatgcatttcagcgtacaagttgtttgttgaatcaatgatatgaaaatattttctcacagtctgtagctatctttttattctcttattagcgtctatcacagaacacaagattttaactttgaggatgcacagtatatttattttttcttttatggattgtgctttagttaccatgtctaaaacctcctcatctaaccatcagtcttaaagacttctttcgcccataatttatttagaagtgtgttgtttaatttccaagtatttgaacatttcccagttttctttttattactgatttgtagtttaattgtattgtggttagaaaacatttgttaaggtttgtttttgacccaggacaatggtctgtcttaatgactctccatgtgcatttaaaataatatttattctgcagctgtttgctggagtgttctttaaaagccagttacattcatttggttcctggcgtttttcagttctggggattatttgtctgctaataaaatgtagacctagttcctcagaggaccctggtcacagatttatggacataatcataaatcccacttaagcactgttccaaattgctgaaactcaattcaatattaccagcaactgtaacaacacaacaaataaatcacattagtaccacaattattaagattgggaaagttttataattagacagttgtcacccaacaaattcatattagatgcttatatttttcttggtaataccagagatccaaataatcaaagcacaaatgaaacaaacacagctgaaatctttatgctttctattactacttataatacaatcagcaacaatttcaggttcaccaatctgcagaaacattgtatatctttagggatgtgcttttcttctttttccttaaatttttggttaaaaaaaaataagcaacacttaagtttctcaaatgaacagtcataatatgttaacattttaacctacgatatctaaacaggagagcattctaataaaacccctaaactcacctggccttttagtagaatattatctttacatacagatatggaggaaaatatgttaaatgtaaattcttttttcttctctctatcttcatttatttatttatttatttgagacaggatgtccctttgtcatctaggctggaatgcagtggtgctgtcagagctcactgcagcctcaacttcctggactcaatcgatcctcccaccacagcatcctgagaagcagggaccacagacatgcaccaccatgtctggctaatttttaaaaatttttccccaggctcagtgtccagctcctgggctcaagtgatctgcccaccttggcctcccaaggggctggaattacaggcatgagccactgcacacagctgaattcttttcaaaaccagcaaatcatacatttctcatagaagttaacttccacagagatgttttattttctttttctttttttttttcatacttcgaggccaaaaaattgtcatcaagatcctagcaattgctgcagccaatcccaggactttgcttccacagtagctattgagcatcaaatgctctcttagatcatagaccacaactttgatgagctttcattcttagctatgtcttaggattctcctgaaatatgaagggtaggaagttgtattccctagttcaagggaaaaaaaaaatcaatttaaattcaatggtattaaaaacaatgaatatttacttcaaaaaattattataaagcaaaatatggtacaaactagtttttccttctaaactcaaatacctagctagtaatattccaaaaataaacattaattatatggaaagaatttttaaatttttgcaatgctgaaattaatcagtgggaatactgacgctcttacctgtgggtctttgttcttagagctcccaagatggggcgggccgctcccaagatggcagcaagccttttgttctctgaccttgggttcttggcctcacagattccaagaatggaatcttgggccatgcggtgagtgttatagctctattagaagctgtgggtcacggaagaaaaccatggaacccagcgactagtgttcagcttgattaggatgaacccaggcacttagctgtgcaggaacaatggtgagcctttagcccgatcgggagcagaaatgggcaccttgctggatcaggagcacagcagacactctgctagatccagaggggtgggagtcaatggtgggtctgagatggtggcaaacagcagtggtggacccgggtgggagtcaatggcaggtctgtaacagcggcaaacagcggtggtggacagtgagcaaaagctcagctcaagccgtaacaaacacggaccagaagagcgtgcagttgcaagatttaatagagtgaaaacagagctcccatacgatgggaggggacccaaagggggttgccactccctgcttgaatgcctgagtttatatcccgatcattgtccccttgttgtgctctcaggcgatatatgatttgactgtttctttacctcctgcttttagcctaatttgtgtttcagtgagccctctttactacccgattggtcaggtgtgagctgagttaccagccctgtgtttaaaggtgggtgcagtcaccttccccagctaggcttaggaattcttagtcagcctagaaaatccagctagtcctgtctctcagtcccccatctcaacagaaaaacccaagtgctgttggggaagttggccgaacaacgctcttaactgcttcctgctgaattggggcatagtaggggtcgtgcaattgagatttcctcaggaggagtgcctttgatgtcatcaacataggagcatgggctaggaggctgtccaggggcccacagtagatcttagtcatgcatctggggctccatttgaagaatgatttgtagttttatagctttgattctggaagacacaaacttaacaaggaggttaaagatacagggattgaaatgtaggcctgaagtgcaggggaatatttctttggcacacgtcacaggccctgactatctgcttgatagttttgaaaaggcctggtccagtaaataatgattcggccatctgatgggtgctatcaatgcctaagtgaaagtgttactggggggttctagctcccagagctcccaagatggtggcaggccccttccaagatagcggcaagcctcttgttctctgacctggggttcttggcctcaaaggttccaaagaatggaatcttgggccatgcagtgagtgttatagctctattagaagccatgggtcacggaagagaaccgtggaacccagtgactagtgttcagctccattaggatgaacctgggcacttagccgtgcaggaacaatggcaagcctttagcctgatcaggagtggcagcgggcgcctcgctggatcaggagcacagtgaacacactgctggatccagagaggtggaagtcagtggtgggtctgcaacggtggcaaacagcagtggtggatagcaagcgaaagctcaggtcaagccgtaacaaacacggaccaaaagagtgtgcagttgcaagatttaatagagtgaaaacagagctcccatacaaagggaggggacccaaagagggtagccattgccagctcaaatgcctgggtttatatcctgatcattatccctccccctgtgctctcaggcaatagatgattggctatttctttacctcctgtttttgcctagttagcattttagtgaactctctttactacctgattggtcagatatgagttaagttgcaagccccatgtttaaagatggatgcggtcaccttcccagctaggcttaggaattcttagtcggcctaggaaatccagtcagtcctgtctctcagtctcccttctcaacaggaaaacccaagtgctgttgagagattggccgatgattgctctaactgcttcctgctgaattggggtgtagtatgggctgttcagttgagatttcctctggagaggtgcctttgatgttattaacttggagcatgggctagcaggctggtccgggtctgcagtagattttagtcatggactgcatctggggctccatttgaagaacaatttgtagttttatagctttgattctggaagagacaaacttaacaaggatgttaaagatacagggattgcagcaggtggagcttgcagtgagccgagattgcaccactgcagtctggccttggcgaaagagcgagactccatctcaaaaaaaaaaaaaaaaaagatacagggattgaaatgtatggcctgcagtgcagggggttatttttttgacacacttcacaggccctgactatctgcttgttagttttgaaaaagcgtggtccagtaaataatgatttggccatctgatgggtgctattaatgcctaagtgaaaggtttggtgaagggttttaagtaatttctattgtttagttgcaggcaaaagtatttttcctttttcggtggctagccattctgaggggaggaaactacgtccttgtgaggttccccgttctatttctcctgctgagtagcagcttgggttcccagaggggattaccccatactaggggtccttctataagcatttttaatggagagttctgccttgtggctcttttagctttaatacccgcttggcagtttccttctatttttctttccttttctttctgatgaccccggcagtgtaagactgccacctctttaggtttctgtacagccaataataatctcctaatggcttcctgatgtttgataggtgttccctcagaagttaggaattccctttttttccatattgctgtgtgggcgtagaggactaggtaagaatactttgagtctgtatgtatatttacccttttccctttttttaattctagtgcccgagtgagggctattagttctgccagccgagagctagttcctggagtgaggggattactttcaagtattccattattactgaccactgcatacctcgcttttgaagtcctttttttacaaaggaattttcattaatatacaagttgagttagggattagtcaagggaacctctagaaggtccctcgagtggtataggtttgaacaattacctgttgacagttatgttttatctttttcattgtttggaagaaatgtggcggggttaagagttgcgcaagtatgcagttgcagcactggccctttaattaatagagcctgatatttaagcaaacgattgtctgacagccacaagtctcctttagcagtgagtatgctgtttacatcatgagatgtccacacagtaagatctcttccctgtattattttaactgctttacatactaagactgcaactgccgccactacccgtaaacaatgatgccaaccctttgccactacattaattttcttacttaggtatgccatggtttgcaagctggtcccttgaacctgtgtaaggactcctggagctatttctgttttttgtgacatatgaagaaaagtcttgccccgttggtaagcttaacactgagtcttgggttaaggcctttttttagggcctggaaagctgcttttgctttaggagtccattttactaaatgggtattggctttctgagcttccttaattagtgtatataatggcctggctattttgccgtacctgggaatccatatttggcagaagcctgttatgccaaggaaccttttatttgctttagggttttgggatgaggataagccagtataggctggatacatttcttactgagggccctggtgcctttggataattttagccctaagtatttaacctgctgtaagcagagctgagcctttggtttggaaaccttgtagccacaagtggtgaggaagtttaaaagcgcttgggtggcttgatggcacaaggttttttcaacaggcagctagaagtagattatccatgtaccaaaggacaagactgttcaggtatgagaactgtctcaagtcttgagctaatgcctggccaaatagatgtgggctatctcttaacccttggggtaaaacagtccaggtgagttgagacattgggtttgaagcatctttaaaggcaaataagaattgagaatcagaatgtacagggatgcagaaaaaggcatccttaaggtccaggactgtaaaccactctgcttcctctggtatttgggaaagcagagtagaagggtaaggtacagctgggtatagaggaacagcagcctcactgataatcctgacatcttgtactaacctccactgtctattgggcttctttactcctaaaattggaggattgcaggggctattgcatggttttactaggagtagggcttttaggtccttaacaattttttggagtccttgttgggcctcgggtctaagggggtactgcctttggtagggaaaggaggtggaatcctttagtttaactagaacacgacgggcattatttgctcgtccatattgtccttctgttgcccagactttaggattaattcctttttcaagcaggggacaacaaacgggtgttccttttcctatgttcaggtgtataatggtccctgcttttgttagaatgtctttccctaacaagggagtggggtttttaggcataattagaaaagcatgtgaaaagagtaaagttccccagtcacagcttagtggctgggagaagtatctagtggctgtcccaggaccccttggatagtgacagatctggagacagttgtccaggacaggagagtaagactgagaaggccacgccagtgtccaggagacagttaacctcctggccctcaatggttaagcatacccggggctctgtgagggtgatggcatgggctggcgcttgccccaggcaccctcagtcctgctgctggatcatctggttagtggcttctgactcagaggaccttcgtcccctggggcagtgggccttccagtgattcccttgacataaggggcatggacgaggggggtggcttatttctattagaacaatcttttttaaagtgtccttgtagatcgcactggaagcaagccctattaggcattcaatttgtccagactttccctgttccagagcctccgaagtcgtgcttgcctgagggccatgactaaagtggtggccttttctttatcccgtttatcctgttctgcctgctcctcctgatctctattataaaaaaccgaggttgccaagttcaatagggtttctaagttttgctctgggcctaaggtggacttttaaagtttttttctaatgtctgcagctgactgagtgataaacttaacctttaagattagttggccttcaacagagtcaggtgacagagagtttgcttcctcaatgcctcccttagtctctacagaaaggcagtaggattttcttcctttccttgtgttatagtgaacatcactgaataatctataggcttcttcctagttttccttagtcctttagcaagcaagttagcaaatgtctgtggcaccaattccatgttctgattctgtgtcccaatgagggtctacactgggaactgcctgctggcctgtggggaattgttctttttcctctgttgtcatcctatcattgacctgactgagataccagagatcaccaaactctcaggctgcagttatggcagcacttctctcatttgggattagtgtctgatctagcagtaacattatatctctccatgtcagatcaaaggattgtcctaacccttgtaaagcatcaatatagccaacagggttatctgagaatttacctaggtctattttaatttgcttcaagtctgacagggaaaaaggtacatacactctgacaaggccgaattctccagaatacattttaggggtgtttttgccttggggggaatgttttgccagcacccctagtcattttctgatgagcttagttctacagtgttctctatggtcctttccacggtgtgtaaccacccatggacctctgcttatcggattagttgtgctcaccaatgtagcagtcctgcaccccttttcccgcctttcttgaccacaaagaaagggatccgggctgctggattctagtggtcctttaccagcgtgcccaacattgcctttgtgctcaggggtgagtcctagagctgggctgagttcctgagtctttcataacaacctggctgcccatcaagatgcattcccataaacaacagttcttatgcaaattcgtttcagagagggtgaaggtaaccttttgagtcaggagtgagatggagttctttgcccactagggtctttgtccttctttacttttgtaggaatatgccctaaatattgatattaagctttttgttgccccagattaagtccttttgggtacgaaatatgagagagggatcctgtttatcttatgtgcctttttcctacgaggagagcaaggagaaaaagatgggcttgctggttttgtaggtactttaaggcttggctgagtgcaaacagctcacacgtttgacagaccaacgattagggaattctcctaactcttcttccacaagagtctcactatcaattaatgaatacccattgtggtttttttctcaatcacccgagaggaagcatctatccttgtgtcccgaagggagttcctcctaggtctggtaggacctttgtatggtaattaagatttaaatcccctgttaggaaagctgctaggttaagggaattttcagtggttagtgttaaatcaccgttttctaatagaatagcccgatactttaagatttttgagttagtaagctacctttttgcttttttgacttaggatagctctgaactggttatgtgtgctcacaataaggtttcctctaaaggttatttttctactttcttctgttagcaaagcagttaccgctactgattgaatgcatttgggccatttgtgggttactgggttaagaatttttgataggaaggctacaggttgtcagtggtctcagtgtttctggctatgcccttgtttacactgacaacaaggtagtattggagtattatagggtcacagagaagaccttcgattatcaattataggttttaaatttaccctggcttttaaaggaatagggcacactgtttttctttactacttctatctttctatttctttctctctctctcatctctgtctctctctctctcctctctgtctctttctctcccttttctctctctctgcctctttctctttctctcctctctgtctctctctctctctcatctctgtctctctctctgtctcctctctgtctctgtagatggattttggaaaacagcagaaggaagttcgcttgttgaccccatttgccactataggaatatgtgcctccctttagtttactcaatttgctttcatcctgatctattatgttgttgtagacccagttccagaagttaaagtactaggtcatcagttctaaggccctggccaaggagccaaggcttgaagattgtattgaagattgcattgtggggtggtgggtcgggggatgctgggtagaaattaggggaggagagcatcttaaacaatgagagaggaatcctagccatttacaaactcagggcctggcaagagtggtggagaacgggtcccacataactgcccatgtcaaaagttatatacctaaattgggaggggcaccagggacaagattccctggtttcatagcctagatgcctaaggatgcagcatagcgcttccttagatccctttggagatacaacctactctaatacttgggagagaaagtgaaagtctgaagcattagtatctaggaggcagggattggaggaagtagattcagaggtaaggagaattttggggctacactttcaagaaagtcatggttaggacccaagaggtatgggtcagaaggacaggtaggggcgcacacatgggcgactgttgagtagagacttctagcctgcaccatgatctcgaccggccaatgccaggggttcaggacgacagctttctgcctctagttgacccttggcatccctaggaaaattgtgaaagtggaagctggttccaggcagaccaactctcccaacccagaagttgttagaaagccttttcccaggaagcctcacacctgagtctttagtccggtggccatgctaatcgtttttaaccagccgacaggtgcccggtattttcctccaattctaaggtagaggacagaatagcaagcaaaagtggtctgatattactcactgctttggagaatccccatacgaggccaccaaatgttaccagcggatctttgttcttagagctcccaagatgatggtgggctgctcccaagatggggcaggccactcccaagatggcagcaagccttttgttctctgacctgggcttcttggcctcacagattccaaggaatggaaacttgggccatgtggtgagtgttatagctctatcagaagccgtgggacatggaagagaaccatggaaaccactgactagtgttcagcttgattaggatgaacctcggcacttggttgtgcaggaacaaaggtgagactttagcccgatcaggagtggaaatgggtgccttgctggatcaggagcacaacctgccagatccagaggggtgggagtcaatggcgggtctgcaatggtggcaaatagcagttgtggatggtgagcgaaagctcagctcaagccgtaacaaatacggacaagaagagtgtgcagttgcaagatttaatagactgaaaacagagctcccatacaatgggaggggacccaaagggggttgccactccctgctcaaatgcctgggtttatatcctgatcattgtccccccgttgtgctctcaggtgatatatgatttgactatttctttacctccttcttttagcctaatttgtattttagtgagccttctttactacctgattggtcaggtgtgagctgagttaccagcgttgtgtttaaaggtgggtgtggtcaccttccccagctaggcttaggaattcttagtcaacctaggaaatccagctagtcctgtctctcaatacttcaaatattctttacacagacaagccatttaaaaaaaattagagcttacctttgcttttccatcaaaacatattgttacttctaggtttcctcttcaatttgcaaaaggaaaaggaaaatataggtaatttctcaattaaacttacacctgattttcaatatgagtttgtttattgagtgtttgtatatgtgtgtgtttggcagttagaagtatgctgagatttttattcttttagcctttgggggaactggactggcccttcacctctgtcctaatgtagctttttaattttattacaaatgggaaacaatgtaattttctgtatgtttcatctgtgaaaagtattggaaagttttgagttcatatgtattttattattgaattttaaaatatttaaaatgaacttaattaaatcttaaattacagtaaccttatgctgtagtaagttgaaggtaagctaccttctgtgaccttgaataatttaattaaattgagaagtctgttttttttttattatttgttttgtttttaatgggtaaattaaatgccaggcctctgaagtgagttcatataaggaactggttgtgggattttttttaaaaaaaatatgcctatattagagtcctacaccaaaaaaatttagagtttttgactcaaacccaggcactggtatttgttcaagctcctgatgtgatagaccagtatctaagtcctaataaaatatgaaatgatcaattttttttttttgagatggagtcttgctctgttgcccaggcttgagtgcagtggcacgatcttggctcactgcaagctctgcctcctaggttcacaccattctcctgcctcagtctcctgagtagctgggaacacatgcgcccaccaccacgcctggctaattttttgtatttttagtagagacagggtttcactgtgttagccaggatggtcttgatctcctgacctcgtgatccacccacctcagcctcccaaagtgctgggattacaggtgtgagacaccgtgcccagccaaaatgatctattttctaattatataattcaaaaaattgtttcaggaatattattctaaccagttttaaaagtaacatatcaatatatgtatgacattaacattaatggcagtttgtctctttcaaacacagactatctggtacttgtatctaacaatgtatttacaattgtgatcatatatggctagtgttgatgctattaataggatgttccaaacatatatcaagtttttttttttgtggaagtcattatgataggtaatccatatttgtagaagatataagcctttacacaaagactttaacataattacaattcagattaaaattagctttattgggatgccaacaatgaatatattaaagggacatacaggcataactcattttactgcactttgctgtttgtattttttttttaatttcaacttatattttaggttcatgggatatatgtgcaagtttgttatatgggtaaactgtgtgatgccaaggttttgagtacaaatgaccctgttacccaagtagtgaacattgtacccaataggtagtatagttcctccctttatagctatatgtaccaaatgttagctcccacttaaaaatgagaacatatagtatgcagttctctgatcatgcattaattcatttaagataatggcctctggctgcatccatgttgttgaaaatgacatgattgcattctttctatggctatgtagtatttcttggtgtatttgtaccacatgttctttatccaatccaccattgaaaggcatctagaataatttcatacctttgcttttatgaatagttctgcaatgaatctacaaatgcttgtgttttcctagtagaacaatgtatttttctttaggtatatacttggtaatggggttgctgggtcaaatagtagttctattttaaattctttgagaaatctccacactgctttccacagtggctgaactaatttacattcccaccaatgatgtataagtgttttatttctttgcaaccttgtcaccatctgttattttttgatgttttagtaatagccattctgactggtgtgagatggtatctcattgcagttttgatttgcatttcactaacaattattgatgttgagcattttttcatatatttgttggctgtatgtatgtcttctttcaagaagtgtctattcatgttctttgcctttttttttttttttttttctttgagacagagtcttgctctgtcccccaggctggagtgcagtggtgtgatctcggctcattgcaatctccacctcccaggttcaagcgattctcttgcctcagcctcccaagtatctgggactacaggcctctgccaccaaacctggctaattttttgtatttttagtagagacggggtttcactgtgtttgccaggatggtctcaatctcctgacctcgtgatctgcccgcctctgcctctattctttgcccattttttaatggggttatttgtttctcgcttgtcgaattgcttaaattccttatagagtctggatattaaatatttgcaaggaatagtttgtgaatatcttctcccattctgtaggttgtctatttactctgctgatagtttcttttgctgtgcagaagctctttagtttaattaggtcccacttgtcagtttggggggtttttgcaattgttattgaggactcagtcacaaatcctttgtcaaagccactgtccaggatgatatttcctaggttttcttctaggaattttataattttaggtcttacattttagtcttatccatcttgagtcaataattgtatttggtgaaaggtaggggtccagttccattcttctgcatatttctggctggttatcccagcaccacctattgaataagagttcttaccccattgcttgtttttgtcaactttgttaaagattagactgttgtagatatgtggctttattctgggttctctaacctgttctattggtctatgtatatgttttggtcccagtaccatggtgttttggttattgtagccttgtagtttgaagtcaggtaatgatgccatcagccttgttctttttgcttgggattgctttggctattcaggctctttattggtcacatacgaattttagaatagatttttctatttctgtgagaaatgacataggtagtttgataggaatagctttgaatctataaattgctttgagcaatatggtggttttcatgatattgattcttccaatccatgagtatggaatgtttttctatttgtgtcatctataatttttctttgagcagtactttggagttctccttgtagagagctttcacctccttggttagatgtatttcttagtgttttactgttttttcgctgttgcaaatgggattgtattattgatttggctctcagcttaaacattcttggcatatagaaatgctcctgattttttaatgttgattttatattctgaaactttactgaaattgtgtagcagttctaggagaattttggtggagtctttagggttttctaggtatagaatcttatcattagtaaagatagataattttttttctatttagattccttttctttctttctcttgactgactgccctggctaagatttccggtactatattgagtaggagtgggagatatctttgatttgttccagttcttaaggagaatacctccagcttttattcattcagtatgatgttcgctgtgagtttgccatagatcgctcttattgttttgcggtatgttcctttgatgcctagtttgttgagggtttttatcatgaagggatattggattttactgaaagctttttctacatctattgacatgatcatatggtttttgttctcaattatctttacatcctgaatcacatttatggatttacatgtgttgaatcaattctgcatcccaggaataaaacctacttgaatgtggtgaaataactttttcatgtgcttctggatttggtttgctagtattttgttgatgatttttgcttcaatggggatattgacccgtaattttgttgttgttgttgttgttgttatttctttggcagattttggtatcgagtgatactggcttcctagaatgagtcggggaggagtcaccccctccttaattttttgggatagtttcagcagtgttggtaccagctcttctttgtaagtctgatagaatttggctatgaattcatctggcacaggactttttttggttggtaagattttatgactgattcaagttgaaactctattggaatgttcagggtcttagtttctacctggtttagtcttgggaggttgtatctttccaggaatttatctatttccttcagattgtctagttttcatggataaagtgttcataagagtctctaaggatcttttgtatttctttttttttttttttttttttttttgagatggagtttcactcgtgttgcccaggctggagtgcaatggtgcgatctcggctcaccacaacctctgcatcccaggttcaagcgattctcttgcctcagcctcccaagtagctgggattacaggcatgtgccaccgcacccagctaattttgtatttttagtagagatggagtttctccatgttggtcaggctggtctcgaactcccaacctcaggtgatccgcccacctcggcctcccaaagtgctgggattacaggcatgagccacagcacccagctgggatcttttgtatttctttcttccttttttttttttttttttttttttgagatggagtcttgctctgtcacccaggctggagtgcagtggcacgatctcggctcattgcaagctctgcctcccgggttcacgccattcacctacttcagcctccaaattagctgggactacaggtgcccgccactgcacctggctaatttttttttgtatttttagtagagacagggtttcaccatgttagccaggatcatctccatctcctgacctcgtgatccatccacctcagctcccaaagtgctgggattacaggctggagccaccgctcccggctggatcttttgtatttctgcaggattagttgtaatgtcatctttgttgtttctgactgtgcatatttgaatcctctgtttttttctttttaatctagatagtagtctgctgattttgtttatccttttaaagaaacagcttttggtttcattgatcctttttatgaatatttaggagttgatttcgttttctcctttgatttcagttatttattctactagcattggggttagtttgttcttgcttttctagttcctcttggtgtgttactaaattgggaattgcagatcattctaacttactgatgtaggtgcttagcactataagttttcctcataatactgtgtttgctgcatctcagagattttggcatgttggttgtgtctctgttttcatttatttcaaatttttttttgatatctgccttaattttattgtttaccccaaagtcattcaggagtaagttgcttaatttctatgtaatagtgtacttctgagagatcttcttggtattgatttctacttttattccactgtggtctgaaagtatggctggtatgatttcaattttttgaatttattgagacttgctttatctccaagcatatggtcaatcatagagtatgttctgttcacagacgagaagaatgtataatctgtggttgatgggtggaatgttttgtagatgtctattaggtcccattggctaagtgttgaattgaagtctaaaatgtctttgttagttttctgacttgatgatctgtctaatgctctctttggggtgttgaaatccctactagtattgttaaccatctaagtcttttcataggtctagaagtacttgttttatgaatctgggtgctccagtgtttgctatgtatatatttaggatagtttagtattcttgttgcattgaacattttatcattatgtattgcccttctttgacctgttttattgctattggcttaggcagtctggccactccttggcaccattacagtagcttctactggggctatggcagctgatgcctagctgctcagggatccaaggcctgtgcggctccactgggcttaagtggtacccctgcaaagattccaggctggtctctgtgttgatttggagttccactgaggtcaagggcttctcccatgcccaggattgcaaaggtccatggcagatgtttggatcccctgggaactctcactcatcaaccctttcctgacttagggaactttccccaggtctgtactggtcccaggtgggcaagtccttggctttgctcctctcttctctgtgagtcctcttgctttcttgttgaatcccaacatgacatcttagatgatctacttgaagtcgtagcatttactcaccactttgttttctctccatgagagcagcatatactagctacttctagtcagccatcttgagcacctcacctgttttccagattggaaaactgcccatatctggggagctctgcatttttctttagagtgcttcacagatactgcattttttacaaattaaaagttagtggcaactccaattccagcaagtctataggcatcatttttccaagaacatgtgctcactttgtgtttctgtggcacatattggcaattctcacaatatttcaaactttttcattattatatctgtaatagtaatctgtgatcagttctctttgatgttattattgtcattatcttggggcaacatgagctatgtccgtataagatggtgaactttatcaataaatgttgtgtgtgttctgactgtgctagagaccagttgtggggatatgtgagggcagccatgttgccaggcacatgtggggacaagaggaagacaagggaaatcaccatgtttggtggacccagtttctaatggcctttatttgcatattaaagcttgcctgcaggctctaagagccggggctttcctgttagacaagaaacatttctggagctgctttaaaagaaacaaaaacttcccaaggacgccttttcatctctatctgcctaaaataatttcttaataactcctataacaaaaatatactgcaaaagggtcatacctgagaagtctgcttgttgagttgtggtaatttttgcataaatattctagaaatatattgtatgaggtgggaagtggtggtagtgagcagatcgtgagacatcagcttaagtattcattaactacttcaggaaactggagattggaggtctccagtgggaaggagattttcatgaactcagaaaaaatacttcataagggaaagagctaaccaaaaagcaccaaagctggactaagattttcttgcctttctttttccactccattggaggaataagaagcagcagcagtgaggaacaagaaaataaattgttaatagacacattcctttgttccaaactgcagtttcctgaacttaagtcaagcatgagctagggctggggagaagatttaaatctgaagtgatgttgatattttgaaactagttcctaggttaagcttcatataaactaaaagagtaagctcataaggtccacagtggtggacatttttgatgcactaaaatgctcctcaagcaataaagtgagttttcagaaccatgagctttatagcaatcatactgtagccttttcaaagaaaggagcattccagaagaatggctctaacactgttgacttaaggactaactggagcaagccctgcttgttaaaagctgaaaatcttgagctcgtaaacaagtttgaagtcaagtgaacttttaagcagagtgctatgggttgaattatgttccctaaaaattcatgtgttgacagcctaaccacctgttcctaatactgtccttacagaaataatcaagttaaaatgagatattagagtgggccctaattcaatatgttgtgatgttcttataaaagggggaaatcgggaaacacacaggcatactgggagaaggccaaacacacaagagatggccatctgtaagccaagcagagaggcctagaacatattcttccatcacagtgcttgaaagtaatcaaccttgtcaacacttgattttggactcagagcctgcaaaattgtaagacaataaatttatgtttaagctacccagaagctttagttctagaagccctagtaaactaggggggcttgttacatgaagcaagtattcccagctcaaggaggatttactgaatgtggagacttggctgatagggggaactgatgaactcttttaacatgcccaatctgtgccagaatttgaagtgtgaccctaagacaaggctcaaaaatctctgccttctttttggaataaagtttttaggatcactgccacatttattttttaattatctatggcttttttaatcctatcataacaaaaaagaggaattgcagcagagactgtatggcttggaaagcctgaaatatttactttctggctttttacagaaaaagtttgccttgccttgcttaaaacaagggtactggttacagatcctgcctgctgggtattaacagaacaaatgcagcaaatgatgctgatctgaacatgaacccacaggatccccagatcatgacacctctcagtgtttactcagagtagatctggacagtatggattaagaggaagaaattgagacaccttaccccccttttcctccctctaataagatcaggctaaattcaatgcaggaagactttccagggaataagaagcaaaggcactaaaagaaagagttggaaaacaatacctacaagaagagtgaactgcggtcttgaagcattgtgacttaaccaaaattttgggatttactaacaggacatgtgttaatcaagcagttcactttgaaaaggaaagttctagtaagctccacggcctttgtgaaaaggccattgaagtgagagagaaaaccaagaggaccattgagaaactgcaaaaaatgtatgccctaattggcaatacctactttaaagaaaaatgtaataatatcacaatctctacaataaatgttttagcatagcactaaacccacaatatgctaaaaaagttgtcagtagaggagacagaaaataatcctaaagaacaggattgactggtgtacattaatcctgacttgcctttgggaaaaaaaggtaaatacaataaatgcttcagaaaggggaccctctcccacttcataagcattaaatactaaacaagatgtgcaacagaatccacacgacattgagttgtgcaagagtcagcagttggcactgaaggactgggaactatggatgaacccagagctcccatattctcaagggttgtgtagagaaagcacaggagccatgaaaactgtggatataatcccaaaggcactaaacttggactcaagctataaggagattatcagtaatgtccaaaccattgatgtgataaccttttattaaaaaaaaaaaaattaaatagagatggagtctcactatgttgcccatgcttgtcttgaactcctgggctcaagtgatcctcccaattttgcctccaaaagtgccgggattacaggcatgggccactgtgcctggctgacatgataaccttgaggatgggaaatggggaggcatatctaatcctagatccaggaaataatggataccttaaccaagaggaatcttctggcacacatgtgtaaacaatatatacatatattttattggtcaggcttaaaagatgccaatgaaaaacaatatctataaaagggatcaggttgaaatagatggtatgtctttaaaaagtctttaaaggtttaattaagtagtctgaagtaaagaccaacatagtacttaatgattccagtgaaatataaacaagaagcttagtctttttttccctaagatataagagaaaactcagtagtttacaaatgtgattgtaaacttgtgactttctggactacgtcttaagcacatggattggtttgtttgcagtgggttaactgtaggataaaaatcatcaaagtttgatttatatgaataagaagtagatgtagaaaacaatctttgcctatacatgtgttagtactatgtgtacgtgtgtatggatatagaatgaaaaaaaccgcataaatccagtacatctacttaagttatgtaaataattatttgcattttttaaaaaaattgccatgtctacaacacaaattagtaccgtgttagtacttgactaaattctggtaatcttcttatacaattagataggctgatgtatttcctaattaaaaacatttgtttttaactcttttctaatgctttggcaattcatgattggaagtacttgctaatttagatttcctcatggagcacagtaaatatgagagatcctcataatagcctctataggtttaaattatattttaaatgtaaatgcaaaacttaattattttttagaggacctgatgtcatccttgggagtaatttttaattactttttatccttcttagagttgattgtattaattatttgtactggcttaacaataccatactgaaaaagcttttatttttttttttttttttgacatttcttctgtttcagttgatttatcattagtgaataaagatgaaaatgccatctatttcttgggaaattctcttggccttcaaccaaaaatggttaaaacatatcttgaagaagaactagataagtgggccaaaatgtaagtattattttaaaagctactactctacatctcatacaaaaatttacaaaatcacattaggttgtctaatatttggaaagatgtgtaatagaatcctagtacagtcatcccttggcatctgtggaggattagttccagggcctccctatcattccaaaatccacaatggtcaagtcccttatatacaaatggcatcatatttccaaagaacctaggcctatgccatatactttaaataatctctagattacttataatacctaacacagtataaatgtcatgtaaatagctgttatactgtattgtttagggaatagtgacgagaaaaaaagtctgtacatgtttagtatatatgcagccatccatttttttccccaaatatttttgatccgcagttggttgaatccatagagagggaatccatggatacagagaaactttagctgctcagtagtctcatttgattgatgaaataactgaggatcagaataaggtgacatagcaagctagtggcagaatcaggactaaaaacttttacaatatttaaacgtttaagttcctctcatgtgttgacatctctaaaccacatgtaatcattttattttatttctttagtaactaacagaggagttaatattctgaagcttaatttcttcatgattaggctaaattatcaacacttacttttatgataaccagaaatattttctaattatttgaaactgaaaaatcaatatgaagatgagccaaacttgacagttaggaaaacgtttcagaaagatgaaaccaaaccaaatagaatttcagaggaaaaacatttggctgtcatagaaactcagaatacattctttacctttcttcattcttcatgctactggttttcaaattgggaacaatatccattctttaaagtttagtaggccagtcacaatggctcatgcctgtaattgcagcactttgggaggcagaggtgggcagatcacttgaggccaagagtttgagaccagcctggccaacgtggcgaaacctcacctctactaaaaaaatacaaaaattaggccgggaatggtggctcacgcctgtaatcccagcactttgggaagctgacatggatggatctcctaagctcaggagttcgagaccagtctgaccaacatggtgaaacctcgtctctactaaaaatataaaaattagcctggcatggtggcaagtgcctgtaatctcagctattcaggaggctaaggcaagagaattgcttgaacccgggaggcagaggttgcagtgagtggagatcaccactgtactccatcctgggcgactctgcttcaataaaataaataaataaataatgtttagcttacactgtgcaaatgattacaactatggctattagataacactgtgaagttcttaattttagtgattaagaacgtaatttcacaacttgatgtaagaatgatagtttatataatttattaatcatgttataactttatctgcataacttttatgcataatttgcaaaatacataccaccacatttgctctagcaagttttagtatttaatgaatgggggtcatagttaataaaaatggttaatattcatttttggccttaatgtaagagagggcagataattagattgaatgaatttgaactttatagagtgtccttgcctcttggatattcattcagcaaggttgtgaatttttatcccctaagcatttaaaatatattctgccctgctattctattcatatccttatggtcatccacttaagtaagaaaccggttgattattttcaagactttaaagttgcatttcaggaaagcacctcatgctcttctattgttttgtcttttatatttcaccttgtgatgatggaaaatttcatcattttaattaaaccttcttactgagttttcattagacagatgattcagaaaggctgtatattttaatgcttcaggcaatgtacagtgaattaaagaagacttctaagcaaatggacatctattccatcctcgctttgtttattttagtcttcttgttttaagctgtagtgactcagtcaacatcatggacccgcccataaatgtctgtggtgtttgggatgcctgatcacctgcctctttttcctacctcacccatcgtttttgatcccaaaagtgtttgctcattattattttttacctcccaaatatttagcttaaaatcccacttctgatgttttccagctgaagttctgttgggaggaaactttttctctaccaaatgagtacttaggtcaaagtgattgagggcctgccaattaattgacaacagacaggttaacaggagaaaagtttatttcacactcagatacaagaattctacaaggggtagtttgatgaacagccatgggtaagggtttatataccagcttgactaaagggaagagttttagagcttcagtgggaaaatatgaaagtttctattgggttttttcatcatgatgctaatgggcagtatccttcctagctggaagctcccaagagggagatgaatggcagctgaatttgtacctccaggtgctaaggtccatctacctctgaggatgggtcagtagcagctgtatttttaggaggctttgcttaagtttagataaatttctttctgtggctgctctttgttcagatgtgttcaaagtagtcagaccaggcatagtggctcatggctgtattcccagcactttgggaggccaatgtgggtcactttagcccaggaattaaaaccagcctgagcaacaaagagatggatgcagtggctaccatctgtaatcccagcactttgggaggctgaggcaagcggaccacaaaagcccagtagttccagaccaacctgggcaacattgtgagatctcaactctacaaaaaaatacaaaaattagctgggcatggtggtgcatgcctgtagtccaagccacttgagaggctgaggtgagaggatcatttgcacccagaaggtcaaggctgcagtaagctgtgattgtgccactgtactccagcctgggctacagcaagaccatgtctttaaatacatacatacatacatacatacatacatacatacatacatacatacatgtagtcttcatgccacttcagtggtctgttggtctcttcagttttcattctcactgttgccttgtttttttgtactaaaatcaaaccctgcatgtgttcagttgcctctacatccagggcctcccattattgtggtaaattttatctgatcacttcttcctctttgcctccctctatgccacttctgctctacttcttggttgatactcaagccaggtcagtgactccctttcttcttgaccaatggaagattatgggaatcactgagtcaaagaggattacacacttattaaatactacaatgcacattgaaagtagttgcttagttgaaaaagataatgttaaaaatgtataatcttgaccaggcgtggtggttcaaggctgtaaccccaggactttgggaggccaaggcaggcagatcacttgagttcaggagtttgagaccagcttgggcaacatggtaaaaccctgtctctacaaaatatacaaaagaaatttagctggatgtagtggcacatgcctgtagtcccagctattcgtgaggttgaggtgggaggatcgcttgagcctggaatgtgggggtttgcagtgagctgagattgtgacactgcactccagcctgggcagcagagtcagacccagtctcaaaaaaaattataatcttaacagtaacataaaaattagagtgcttcaacaaagcaagattttacacaggcatatagatgtcaaatctctgtctatccaagtattgtaaagtaggaaatgccatttggctcacggattccatcttctccagttttatggcctattgcagacatattgcctaccacacctaagtattgaataaatgattttttgtcataatgcagcctgattttgtaattcataaggctaccatctttgatttcttatactaaggaaaagccaagaatagaggtacaactagaaatattttaggatctgtcttggtttgttcccgctgctatacaaaatacctgagtctggataatttatagagaagagaaatgaatattcttacaattctggaggctgggaagtccaagatcaaggtgctggctgacttagtgtctggtaaggtctgctctctgcttccaagatggtgcttcttgctgtaacctcatgtggcagaagaggcaaacacctgcctcccacctgttttacaagggtactaatcccattcatgagggctctgcccttatgactgaatcacctcctaaagactctacctcttaatactgtcacattggcagatcaaattttaacataagaatttgaaggggacacattcagatgatagtagaaccaaatgatttctaaaacttacacttatttaaggaaaactgtgaaaatagttttcttagaatcttttacctctgtgttagttttaaaattctattaccattaatttgcattttcattttcaactctatgggatttctaaagtagattaataacacattgaagaatatatttgttttgcaaaatggcaatatttaggcaattccagtattctgaaatataaaactttttgggtgattatatttatttgatacttaataattataagtaaaaaggttttgtaacaagaagaagcaacaatatgcctgaagcctatgggtctgttggaatgagtaggcaataggcatgaagtatttgggaataatagtttatattaaatatttactaatgacctggattatttaatgaagaataacattggttaataatcataatgccacaattcagctagaacagaaggatatatcagtcctaaagagcatattgtaagctgggagatgggtattatgttcctaaaatagaatcacaatattttaggtcatttacattgtcaaatctgctacataaagggtgttctctctttttcataagagcaaaaacctactacagttttgtctctacagggattcttctaagaactgtgacagtttaggtaagattatttaaagacaaaaatgtccctttgaattaaatatcaggaataaaccacagagtttactttacatggcagtgtgtgtgtgctgacaggacactgataaaacatgccagagagatgtagatgcctccttcagacccctctagtctcatttaatttaaggatttcttccattaaaagcaatagtgtttgaataagagagcactaagaaaatacatagaatggcatgttacaaagatttttcacaacatctttgtttttgtttttctaattaacattctttttttggagtcagggtgtcactctgttgcccaggctggagtgcagtggcgtgatcatagctcactgcagccttaaacacttgggcccaggctatcctcccacctcagtctcctgagtagctacgactataggtacatgccaccaagcctggttaattttttctttaattttgtagagacgacgtctccctatgttgcccaggctggtctcaaacacctggtctcaagggatcaacccaccttggactcccaaaatgctgggattacaggcgtgagccaccgtccctggcctctcaacatctttattggctaatcatcaattggatcatggaaaaaaaattataatgtaatgaaggcagcccatgaaattgtaattatttacttatggaaggaagctttctaaaaacagggccatttttcactttgtgggatggttacagcatggtcctactttaaagaggatccaggtttctattaacttcctaattttacatcctgcaattctaattttgtgagtaaatactcctagtagatgtctcagaaaacacccacttatagcaatgatttattctgtggcagtgagttaactctctcccatgctctcttttcctttccagcatttgtaaaagaagattacatctatgctgcgactattttaagtagctttgtttgaacaatatattttttcttaactttaatactgatgtttataacggcactttaatctacatcaactctttctaatgacaggccactttactttgggtttatttgggtaacactttctaaatacatttcactaccccaggctagtgggctaacaaaatgaagaagcagactctgtgtggtattttaaagggagggagatgccaaaagcattgcaggaagaaacacatccttaaagattattaccacggtgtctaccagagtaaggagtaggtggcataacattctgagatataaattctctgaggcagaacatagaattttactacctaaatgtaataagatgtattgtgctatcagcaaaggccatggagctctatgtgatgaaaataaaaaaggatccaagtatcttcctttaactaccatttaatgataatgatttttgtctttagcatttatattagaaatcaagaaagaggcaagctgcaggctatctaataataatacaaataataataactaacaattgcccctctcttccatccttagttcttagcagcctatgtttattctcaaagaaagtcctcttccttcatcttagtttatatggtaatagaaatgttagtttaaaaattgtgttctacaccacatgctgatgaaggtagttttagcattagatttacattaggaaagaagactcagaaacagggtactatgtaaccgtctctttcacatgttatctcatttatttctcatgggaatcctttaaggtccatattgttacccatttacttgtacaaatgtggaaaatgaagccctatagcttccaataaatgtggtctcatgaccagtactgacctggagctggcttataccagatgtcaaaagccaattattaaatactcagaatttctgttggtagtatgaaatcacccatgatgggagtatttataccttggaaatctgcaaaggaggaaaaacagtgctctagtcctctggtcttaccaccccttttagggagtaccagcccaccagcaccagtttactgacacagattcaacccaggttggtactatacaaaaagcacattttcattcctttctttcaagatgacaaacttttggattcctaaagaattaagaactgttacccagaaaaaatgggttttattcttttggtgagtaacaaaggtctttctggagacatggatgatgctggaaacatcattctcagctaactaacacaggaacagaaaaccaagcaccgcatgttctcacccataagtgggagttgaacaatgagaacacatggaatcagggaggggaacatcacacactggggcctgtggggggtgaggggctaagggagggagagcattaggagaaatacctaatgtaggtgacgggttgatgggtgcagcaaaccaccatggcacatgtatacttatgcaacaaacctgcacgttctgcacatgtatcccagaacttaaagtataataaaaaaaaaagtcagaggaatatatagcaggctcaaatatttatctttttaattgtgaaatcatctttgcaatatttattatgaaataagttttaaaatattgcataattctaaaatatgatttaaaataaattatttctctgtagtaaaaaaaaatagagcaggttttgatcaatagaagtttgattacttggcataagtaaggaggacactgggagttttcacaaaagcagtgtctcccagaggaaaagtgacagggaagttttatggggtgatagggaagaaggtgcatcatctcatgtagaggaagagttccagttgcggagatgcagtgagtaatcacaccagtgcgtagatcgcatcttatggtaatgaagctatagctcctccccagggtggagactttagcatggtaatgaggaaatttcacacagactcgtctatgagttgctggggtctgtcagaagcttgccctaaccaacaaggtgacagcattacacaccaggcttgggaaaaaaacaagtgatagggcaggaggctgtaaaacaggctgatggttcaactttattaaatgttataatccctggagacccccctgcctgcttacagaactatcacattcagggcatcataagatacaacaatgtaacagcactcagaggcgcttcatcttaatcctctgttttaatttcttctatgtttttcaagtgtatttgccttcttcatttcatggaaatttcttgaaagttgaagtactctatgtattttgcatttttctactatgcctcctgggatacttactagaataataaaattgagctggaatgtgacagatgaaattgctagcaaatatgtcaaaccaagtagtattggctttgattattcataaattttgttatttacctataaaatggtatcatgagtataatcacattttatacacttctattaaatttacagattatagctatatttcaatttataatcattttagtctctagccttacaaaatagtatggaagttttagtatagatactacattctacaggtataaaagtagtgttcaaataatcttaaaaattgcaaaataactgagaccaaaaaaattagactctagaatatagcaaaatattaaaataacatatgaacaatctcccccattcctcacaaaaagaaaataaaagaaatttaaaaagagaagttaaaagacattaatcccaagtattatatattttgttttaaaaaggcctgattttatataattactaacacatagaaaggtccacatagaaatgtttatttgctaaagctgatatttgaaataatcacacacatgcacataaaagctaagatatgtttatgtccgttttcaatttcagagcagcctatggtcatgaagtggggaagcgtccttggattacaggagatgagagtattgtaggccttatgaaggacattgtaggtaagtacaaaacactgaagtttttccaaatgaattgtaaagatgttatcatttagttataaacacaggctcataaagtcaaaatcttattgaagaacatagtgattttctattttaatctataatagtaaaaaggaagtacactttcaacttaaatttgttaactcaaagattgctatggtgagcataacaaggttatttatataaaaataaaatatatgttatttttttctgtcatactttaaatgtaatatttatcacacatgaaaaacacatacattgtattaatttataattgaatacatttcataaaaatcaactgaaatgaattttctataatttaactatttgatataatgaacattttcacatgctaaaggtgtaaaacaccaatcatgtttttgctcatttcaatttaatctttggtgatctatttaaattttagcttcatgttactgaaaatgacatagctgatgctgtttttagtctaaaatgtgctatcctaaagagagttatatatactatcggtggtatttaagatagttttagatggtaaatgtgttaacattttgaaaaaatttatttaattggcttaaatattcagcattgtttaaaatttaaggtactgaacaaaaaaattaatgatattttggtaattggagtggtgctatttggaactattttaaggacttagggaaaactcaagttttcaaatcctttttgaaagcttattctcttataagcaaacataaaaatatctttattgcttcattccatttgaatcttgaccagtaattagagagaaaatcaacgtggctggaagggaaatggagtggggaaagctggacttatgcatagaaaaaactatggcaactggcaaatcattaaaatctggagactatcttgtttatttaaaaagtaattattgattttttgctatatgtcatgacttgtgggagctctgaggacataaaagtgaataagggctgggcatagtgacacacacctataatcccagcactttgacagtctgaggtgggtggattgcttgagctcaggagttcgagaccagcctggccaacatggtgagatcccatctctacaaaaaaattttaaaaattagccaagcatgctggcacacccgtagtcccagatacttgagaggctgaggtgggaggttagcttgagcctgggaggttgaggctgcagtgagcccaaatcgtgccactgttgttcagcctggacgacagggtgacaccctgtctcaaaaaaaaaaaaaaaaaacaaaaaacgaacaacactcaccttccttatcctcatagactgccagtaaaggaagatgcaaataaatccaaaattaatgtacatacataagtaaaatacaaagaaatataaaattaatcacactaccaaagaggcataattttccagttgatttaggactgaacacatgcatgtaactactcttttttctaaaacctcaccaaagaattctgaatggaatagaaaaaaaaattacaaagtctaaactgcagaggacaaaatagaatgccaaaggagatgataataatatctggggagttggctcgctgatagacaagtggtaattgcctttctcaaaaaaaaaaaaaaaaaaaaaaaagtaaaccaaatcctaatctcccaatggcaaaaaaataaaaagccagctgctttaccctgctaatcacctgaccatgaaaagagccaaattctgtaaaatatttgaagagtaaatttttctgtaaaatattctgagccaaatatgagtggtcatgacccaaggcacagtctcaagaggtcctaagaacatgtgcccaaggtggttgggttgacaaaagacatcaatctacacatgtgaagtatccataggtttgggggagaggaggggacaggcgcacaggtgggaagtgtagtagtttataggtcataggattatagatggagtcaaagattttctgattggcaatttattgaaagagttaagttattatctaaaaacctggaatcaatagaaaggagtgtctggaggaagataaggggtgatgaaaaccaaggttcttattatgtagataaagtctcataggtggctgcccttacagacaatagatggcaattgtttcccattcatacctgtaaagggttctagtctctcagttcatctcttcaggattggaagggactgaaaagggaaagatttggttatattcttcatattcttgacagatgtaaattttccctcacaacagaaggctttgtagggccactcaaagtatgtcaaagagacatattttggggtaaaatattttgattttcttctttatctgtcatttgatgttacgccagagtaaggttggaaagtaagcttgtcatataggataaaataaaacccatctggtgagattttatggtttgtaggatgttattccccaggcctcttaggaatttgggcaagacagaaaaaaggtcagagtttagtcctcacacctccagaaggtagtgatgaaaatatgaatttttaaaaaagaagatttgttgaaattctgtttaaaatacaattagaatatcagatccccttgccaacttgatgctgcaggtgaatactcccacaccccatttcaggagatgactagaggattaatttccagaaaagggaggagaaagggtctccagactgccatgacaaacaccacagactgggtggcttaaacaatataagtttattttttcgcagtactggaggctagaaattcatgatcaaggtgcaaagtgctgtcagggttggtttctagtaagggttctcctcctggcttctcctcttggctgccttttcactatgtcctcacatggcctttcttttgtgtactggaggaaacagttctctggtgtctctcacacgtcttataaggacacctaaggataccagctctaccatatcaagccctcacccttatgactgcacttaaccttaattactaatttgtaggcctatccccaaatacactcacattggagattagggctttaacatatgaatttggggccaccaactcaattaataatatataccatagttgtaaggtttctgtatcggtttgaaccccgagagcacgtcaatagacaacacgaggtggtgtggagcaacatgctgttttaatgagcgcctgggtgcaggcgggctgaggcctaaaatggcatcagcaccaagtgaggacaagacaaaggttttatagtctcctgtaaacaggaagtgttctagtctgacataactgctgcgttgtacctggatggcctctttctcgatcttcagggttacgtgtcttccggccagggtagctgtctttcggtcggctctcttcctgcttctgatatcttgctggcgcacgccgctgacgtaagtagccttgcgccttcgtactgggcctgagaaggaaggagttattcatctccttaagctttcaggcctcagggagaatcgtacattcccgtctatttggttgtagataaaagggataaggggcctctttctcaataactacttcacgtgtgatatagggggtggtgtgggcaccttggaaaaacaaaaccttaattttttgggtattcttgagagacgggttggtatccacattgtccttgtagtaggagcatcatctgtattgtctggaaacgcgtctgtgcctgcaagacagttatgttgagaggacaaggaggtgtcaacagggagaggtatagcctcatttgctgcttcacgaatgaaagactgtgtctggattaaggaggggaggtaatttctgagtgggttagagtttggtaagggtggaggccctaagataaaagttcggccatacatgattttaaagggactataaaaagaggctgcttttggtgttgtgtggagtctcatgagggcaaaagggagattttttgtccacgactggtgggtttttagagccagcttcgtgagttgcgctttaagtacagatttagttttttcaactttgcctgaagattgaggcctgtagggtgtgtggggaacctacttcatatttagagatgtagagacaccttgaataatttggctgatgaaggccggcctgttattgggctggatggatgttcagagtacgaaatggggaattatatgcatgatgagagtttgtgtgacgacatttgcaccttctgaagttgttgggaacatttttacttacctggagaaagtatggacaaagactagaagatagcagagcggcatgtgagtgaggtttacttgccattcttgccttggtacctggccccaggcttggtcggtaggaaaaggtagcggccagagggagccttggggtgacactgagtggcagatagagccagactgggtaatttctcagacatggctggaaaggtgaggacaagtgagaatagggtggaaaagttgcaagagaggtttgtaaccgacatggaaagagttgtggagtctttggaggtgaggaagattttgagagtgaggaagaacaaagcacctttccttgacataccatggtccttgcttttgaaggttttgggctcagaagtcctgcttttcttctgaggagtaaagaggagagaacaaggacagggagagaaactggccttgcacggatcatagggctatttgtttcactacctgatctgttagcgcatttccagccgatatgtgattgtctggggtttggtggcccctgcaatgaatgatggcaactttctgcaggagcctgatagcttgaaggagtttgttgatgagagagccatttatgacaggagtgttttttgcagctaggaaaccccgttttttccaggtagacgagtgtgactgtactatatggaacgtataatgaatgacaaattgaatatatgttaatttgttgtccggctgtcagtgtgagagcttgagtgagggcaatgagttcagcttttgggaggtagtgcctaggggcagtggattggcttcaatagtatgtgggggcggggggcgggggacactatagcatagccagcatgccggcgtccttgctgtaagaaggagctgccgtctacaaaccaagtaaagaaggggttcatctgttagatttggaaaaggtataagaaaggtttgaacagtgttcacacagaagtgtttagggtctttggcggttgtagcttcaggtaagagcatggctgggtttagatgggagctggttagcatagtgatttggggggtttctatgaatagagcatacagttggaggagtcatggggcagagatgagactagtacactgcagtgagttggcatgtctttgatgttatgggttgaataaactgttaggttggcatggagagatagttttaggcttttaagggttaggacagcagctgccgccaatggtcggaggcaggcaggccatccaagaactgaggctttaagctgtttagagaggtaggcaataacctgaagggtgggtcctttagactgggttagaacacctagtgtaactctatgctgttggtcagtatagagggagaaaggtttggtgaggtctgggagagtgaggacagggctgaggtgagagccttccagagtagacggaaaggttgggtaataggctgtgcagatttttaaggctcatggagtggggctttagcagcttggtataatggtttggcaagtagagcgaaggagggaacctagagcctaaaacatcccactaatcctagaaaagagagagaattttttgcttagtttgcagaggcaggagggattggaggagagatatgcagtcagctgtgagcccttgggttcacggggtaagagctagccctagataggtgactaagggggtgcataattgtgctttcttagaggagacctaataccctcgttttgtcaagaagtttaaaagagagagatagtgtgggtgttgcagtgtttttgagaggggctacacaggagcagattattaacacattgaaggagagtggatggttttagggatagggtactgaggtcaagagcaagggcctgtccaaaaagatgggggctgtctctgaaaccttgaggtagtatgcaccaggtgagctgatgtgaaagtttggagttggggttttcccatgtaaaggcaaagaggttttgggaatcaaggtgtaaaggaattgtggggaaaaaaaagcatcttttaggtttagaacagaaaaatgggtggtattagacagaattacggaaagtaaagtatatgggttaggaactactagacatactgggagtacagcttggttaatgagcctgaggtcctggattaagcgataagtttcatctggctttttgacaggtagaactggtttgttaaaaggggagtttgttgggtggagtaggcgactggtgaggaggcgaaaatgataggctttaggcctatgcgagttgcttgggagatgggatactgcttctgtgataggaactgggtgggctttttaagggcaatgtggatgggggtgtggtgttttgtgactgagggtgtggaagtgtcctaaacagaggggttaactacggatgggggataaggaaaagttgcatgttttaaggtggcaggttggaggagtagaagaaagttagaagccccagaggggtctgggttggtgcgttgggtactatggggaacatggaagtgaagagtagtgtggagctttgaaaggagtggagtttggcatgagggtaggactaagaaagtgagtgaaggaaaaggtgtatagggagcagaaaagtggaggggtggcttggggtttggagacttgtctattaatttctacaatagagacttgggagaactcagtgggtcctgaaaaattaggtaaagcagtgtaggttgccctggtattaattaaaaaacatactggcctacctgccaccatcagggttacccttggctcggatgaagagatggtagttgccagggtgtccatttcagggcaccgtcactcttcagtggcaaggccgatgagatcctaataggaggttttggccagcttcggaagggatgggggcggtccttgtggggtccgctgacagtccaacctccggtggggtcctccgcaaagggggcatggcctggtgggcttacctgggtttgggcattgtctggaccagtagccttcattgccacacttgaaacaggcgccaggtggaggtggattgctaggaggcttccctgttgagctgcagccctgcgggcctggtggaggtaagcatttgagactacctgtgttttgcctttcattttcctcatcacgattgttaaagactttgaaggctaaattaagaaggtctccatgtggggtttgagggccgtcatcaagcttctgaagtttgcgtggaatattgggggtggactgggaggtgaaccaaaggtttaagatagtggttccttttcagctggctgagtttaggttggtgtattttcttatgacttcagttaaacaagagagaaaaagggctggttttcgtcaggaccctgggtgatttctgaaagtttttcatagtttactactctatgggcaccctttttgagtcctgcaaggagacacacaatcatgtggtcttgatggtggcatccagaggccccatcttgataataccagtgggggtcctgattgggaactgcctctgcgccagtaggctgggcaggagtttggtgatgaattgtatcagcctgcgcctgagctagggtccagatatggtcttagtcttctggggtgagggtggaagagaataatgtagaggtcatgccaggttagtttataagactgggtaaggtactgaaactccctaatataagaggtggggtcttctggaaatgaaccgagtcttttgttaatttgagacagatcagtgagggagaagggaacatgaactctagtaataccttcagttcctgctacttcctgaagtaagggtgggtcataggctaaagatggcatctgaaggagtatgggccggagggaaggaaaaagccggaagtggttcctgctgagggtatgaagggggaagggagttgagttgataagcagtggaggatacatacgggcgtaaggtggcaggatgggtttataggcttcaggagagggcgatgaggaaggagaatgagtacaggcaatgctagaattgtcctgatgggacggtgtaggaaaagaagtggatacagctgactgggaaggtggtggctgagaagatgatgactgagaagacaacgaacgggttaaagaaggcgattgagagaaagaggtagtggctgggaggcatggacagcagtctgctggattgaatgaggaaaaagaggtagggttgggaggagaaaggtgatctggatagcaagaatggaagagaaggatttgaacaggtaaacaagaattgtagaggtcgggctgtgatctgagtgcaaaaaacgcctggacatacagaatttctccccatttctccagtcattggcaataattgcttaagttcgttaaaattataaagtcaaatgttttatttgagggccatttagatgcattgtttaatttgtactgcatccaggctatattgtaaaaaaagacggggcacttagggtggatatcttgtctgaggcctaaggtttgcagggttcttttatgaggcagcctagagggctgttttttggaatagaggaccaagaatttcccataacggagggtaggcatgggagaacagagaaaaaggagaccgtcctggacagctggagggagacgataaaaggagtgatcgtcactgctgcctttttcgttcccggaatgggatcagttggcttagaggtgtcccctaagaacagatgatcagcaactgcctggcacacaccagagccttcttggaccaacgctggatttttggaccggagaaaccaagagaggccatgtagatttttccctgttgacagagctcccaggaaacttactggtaggtgagatcagtgactaatgtgcatgcagaggggtgactggaggctgaggagtttcctttgtctggctgctgtggcctactctctggggtggaggggtaggcccaaggaggacgcagacttgagcccctcccaggttttggcaccagaacgtaaaatttttgtattggtttgaaacccaagagcgcaacagacaagatgaggtggtgtggagcaacatgctgttttaatgagcgcctgggtgcaggtgggctgaggctgaaaatggcatcagcaccaagtgaggacgggataaaggttttatagtctcctgtaaacaggaagtgttctagtctgtcgtaactgctatgttgtacctggatggcctctttctcgatcttcaggagtatgtgtcttccaaccagggtagctatcttctggccagctctcttcctgcttctgctattttgctggtgtaccctgctgatatatgtggccttgcaccttggtactgggcctgagaagggaggagttactcatcttaaactttcaggccccaggaagaatcttacaatagtgaaaaaaaaagcattaaataaatgtttatccacttgcactcttatttagctaccagtccccacacaggaggctggacaagtctactctgttatctgcacaacctaaagagtctgacatgagggcatttcccagcacgatgggcaaatgggatcaccttacaacaaaccccatcacgtgcagaacacactgttaaaaaaaaaaatcatgagccaaactaaatttaacggagtttaattgagcaaagaacaaatcatgagtcaggcagcctctcaagccagagtaggttcacagactccagcacaggcatgtggttggaagatttgtggacagagaaagtaaagtgatgtacagaaaatggaagtgaggtacagaaacagcctgattgggtacagcccagcatttaccttaatttaacatggtttgaacagttggtctcctttgattggccaaaatgtggtgattagcacaagagtaggttacagtctgcttatgcctccatttaggtaacagttcatgattttcagagaaagctttaggctggacttaaaatatgtaaggaggcaagtttaggctaaagttaatttaacaatctccctttttggtcatcttctcaattttgagagattgaccaaaactttagtcattgatgtaactatcaccatcataaatgtccttatttggtttcaaaacccaccggaaaatagcataatagtggattttgtaagataggaacaaggacttcggtaatttttttttacgggttagagtagagggtacctcctcatgctggaatatcctgtttacaggagaaaaacaaaacctagtctgttctaggatatatctgtttccttgaagtcttattttttattatgtcacatttatcataagtgactgctttttggtttggtctggtctgtggggtcctagtgcatgagctcactccaaaacagtatcctcccataattttgtttaaatctgttaaaagaaaatccttaaccaaattaaatttatccgagtataattgagcaaagaacgattgacaaattgggctgcctcccaagccataatagactcagagatactccaccgcagccacgtggtggaagaagatttatggacagaaaaaggaaagtgacatacagagaagggaagtgaggtacagaaacagccaggttgtttacagctcagcatttgccttatttgagcagggtttgaacagtttctcttctttggccaaaatgcggtgattagcactggagcaggttacagtttgtttacatctccatttaggttatagttcactatgcacagagaaacctttaagccaaacttgaaatatgtaagtagatagctttaggctaaacttgattcaacaacactcatgtttattatacccaaattacaaaacttttcatgaaaatctatttttatacatccatgttgtgtggaaaattttttaaaaaaagaaaaaagaaatctgtttttagtttatgaccatatgaatatgttaacctattaaattttttttaataactttatagggggccaggcatagtggctcacacctgtagttccaacactgagaggccaaagcgagaggatcacttaagcccaggagttcaagaccagttgaggcaaaatagtgagaccccgtctctacaaaataaataaataaataaataagtaaaataaataagagaagaaagaaaaattagtggggtgtgggtggctcatacctgtagtttgagctactttttaggctgaggcaggagctcaggaggtggaggctgcaatgagccatgattgcaccattgtactccagcctgggtgacagactaagaccctgtctcaaacaaaacaaaacaaaacaaacccctcaaacctcaatagaagagttgtaaacaaaagcaaactcaagttcctaccaattattattaatcattacattatacaaatttctattggttttgtgcgactatgttgtagatcagaatatcaacttctagtttaagataacagattgagtctgagagtggtggctcatgcctgtaatcccagcactttgggaggctgaagcgggcagatcacaaggtcaggagttcgagaccagccttaccaacatggtgaaacgctgtctctactaaaaatacaaaaattagccgggcattgtggcacgtgtctgaaatcccagctactcaggaggctgaggcaggagaatcgcttgaacctgggaggtggaggttgcagtgagctgagattgtgccactgcactccagcctggtgacagagcgagactccatctcacaaaaaaaaaaaaaaaaaaaagaaaaaagaaaaagaaaagataacagattgagtacagaccgaaaattctccgttctatgacaaataccgaggagtgactgaaaaaaaaattaacaaacatatagcaacagttaaaaataagtaaatagaaatctgcatagaccagaaatttacaactattattgaagaaaagaacagtaagaaaccagaaagtagtattttgggggcagctcacgtggagtcaggctcagtgtaggacttgagtgaaagactttcccaagaagccccagggctaatctgggcagccctggatgcttaggtctggaacccagggccagaatctttgacagccagatccagtaaaggccaaaaccaagaatctcctcccacaccagtggattctcaaaacacagtgcacttgatcaggctgtcagaattacctagagcagtgcatattctgatggagagaattctctgaacaatcctgaattgcatttaaaagtgtgcgaaatatttgtgtaataaatccttcgtttgtgttcatttgttagaagccaattctaaacattcaaatattctaatatgtaaacaaaaaaactggaaaaagaatttgcatttaatttgaccggagaatatgtgcttctcttagctgtgaattttttttcactttattcagtttgctttcagaacataaactgcattctaatcctgttattttgttcttaatatttatcatcctctaaagagaagttagaatgtttatatagaagccagggaagtggtaaagtgatattattcagtgagatttatttatgaagccaataaatcctgcaaaaagatgtcctttgaccatttaaaagtttacagctctattgcaacttattaaatgtccaagagccttgttgacacataaatacatgtatgacacataaagatcactgaaatttcaaacctgtcacctttcattattgttactaaggaaaaacaaaaaataagagaaagactataaatattcagtcttgtttagaaaactaaagggattaagcttattttaaatttttaaaagaaaatttgtcaaccatagctgtaggggttttctgcctgtctttgaaaaaccacacagtaatataatttatattctggcccacaagactgccgccacttcagatgccagtcaaaaatcctagaaaccacccttactttagacgcaccagctgtaaattcagggatttccacagtgccctttgcaggctccataatttgctagagcaatttcagaactttactttcactttactttatgtttgccagtttactataaagatacaactcagaaacagccaatggaagagatgcatagggcatggaaatgagggagcttccatgccttctctgagcctgccactctcttggtacttaaatgtgttcatcagcccagaacctctctgagtcttactgtttttataaagctcaatcccagccctcctctccctctgggaggtcagtgggtagagctaaaagtttcacctctactccctctgatcacttggtctttttgatgggcagccccccatagtgagatgtctctcagggccccaacttaagtcactttattagcatcaactctcctgtgatctaagggagcttgttatgaataacaaaaaatacttttaccacttggaatatccaagggttttagcagccctgtaccctgaactgagaacaaaaaccaaatatttcttgttataacacacctatgggacaaaattcatttagttttctacatttttgtctttgaatgctgcattagttaaattagatgtgtttggtcccaaaatataatgtgggatatagaagataacaattatttcttaaaatgggcaaagtgagttttgtagacctgaaacttcgtaaagaaaatatttataactttcccaaagcctcaaaccttatatgacaaatgcattgtcacattttatttgaagtcttttcagtggtctgggttgtaaatcagagttaggaagggtgtgatagctcctatggttagggagtttagagccacaggaatttaagagatttgccatgctgaatgggccctgaacccacgacctgacccgtaggtaatttagtttcctaaaccattggatccatctttatcgataaaggagcatctgtttcggtctttcagatcatactattagctccaaaattttttaacttccaaaattaaatacatattagtcagagaaatggtccttacttaagtcaaattgaaaaaatgaataaacgaggcacagtggctcacgcctgtaatcccaacactttgggaaggtaaggaaggagaatttcttgagcccaggagttcaagaccagtctgggcaacatggtgaaactccgcctctgcaagaaatacagatatacaaaaattacccaggcatggtggtacattcctgtagtcccagctattcgaaaggctgaggtgagagagttgctggaacctgggagtttgaggctacagtgagccatgatcatgctgctgcactacatcctgggtgacagaaaaaaaaaaaaaagaaaaaaaaaaaagaaaaatgtgtaacttcactcaaatagactcttttagaatgtgtttttttgtgtgtgttcattttgtttgcaaaccccatgcagcttcccgttttgccttggttactaagaagttctgagaaaaatttgatcaagtttgaagtaacaaaaatatttaataaattctaatttgtttctcatctgcatttattgtgttgctactttctatcattcttcctcaaatagttttgtattacaatttatctgaaaccctctttggaagtaagtgtggtttaaatgatgaaataattaaaataattttgtagtaactgcagtaaagagtagcaaaggccaaatttattttttctacttgctagggttactagcagcaaatccatatgggtctgcagcaacctcggtttttgcctctttagaagaaataattcaactgaggggcgtaaggcaggagagatcaaggcaaattttagagcaggagtgaaagtttattaaaaagttttagagcaggaatgaaaagaagtaaagtatacttgaaagggccaagtgggcaacttgagagatcaagtgcatggtttgacctttgactttgggttttgtattttggcatgcttctggaggcttgtgtcccttctcccctgattcttcccttgggatgggctgtcctcatgcacattggcctggtagcacttgggaggggctgcatgtgcagtgtgtttactggagatatgtgcatactcacttgaggcattcttcccttaccagctgaatgtccctagaaggtcacataagagacattaaaaattggccattttgcctcttaatgtacatgcttgagcccactcacccaaatcctgagatattgggaaactgctgatcacgagtttcaggtttttttctatcttttgggagactgtctttccctggcactggctgcaaccaattattattttagagagacagttaacaactgcctgaccatcacctgacattcctggtgatgggaaggagatgcctgccctgctcatgtctgcctgactacctactgtaacaccaggttgtctaaatgtgccatgagcaaacagacaagttgtatattttgggtcgtgattgagtcttccaggttcttaaaaccacagcctttaatttaccataaaaaattttaaaaagaagttaccaggaggataataaaaattattatgtgtacaaattgatagtgtggatagagaagagaaagaaataataaccatatttattcatagaagtagaaaaaattcaatttcagatgagaagaaaaactgttaatgaaacattttatagagagccaataattcttcaaaacatggaataactttcccttataattaatgtcatattatcaagatggtagaaataaaattgctgaagaatattattaatattattattaagcttacttctccctggatagataaaaatcacacagcgttagctacatgcattcaaggttataaaaatggtgtaatgtgaacataaatttgctttatgaaatccgtggctgaccctcagagaagcaataatccctggaagctatccccccacagctgcagaccctcagtcatgtaccagccacctctaaaggctgctgaaatttgttacttgaaaaatggaatgtaaagttcttggacttagcctaattacaaaccttacagccaaatccacaataacatttgcatctgcttaataaaatatacagaacattgtatggcagttatgagacccgtaatgaaccctcttatccaatggtaaacagcttggggccttgtcatccccactttgcaagagatttgaaattatgttaggattaaaaagacacagagggaagttggttaagatcctcagtctcaagtcaaatacacagagtattttctgtaaacaatgctttaaccctgaaagaacattcttattttatttttcttctacaagacttttggtcagttagttcatctctttgcacatcagtttcctcgttatgaaatgaagagaattagagtaggtaccttattgagttgctatgcatgctgaaataatacaagtcacataattagaagtgctgaaatacttaatggatccataaacattagcttgccagtctttgagaccagaatgcagttgcttgcatttaactaagttttatcttctggtaaagcaaaaatatgatgttcaataaataaataaacaaggaataaataagcagagaagcactctttggattagagcactggctcacactcatctcagaagtgatttaaatcttgacatttattgcagtgagtcatagatgatctgataaagtaaagatcctttcaaaacctgctaagctctccagaagcattttaaaaattttgccccaacataactggagctcttgatgtttccacattaattcaaaataattaggaaaaagtaaaggaatgaagaaaaacaacttgaataaactttggttaacttttaaaaaaaaaagattgttagtgaaatgatgatattgaaacatcttaggacaatattggtttcagaaatctaatttgaaccaaaaaagataggccaattaggtaaataatcttttgaaaatacagacatacctcaaagatattgtggcttggttccaggttgctgcagtaatgcaaatattgtaatcaagtgaatcacacacatttttggttaaacagtacatacaaaagttatgtttacactatactgtagtctattaagtatgcaatagcattgcatctaaaaagcaatgtggataccttaattaaaaaaatactttattgctaaataatgctaacaatcatctgaaccttcagtgagctgtaatctttttgctgatgtgggttgtcttgcctctatattaatggctgctgaccaattgggatggtgttacctgaatgctggagtggctgtggcaatttcttaaaataagatagcaatcacgtttgccatgttaattgagtcttcctttcatggaagaaatctctgtagcttgtgatgctatttgatagtattttactcacagtagaactttcaaaatttgaagcaatcctctgaaatcctgccactgctttatcaattaagttaatgaaacattttaatcctttgttgtcatttcaacaatgttcacagcatcttcaccatcttcaaaatcttaaccatttttctttgcactttcgtaagaggcaacccctcatctgttgaagttttattatgagattgcaacaattcagtcacatcttcaggctccacttctaattctagttctcttgctattccactacatctgcaattatttcctccacctgaagccttgagcctatcagtcatccatgagggttggaataaacttccccagttcctgttcatgttgatattttgacctcctcccaataatcatgaatgttcttagtggcatctagaatggtagatcctttccagaaggttttcaactgactttgcagagatccatcagagggatcactatctgtggcaacaatatcctcacaaaatgctttttttaattgtatttaatttttttttttttggaaaagcagtctctatcgctcaggctggagtgccgtggcacaatctcggctcactgcaacctctgcctcccaggttcaagtgattctcctgactcaaactcccaagtagctgggattacaggcatgcaccaccatccctggctaatttttataattttagtagaggtggggtttcaccatgttgaccaggctggtcccgaactcctgaccttgggtgatccacccactttggcctcccaaagtgctaggattacaggcataagccaccccacacctggccttttttccaaatttttaactttaatttttgtattttgttttttatttttattttttatttttgagacagagtcttgctctgtcacacaggctggaatacagtggtgcaatcagctcactacagccttgatttcctgggctctggcaattctctggcctcagcttcccccgagtacctgggaccacaggtacaagcgaccatgcctggctactttttgtatcattggtaaaaatggggtttcaccattttgctcaggctggtctcaaactcctgagctcatccaatccacatgcctaggcctcccaaagtgctgggattaccctgcccggctgccaaattttattcttaaagaatactacttgaaagtcaaaattactccatgatccatggactgcagaatggatattgtgttagcaaacttgaaaagtttaatatccttgtacatctccatcagagctcttgggcgactatgtgcattgtcaataagcactaaatgttttgaaaatatttctttttctgagcattaggtctcaacagtgagcttaacatagtcagcaaaccatgctgtaaataggtgggctgttgtccaggctttgtcgtttcacttataaagcacaggaagagtagattaagcataattcttaagagccctattattttttgaatggtaaataaatattggcctaaacttaaagtcattagctatgttaatcctgaataagattctgcctgtcccttgaaggtttgtagctgagacctcctttctagccataaagtcctagatagcatcttcttccaatagaggactcattcatctacactgaaaatccgttgtttagtgaagcctgcatcaatgatcttagcttgattttctgggtaacttgctgcagattctccatcagcacttaactgtttcaccttgtactttttgtatttcaaatagccaacttgagacaagtttattagtaatttcatggtacccttttgtgggctgattctcacctcacccttccccaagcaactcctgtgactaatgtcaaacaatatgtccttttgttgcttttttcagccacccttacagacccccaacacaatcaacctggaaatgacctcagtatgtgtaatcttaagtcatcttgctaacgcagacacctctgaggttcccaagaaaacttcagtggagttctctaaactgaaaccttgagagaggaagattttcaagtaggaaccagacaaattcacttaaaactcaccactacacacctgtgtcatagaagcattccattttttctattgcagatgggatttcctcttcaagcttactgtactgtgtctttttaaaaaatagttgaagacatcggaataaaagctaatgtcccaaacagcgcttccctggatattgctgtttctttaaaagcctttttcccagctcttctgagatggtccatgacattgcctttcttgctcattaccttgatcccttgaatgggcccaaaactttggaatgcaaaaacattcattccattgacttggttgagaaagatgataggtcaggttttttttcatctaaagattatcctgggcatacttcatttgggcccaaatgagggattattccaaagaagattgaagaagcaattactccttcccctagtaatatactctttggcaatgattacagtttgcatttctgctgataatgctgtgtgctataattatatgtaagtttataagaaacctggggtaaaaccgtggactttctcccttttgctggcatcatctacagaaataccatgggcatcatgaaaggcagtatagctataggctgaaaaaagcagggttcagtttgctgctgtcatgatgccctgttgagagactgctcttcaaagtttcttgtatcattgggtcctccaagtcaggcctgggtgcctctttatttacaaagagtagttgcctctattttctcaattgaaatgaccagatttttaagatctaataattgtgtccaccgaagaaatcatcaataaaaggatctgcatttcatgatacacaagtgcacctggaccctatgcagggagtggcactgctgcaccctggtcactgcctggctcctatgctatgtactcctcttcctgggacctatgtccaccttgaacttctaagtttctttccttaaaccttatgagccaacctgtgctagtttcacacttttcttttacatcttcctcacctctgtcaggcttcaaagaattgaagagaattggggccttgctctggtttaggctttggcttaatggaatgttggggctggtttgatcatctgaccagatcactcaaactttctccatatcagcaataaagcttgtattagtctgtttttagccactgatgaagacatacccaagactgggcaatttacaaaggaaagaagtttaatggagaactcatagttgcacatagctggggaagcctcatgacagtggcagaaggtaaggaggagagagtcacatcttatgtggatggcgacaggcaaagagatagcttgtgtagggaaactccccttttttaaaccatcagatctcatgagacttatttactatcaggaggacagcacaggaaagacctgccctcttgattcaattacttcccaccaggtccctcccacaacatgtgggaattcaagatgagattcgggtggggacacaaccaaaccatatcattccacctttggcccctcccaaatctcatgtcctcacatttcaaaaccagtcatgcctttccaacagtcccccaaagtcttaactcattccagcattaactcaaaagtccacagtccaaagtctcatctgagacaaggaaggtcccttctgcctatgatcctgtaagataaatggcaagttaattattccttaaatacaatggaggtacaggcactgggtaaatacagctgttcaaaatgggagaaattggccaaaacaaaggggctacaggccccatgcaagtccaaaatccagtggggcagtcaaatcttaaagctctgaaatgatctttgattccatgtctcgcatctgggtcatgctatgcaagaggtgggttcccatgtggtcttgggcagctccacccctgtggctttgcagggtacagcctcactcccagctgccttcatgggctggtgttgagtatctgtggcttttctgggcgcatggtgcaagctgtcagtggatctaccactctggggactggaggacagtggccctcttctcacagctccactaggtggtgtcccagtaggtacactgtgtgggggctgccaccccacatttcccttctgcactgccctagcagaggttctccatgaggatcccacctctacagcaaacttctgcctggacatccaggcatttccatacatcttctgaaatctaggcagaggtgcccaaaccttgacttctgtgcactcacaagctcaacaccatgtggaagctgccaaggcttgaggcttgcaccctttgaagccacagactgagctgtaccttggcccctttcatccatggctggagtggctgggactcagggcaccaagtccctagtctgcacactgcaggtgggctctgggtcccacccatgaaaccactttttcctcctagccctctgggcttgtgatgggaggagctgccatgaagacctctgacatgccctggagacattttccccattgtcttggggattaacattctgctcctcgttacttatgcaaatttctgcagctaccttgaatttcttctcagaaatttggattttcttttcatcgtgttgtcaggctgcaaattttccacactcttatgctctgtttctcttttcaaatggaatgcctttaacagtacccaagtcacatcttgaatgctttgctgcttagaagtttcttctgccagataccctaaataatccctctcaagttcaaagttccataaatttctagggcaggggcagaatgtcgccagtctctttgctaaaacataacaagagtcacctttgctccagttcccaacaagttcctcatctccatctgagactacctcagcctggatttcattgtccatatcattatcagcattttggtcaaagccatttgacaagtttctaggaagttccaaactttcccacattttcctgtcttgttgtgaaccctccaaaccattccaacctctgcatgttacccagttccaaagttgcttccacatttttggatatcttttcagcaatgtcccattctgctggtactaatttactgtattagtctgttttcatgctgctgataaagacatacctgagactgggcaaattacaaatgaaagaggtttaccagagaactcacagttccacctggctggggaagcctcacaatcatggcagaaggcaaggaggagcaaatcacatcttacatggatggcaggaggcaaggagagagcttgtgtagggaaactcccatttttaaaaccatcagatctcatgagacttattcactatcaggaggacagcacaggaaaaacctgcccccatgattacgtcccgccaggtccctcccacaatacatgggaattcaagatgagatttgagtggggacacagccaaaccatatgaaggctgttggtctttcttattgttgtgttcactgaagtagcaattttaacttctttcaagaacattttctttatatttacaacttggctgtttggcacaagagacctagctttcagcctacctcagcttttgacatgtctgcctcactaagcttaatcatgtccagcttttgatttaaagtgacaggcatatgacacttcctttcacttgaacacctaaaggccattgtagggttattgattggcttattttcaatgttgagtctcagggaacagggaggctggagaagtgggagagaaatgggggaagggctgatcagtggagcagtcagaacacacaacatttattgattaagttctctgtcttatatgaatgtggtttgtagcatgccaaaataattacagtattaacatcaaagatcattgatcacggaaataataataaagtttgaaatattgcaagaattatcaaaatgtgatacagagacatgaggtgagcacattcttttggaaaaatggcactgataagatcagttgatggagggttgccacagacctacagtttgtttaacaaacaaacaaacaaacaaaaggccaggtgtggtggcctatgcctgtaatcccttcagcactttgggaggccaaggcaggaagatagcctaagctcaggagtttgagaccagcctggacatggtaaaaccctgtctctaccaaaaatacaaaaaattagctggatgtcatgtaacagaggtagaaggattgtttgaccttgggaggcagagtttgcagtgagctgtgatcatgcctctgtactccaacctgagtgacaaaataagacaaaaaacaatgaagtgaagagcaatgaaacaaagtatgcctgtacactaaaaatcagtctgttgtagctatttgatgttaagaacactaaattctttagtgcctttaggtcatatttgtagtaaacacttctgttaatgttttgaaactttactatttgcaccacccccagttataagtgtacacattcttgcatgttggactaaccctgtccttggacaaaggtcagtagcagatgaagattgcattttgtgatgtgctcagttaagtttaatttaaagtggtccattgtacaataatgtttgtatatgtgtacagaaaaattgttcaaatcaggaagggattatttacaaagaattggcccaagtgtgaggaggccattgaaagtgaaatgagggaagctctataccaagtgtaagtgtagtttaattctgcccagcacatctggaggggaacatgtgtgtaggtgcatcacattcccaagccagaaaaattttaggtgattcaaaatgaacactgtattgtttggagaaccaaaatgtccaggaatctgtatcgtgttttgtttgtttgttttgttttttgagacagaatctccctctgtcaccctggctggagtgcactgctacctctcctgacccgccaccttccccaggctcaagcgattctccaactcagccttccaagtagctgggaacacaggcatgcaccaccacatccagctgttttttgtatttttagtagagacagggtctcaccatgttgcccaggctggtcttgaactcctgagctcaaaccatccacctatcttggcctctcaaagtgttgggattagagatataaaaccatcatgcccagcctatatccaaattttctttttatttgtttttgtttgtttgtttgttttcttatttctttctttgtttttgtttttgcttttttttagatgcaggttccactctgtcacccaggctagagtgtggagtgcactggtgcaatttatagttcactggaacctcaagcactcttcctgtctcagcctccagagtagctggaactataggagcatgccactacacctgactaatttttaaaaactgtttgcagagacagaatctcactatgttgcccaggcccatcttgaacacttgggttcaagcattcctcctgcctcagcctaccattatatccattttaatcagaatataatatttaagcaaaaatggaatgtctgagcttctacagaaagcctcctttttcctgcctcttccatttcttgattttatttgtgataattattttttcttttattttctcctcactttattctttaaaatgcttctctttccactaattctgtatttttcttcatattactttttctttcctccttccactcaccctgccattttttttaaataaatggttttccaaatagatgtgtgcaaataacagggagtcaagagtaagatcaagttactttagatagtgtttgttttagaaatagcagtaaaaattcactctataattgttctgtggtcgacaggtttatgcaaacctatcccccaaaccggaggaagctgaaaggcccaagtaagagactgataaatccagtttctcagaaagaaacatttaatagggagtgagaaacagaagtcatgatgtcctggcaattgacaacaacaagattagatagtgaatccccccgtaccattacccaccgcgtatgacttatatgtaaaacatagggaaggattatgtggaacaattgaagtcaacctctcagggaacggcaagaatgctatgtgaatctgcctaagggcaggatttatggtagcagcagttaaaatagaaatcttaaaggcattcccagaataagggttacccagaagtcaacatggcagattaacacccaatatagagttgctttagcctccacaataatgtagggaaataaatataatgaagatggcagtattttttaaaccatatttcaaagaaatcttctctttgaaacatggagaagaaggcatatgtcactatatgcaacataagcttatattcatatctatttagtatatccaggacaaattttatttagttctaggaatatacagtgagatttttcttactgccccttgacgttagatattattcaccttacagtgatcagagatacgtcttttagcatccaccacttgttcatcaaccttgtctgtcaaatggagaaatctatgtggcaaatgcaacaagaagttttccttgacccaataaagatacaggtccttccttaaatggctatgttgaaatataaattcttaaattatatacttatttacatggcttctcccctctagtgaacttatcctggaatctgtcaattagatttattctatgtactgtctattcttttaaaatgggactctctcagaaatatccctctggataaggtacacatctcatttttctcagtgacagtaaaggggcgtaatttctattacacaggtctaattgccttgaagaaacatcataaggactcaaaacatggaaggtattattattgttgtgattatgctttgaattcttaagtaaccaatgtattctctgtctctggatctgtttctagtgtcaaaacccttgttagcaggaattagatcagattatattaataattatgtagtggatatcttacttttgcatattttctcatcagacaatacacgtctatattatcttttatctcagtgtgtatgaataaatgtcagagctatttgggtcataatttgctatgcggctgttttgtcttgttatatatttcactgtaataacagtgagttatgattcacaaagtttgcctccttttataaaaggtgtattttaatttgatgttagaaacaacgaactttaaaaatgtaattggccttaatatctttttagattcctttgaagatatacttagcacaaaaatatgctccttgggaatttgacaattgagctgataataggatatatcatttttagtttacaggcaaaagcaaatgcttcattattttgttgttatttactacatcataaaagaaatttaattttagctagctgtgtgcatctaagtccagatatcatttgataaaatgagtcaagtgggaaaacttccatttctttgtgatgacacatcaaatatgcccttatctctaaagacattaagaatgattgagtgaagtcttcctactttgttttttcagtatctttagacatagtacaaacatctaaattacgatatgtttattttacaggagccaatgagaaagaaatagccctaatgaatgctttgactgtaaatttacatcttctaatggtaagttttctttcccactaatgtttagaacacattcatttacagaatctgatgtttttctatctttaattcatgagcttctgggggtttacttatttaaaaataaattgtgaggttattttcatttttactaggaaatgctggaccatgatataatagcttcttcctaatcatggaagagttgactcttgagaagagctttagaataatgaacagttcttgtctgggaaaataaagaataagagccataatgggtaaataggcaaactacatgcaagcctacaaaacagtgatgtacaatgctagcaaagcactgacctttttggaaagacaattttctaatggcttcagcagagtgagttagtggatcagtatacttttgtatattaatataggttaaaaaagacttggagtattaaatttttaaaaagaggtctagtaccttaaatgagttaatgtgtttaaagtacttcttacatcttactcaataaacagttttaccttaaagtgtcaaatctattatctattagggatattgtgttaatggtgactgcccaatgctttaaagaatcttgacttcattttttcaagtatgttttggaaacatgtctacaagttcagatatccctggatttgactcccagctaaattacataatgcttatttgaggttgaaaaaggcttttggcatctctaagtcttagtattttcctttgtaaaaatgagaaacataatatctacctcaaagatctgcatgagaattaaatgtaataatatgtgaaaattgctttagtaccctggccagtgatcaacactcagttaacagtagctatcatcttcgttgttattgttgtcaatatcactctctaggaactgtgtggagaaatgaaagagcttcactgaacaaatgagctactatcaatacaaataagacatacatagaccataatatttcagtgtcatgccatcaaaattaccatgaaatgctttgggaagataatttgtcaattaacagctttttttgttgttaatcatcagactttaagtttcatcaattaatatataagtaaagtttgaggattcgttatcacattcacattttcccccgagtttgctgtttcattgataagcaaattgagccaatatcttctttctctttgagattcactggaaacatggctaattgaaaaggtagtcctgacaaacacttaagatgttgagttaattaatgtctttaaaatactggagattataaaatgatagtgtgacataaaatgaacaaatgtataaattgtgtattaatgctttctcaataaatccattttattgcagttatcattttttaagcctacgccaaaacgatataaaattcttctagaagccaaagccttcccttctgatcatgtaaggacttcttcaaattgtatttatgttctttctactcttcctagagcagtgtatcatttgcctgacttgaatgtttactcactaggcttttccaagcaatcttacaataaaaagatctgtcaaatgcttttgattaaattttttaatagattatagctttatttcttttgttaaagtaaaacacgtgttaagggaagagaagatggaataggaacattgatttattagtctttttaaagacattgagcaaaccactgctctaaatcaagtgcagttataaatgttttattaattcttattgctcttttattttatgaaatcaaatcaatacaaaccccagtgcttaaccctttagctaaatagaataggaatataaacttttatttgtccagtgtgttttcatagcatgctagcataaatgttggcccattattatcaaaatattatttattagagattaaaaatatttcttgtgatttactaaaaaaagtcacattactttacttgatgatgagttgtttattcttacttgataagaaatgtaatggtttcagacacaaacacaaataaaagtacaatgtaagtctgggcacagtggctcactcctgctatctcaacacttcaggaaaccaaggcaggaggaacacttgagcccaggagtctgagaacagcctgggcaatatagtgagacctcgtctctataaagtaaataataaataaataaattaattaattttaaaagtacattttatattttagttttggtgttagagaaactttatttctctatattattgctgtcttttactctagcccttgtaattttagggcaagtaattatgtcaaatggaataaaaccctaatatcttactaaaatggatcaaaatcctaatatctacaaaagattccaggtcggtgtgggggcttatccacatgcatatctggtactcttaatgaagtaaacttcttaatgccttttttttagctaacttactcttcctagggtaagccatttctatatcctatgttcaaggatgacaagtccctactattcattttgcttattttgcaaattctggttttgacttagattagatgatttaatttcttattctaaaatctcttataattccttaagtcaaggagatccctctgttttcatctatctcaaagaatgttcagaattctatatgtgaattttattaagtggttcttctctgttgtgtattttgtttaggtgttttaaccttcaccttggatttaatataataatatgcccttatttttactttattatttgttatttcaatgtacttctgtgctctcagcttgatttgataaatacatcatctttcctttttagtatgctattgagtcacaactacaacttcacggacttaacattgaagaaagtatgcggatgataaagccaagagaggtatatgagaaagaaagaaatatttgtcatgctttgtttagtattgatttttttcttcattttcctcaaaagtttattaaaatcttcattactttaatggaactttcaagaaagcatgaaggacctatacttctgttactattagatcattttgcttaaaatagagaataactcagatgtgtatttattttcatttttcaagggctagccatatggcaagcaaactatttttctgttaataccactggattctgccatattcttcaatgggatgggaaaagggtgacaaatttagtatatcattttcaattccaaatgtcatgcccatgggtgccattaaaatcatgctaaagaccagaattatttgttaaaatggaatcgtgactatatttcatgtcccctcttactctaagtatcaaacattttctttgtgtttagactaggatagtggagaaagggatgtggtataatgggaagagctttggctttacagtctggctaatatttccagtgaaatctcagactctccagtttactgggtatgtgactttgggaaagttactttattctctgagactcctttatatttaaacagataacaaaagcatgtgtctaatcaggcttgacctaagatctaaatgtgtactttacattaatagagataaaaggctcacagactttgacatttaaaccctgcagcttgtgtaatttgtcactagtcgaatcatacagaataaattttaggtttcacataagatgctcccagaccgctagtcattgtttggacaattacttctttcaacccagaattactttgaataaattaaagatgtactctattcacttccatttgccaacatacaataaattaatggaataaaaagttctcacatgagaggatataaattgagaggatataaattgttaatttctagcaaaaatgaacatagctgctaataatcacataagtgaccaatattgtggagtttcatgagttactcataatcttgggaccactgttgagcattacctagaacaagtcaacatgagagagggccgtatcctgtcgttgaaaaatgtatttcttatgtgcttaatactgattttttaagatataaattaagtattagtatctataatattttccttaccactttattggaaattatggtgggtaaaccttattagattgttttaagaataaagagttttggattgccaagttatcaattttacttacaattaatgacattcttttctttatataaagtatacttcacttaataattcagatattttaataacaatcccattaatattgggatgccaatttttattgatgcccattttgtaaacaaattcctggtttcttctagtagagagtttatttcacacccacacacatacacactcacacacacacacacgtactctcttaacatggagcagagtaattggcaaataccaagataattaaaaattaaaagtaaactataggataatatcttaatgagcttcccccaaatattaacgtaattaatgatgcattgacctcaaaatcatgtcagacagcactggagaaaattcatggctgggtgcagtggctcacgcctgtaatcccagcactttgagagtttgagacaggcagatcacgtgaggccgggagttcaagaccagcctgaccaacatggagaaaccccatctctattaaaaatacaaaattagccagatgtggtggcacatgcctgtaatcccagctactcaggaggctgaggcaggagaatcacttgaacctgggaggtggaggttgtggtgagccaagatcgcaccattgcactccagcctgggcaacaagagtgaagctccgtctcaaaaaaaaaaaaaaattatgaaaacttcagaattgctaggatacaggatacacataggtactttgtatttaactaatttttttcagctcaagttgtttgcaagaccaaatctaaattcattcacaacctttagtaagtaatcaattattagttgtagtggcaagatataaggaaaaaaccctctattatagtcagttttattgatatttttcttcttgtttgggtcttgagctttagattagtttggaggagattttaatcttaatctaatagaagatattggctaggtaaaactcagataaaagatgtgtaagtgttatgttttctttggtttagtttaatttagtttagtttttttctgagacagagttgctctgtcacccaggctggagtgcagtggcactattctcgtgcttccgccacccaagtagctgggattacgggcatgcaccaccacacctagctaatttttgtatttttaataaagactgagtttcaccatgttggccaagctggtctcaaactccttacctcaagtgatctgcccaccttggcatcccaaagtgccaggattacaggcgtgagccacacacccggcatgttttctttttttggaaacaataacaggatatcagattgataaatgcaataccaatttctgataatttatcttgctatataatacttcatggacttcttgcactttgtggtgttttattagtcaggaataaggagaaaacaacttatagctgtggaaagagtacaaattaatttttaaaaactggagaataaatcaagcaattcggcttttgaagactttcacttgaaaaaacactttttactttttaattatcatttcttaataataaaaattatgctcaaatgctgctcttatgccagatttttaaagaaccttaatctgaaaaaaaaaactattttataatgcaaaagggctcacggtgaaatttagatcggcaatatgaaattacaaatttattattatcgatatgacctaacttgtgcctaacttgatttagggggaagaaaccttaagaatagaggatatccttgaagtaattgagaaggaaggagactcaattgcagtgatcctgttcagtggggtgcatttttacactggacagcactttaatattcctgccatcacaaaagctggacaagcgaaggtatgcacgccatttacttcttcccaccttactccaaacatcactctacttaagagtgttctaattgcatgacttgtgaagtactttagcttgtgtctgagtaaaactatttcaaaagttaaaaaaaaaaagagtaaaccttgggccaggcacggtggctcacgcctgtaatcccagcacttgggaggctggagcagggggatcacgaggtcaggagtttgagaccagcctgacaaaaatggcgaaaccccatctctactgaaaatacaaaaattagctgggcatggtggtgggcacctgtaatcccagctattcgggaggctgaggcagaagagtcacttgaactcgggcggtggagattgcagtgagccaagatcgtgcccctgcactccagcctgggcaacagagcaagactccatctcaaaaaaaaaaaagcgagtaaatcttacatttttaaaagaaaatctgtaatcttttttgcttcaggcatctctatttaaactgcttttttttttttttttttttttttgccacttctgtggtctcacctccttagtagcagctgctctgtgcatttgcctctagtcagcaggccaggcaagctgtaggtgatgccattggtactcagctggtcagtcaccaggaagcagacaaaatacttaagataggaagtacatgctaggtctattaaaaattcaactcatactttgtcatactataaatcactctataaatgagttttcacttaatgctgagtatctaaagatgaagaaatgcagaattcaattttatcagtagatcaaattttatacaagttactttaaggaggccattttattcctaagactcttgaaaattttttatactgcctgtaatgagagctttttttcctacccactactaaatcacagttaaattgttttgaagtcatgtctctttgtatgtaagtgtttgtaaaaagtgtttttagtatttatttgaaaaaaaagggcaacattcaacagtcacaatttgtgtttaaaatctttaaatagcacttctatttcattcagcaatcaagccatgtatttaaaaatgtgacaattgaattttattctgaacattaataagttatgggattaatatacatgtgagatctagttaatatattcagttattgaagctaatgaatggaactaattaaaatatatttagcactgttatcagcagtctctaggaatttctaacaacgacttccaactgctttgacggataactctgaaagtggtgcattacaaaagatataaagataatgtcttcttaatttagatgttaaatgttaagcaccaaaataaagggaggccaataaaaaatcatattttaaaatgttatgcaagtaatcagcagtccctgcttccttagtatacacgtatgtctcattaaccttcctagacatgagacagcaagatacagaagaaagaccatgggtttccatcacacaatctgaggttcaaatcttggctaggtcatttaattgttacacaatcttgagcaagttacttgacatctcgctttaaaagtgctaatttaacataacagcacccaccttacaggttcagtgtgagaatgatgaatataaaacaccaaatggattggcacacattctgctattaaatgatggtttccttacctttctactcttctcaattaatatgatattataaagtggttgagagacactttcttttgtttcccattgaaacacaaaataaatttgtttactttaggttttataagtaaatctcatacttaagtactttgattgctaaagccatttgttaaatgttttgcaggttttctttaacttaaaaaatatagtaaatgcctaccaagttagtctcatagaactctcagtcaaataaatgaaggtaggaatgagcagctttaagtgtaactatgaagaagcaatcaatactatgggaatcaaatggggatatagcagatgtagatttatccattatcaagattattctaacaaatttttaccctcttgctgtagttcctcctattatcaaccaaggtgaggcaaagttctttgaaatgtagacttcgataggtctctctggtggtctggtcatctgtgaataaaactgaagagagaggcagagaagaaattaaaggtgtcaatcaagaaagagataggaaattctaagaacaaagggcatgacacagtcactggtagatttggacatgtgaggcaaaaaaacgttttcagaaataaagcatggtgggaatacaaaatgatggtgggatggagcaatgagagtcaatcaggaggttctgaggtaaaatcttcatagtcatgtgataaggaagaagaaacagaaattgtgaaaaatattttaatttaagaaatgtatgtataccaaaaacagcatgaatcataagcaaatagcttcatgagttattttgaggccttataaccatcaccccatcaagaaaaaaaaagtatttccaatactcagaatcctcaatcgtgtcttcttccaaatactacctgttaccttctgtctctgtccacttgggctgctataacaaaataccttaaactgggtaatttaaaaacaacataaatatattgctcacagttctggaggctgggaagtgcaagatcaagatgccagcagacttggtgtctgcttagggctgctgtttgtttcacagatgacgccttgttgctttgcccttcctcacatggcagaagggctaagggagctttctagagcctctaatacaaagggacaaattccattcatgaggaatcacttaatcatgacttaatcatttccaaagccctgacctcctaatactgtcacattgggtataaggttgtgacatataaaattggggtctggggagaccaacatttagaccgtagcatccccctttcaaatttataattcccctaacttctaaccacatagtcagctttgtccattttgaactttatataaatgcattattttgtctagttttgaactttatatgaaggtatacacaggttgaatattccttacctgaaatacttgggaccagaagtattttggatatttttggattttggaatatttgcattatacttactgcttgaacacaccaaatctggaaatctcaagtgctccaatgaaatttttattctttgagcattctgtcagtgttcaaaaagttttggattttggagcctttcagatttctgaatttgggattttagatgctcatcttttataaagtttttttttgtgtttggcttatttgctacttttatatgtgtgagattcattcatgcagtacctagcagtacttttgtttgttttttttttctatttcagtgtatttttacatagtatgaaatagatcacaggttttttccgttttatttagggtagatatttggattttattttcatttgagaactactaatataataatacatgctactctaaatattcacataaattttggggggtatacattcatatacatttctgttaagtatatacctagaattagaattcctgaaccataaggtatttgtatatttatttctaatcaataatgccaatcctccaaaaaagttgttcttctaccagcatatattagactttctgtttctctacagcttcaccaatagttactgttttcagtctttataattttagctgttctaagtagtttgcagtggtaatgcgtggcagttttattttgcagttccctgattattgataagattgagaatcttccaaatacttgttgattttctatatatcttttatgaaatgcttgttcaagtgtcttgcccatatttctatatggttagctttcttttcctggtttgattgtaggtggtatagaaattgattttgaaggagagagaaaatacaagatttcaagtggtcatcaaagaagaaaactaattaataaaaagaacaattgataatatgactttgattcacacaatagatttaagatactgaggcttttcttaactgaggaggcctgagattgtagcaagtgggggaggccaaggaaaacaggttagagagctcaataacaagggaaggccagcatgtggcaagagacatcagtttgaagatgcttcttcaagatgaagatgtgccaacccatctttttggagctctgtcttacttccatgtttctatatttttcatattctgttacttgtttctactaggaacttctttcctacacccactaattgtagatgtttctgattgtcccctgcattgtatctctagtgatttttaaccactgccataattcagctaccactgtcaagtgcagactccaggctactcatacaataggaaatagcctgcatcttcccactacatccggatgtcctatatgtaccttgggatcaatatgctccaaagagatttgtgtcatccacaagatgtctctactgtatcatcatgtcaccatctttctggaccagtacactcagcttttctgttcttgacctttttaacctatctcttattaatttcatcctttcagggtctgtctttcttttaatatttctgaatcaaagatgaatgttttcagctacaagaaacaaatgttaaccttgggtgaaaaatgcagatttctttttctcaccacgaaagacttgaggcaaggggctgctggggtccactcagcaactcaattatgtctgagtgccatctcccaagtttccttagagttttctcagactttttccatcacagtcacaagatatttgtctcaaatccagaaatctcatttctatttaaggcagagagaaggaagaagggagaagcagcagggcagcttcatctgtttctttcatcctaagtgctaaatctttcccagaaaaaaacctagcagattcctgctaatgactcactgcttcctgaaatggcagctaagaaagagcatgagtaaggaaatatttcacatctatggccctaaagtagagagagactaagaggaaggggttgggaatgggcttcgggttggctaaatataatatttcttatgttcctcaattataccctcataggatctcattgttcctaacccattttcctctttcctctttcattgctcctttttcctttttttctatccctttattcttccccctcgctctcctttctttttgttctctcccttgctctctctctttcttttttcttttatcgtctcatttcacaaagcatttgaaacaattcatggaaaattgacaaggtgaaaataagatataaagcaagaggaatcaagactgtatgcctaaatcatcttgaggtatgaatagactttcccacaaatttagattataataagaaataggaaataaataatgaaaaatattttaataagaactcttgatgtgttaggtagaatagttattggttataaataaatacagtcacaaatgtcttcacagtgatagatgtttatattttactcatgcatcgggcaggaattaactttctctccatccattaattcaggtttccaaaagattcatggttgtgtcctttggcttttgtgtccacagcctctgtctggattcagtcaaaggaatgcacactaacttctttaaagtcttagcttagaaatggcaacatttacttccacttatattccattgactaacactcagtccatgaccttttctgggaaatgaagtatcactgcatgctcaagaacagctgttagttttgctacacctggaactagttattgtgtgttcctgatggaataggatacttattctaagatgcagtatggcattttcattaacagaatgtgtagatcaggaagacacagtcagacctggacttgactctaggtctctacattacttttcagcatagttttaattcatttactaatgtgagttattttgtccatttaacaaattaggaaaataatcgtgccaacttcacaggtttgttctaaagagaatgaaaaggtatacattttaaaaatacttagtgcttagcagatggtaagcactcaataaatgttagcagttgtcaacatgttaagaaaaaaaattggactatccaggcttgttggaaaaagaaataatgaagaaatgagattttttaggcagaaagtgaaatatccagaattttttattaaagactgtcactgaatagttccacactagaattaaaaaaaaaaagaaaagaataatctaagcagtttggccaggactcaagagactaaactgaagttttaaaaagttaagagatggaacttacaaaaattttaatagtcttatttttaaaaaactcagcacaaactctttgtactcctccatccctttctaatttcatctaaagtggcttaaagcacatggaaacttaaatgggacctagttgttaggaagagccaaataagtatttgttgaatgaatgaatgaatgaatgaatgattcccttaatttctcacatcttttacacattttagtgtacctaatggatgctggcatatttgttttttttcagcttactaaaagttgaatgcaaatggtggttaaaaagaagaccaaattctgcaaactccaacattgttttattagcttctacttctttgtgtgccatatgatgctttgtttgggtgcaaacgtctcacatctcttagactcaatcataagctgtttaaattattaaaaaataataatcacaatgatagcccaggcagtttgaataaaaatgaattacttctggatccagaataatttaaggcaaaaatcagaaatacgaataaagacatcattaataaaatcatttagtaaaatcacaggtacccaaaccacatttaaatatgaatatccacctcagtgaaccttctatttatcttcagatagtcctaattattttttaaaaacaattttgagtttattttagaacacaccattgagtgatcaagcctcaaatttctacagaaagcttggccgtgatgcttttagtcctgaaaattggaaatcaactgtcgtaatattataatagaataatatctctgtaatatctctattacagtagaatgatatcaataatacatgggatatcagaacttgagcaattaattagctagaataaatgagtactaaacacttttgtgtacaaatataaattagcataatgtatgaaatttttatccataaaaattaacctctttcataaaagtttaatactggaatgttaaataagtcatctttaccagaaattgttgacattagagacattttgctattgtcactggccattcaccgaataggatcttagtgtataagaagaatcctgtcgctattgtttctatagtagaaccatagaatagcatgcatttggatcttttatcagtacatatttggtcagtaaattataataaaggagttgcaaatagaaacacctaacttaacctggattgtcagggtgagaccttcttaaagaagatgagatctgagccaattatagaatatgggtagaagttatcaggtaaaatcccttctagaaagttaaaaatattggtaggattgcagggaagcaagtatttcagtgtaatttgtgtaattttagaaaagggaggacaagtctataaagcagaccaaaggccaactaaagaaggtcccactaagccatttagctttgccctgaagacccatggaaagccattgaaaggttttagccattcaaagagccatatttatattaattttacaaagaaatatcctgcatatggtgatgagaatagattggaatgaaatacaggtggacgaaaagaggcaattgcagtatctttgcaagaatttgaaaactctctgttgcgtgggcgccgtagctcacgcctgtagtcccagcactttggaagcctgaagcaagtggattgcgtgagcctaggagttcgagaccagcctgagcaacatgttgaaacatcgcctatataaaaaattaaaatatagctgggtgtgattgtgtgtgcctgtagtcccagctactcaggaggctgaggtgggagtatcacttgagctcaggaggtggaggctgcaatgaaccaagatcacaccattgcactccagcctgctggacagagtgagactctgtctctaaataaataaataaataaataaatatgctctgtcattatgatacagttcaaaagatgaaggtatgaaaggacagatccatttcatgcacacaattttttttatctcaggggaaatcatttttattcatcctcattccctcagtgacaataaaaacaggttacgtataagcatcagaaataaagtatctgtactgaactcctgtagtttaactcacctttggttctattcacagaattcaagaaaaagacatgttaaatacacacaaacacacacatatatatatttgtaaatatttttgggtatgcttatatacgtgtatatgtacgtgtatatatatacttgacacattttcagggtgatagaagatatactatatctgcttatgaaaaatgttgattaaggaatttacacctgtattttgatgtaggggaaaatgacataaagcttagatgcaatgttccattagctaattggtctttactcttcactttggaaatagtggaagattgttttgttcagacagatagtgaacaatctgtagtcttaaatccatgcaggtggaagcctaaaatatgtcaaataagtcaaaatatgttggtgaggatcagtgcccaagaatctgaaaattttgagctgtttctaagaagtcttcatcaggtgtttaatttaagcttttgattaaatagaccatttgagaaataatgattaattctcaatggaaatgaagcctggcctccagatgttgttataggattacagatctgggaaaagcaagcctcctggttgtcaatcaggatctctgcttctgcagccacccttatcaaagccatgagggatatctatttctcctgaattagcctcattcattggcataacagctaaacctagggcctcccgaaggaagtgttacacttaagttttttgtagatgatagatgtttcataaaatacttaagttgcctaaagcccagagtatattcttgaatattccatttttcatgcctcttgactaaccaaggaaggcagatttaagtctttgttaaactgaaaaatgaaagtgttccaatgtgaaatgtacacatcagttctaatttattctaccctccataaaagtggaaaaggaaggctatgtctcatggcaataaaaatggaattccaaaagatctttgggcagaaaaaaaattcccaataaaatatgagagatttcttccacaccattctctgaaattcacttctttcatcagttaaattatttatacaaacaagattagggatgtcaacatgaaaggttagtcgatttgaagagaaaatattttcgcagcagataatctatcttatggaggagggtggtgagcaaagaagataatcatcatattgtctataaaacctggcatcaaaggaagcaatttagaagcagtgtcttcgagaattgtcccatagtgtctatgcaatattatcaaattcagtatgtaaataaatattttaaaataaagtaaatttggttgaggaataggccattcatgttgacacagtaatcagcagaaaaataccttatgggagactgttcctttattttatatctaaatggggctatctccagatataactgtcactagtacgtgatggataaattaaatacttgcttcaaatccactttataataagactagtaggtaaattgatgaataaaggttaaaagtcaccatgtgtctgaaaagtcagttggactttgttgggacagttgtgattggcaccatgttttgcctacttgaatttcctgcatcgtgtttctcccacaggatgaccattgttcctttactgattgtggaatagaatgcaaataacttcagctctttatgattttgcatatgctgaattatcagtatcatattttccactgttctccttcacataacatatatcagctaagccaaaagttgtatatattccctgtctcaatgtcctactttgtgcctccttgtcttcctttttagctttccctccacctacatattcccacaagtgaagattctcctttcctctattcccagtcaaccattacttgcttcacaggttacaacttgtcctagaggtttgctttgtgtaggccctcattgtattagcaaacatggtgtatttttaaaatgtagtcatatgccaacaataggaaatcatgagatttcatataaagactcctggtttcaaatatcttccaaaaaattagaagtttgacaacaatggaccttcattcctataggtggcaacactgggtagcagctctgtcccttagatggggcttaagctcttcgacacaacatccatgtttacccactgagcccaccattgaagccaagtcatcgctggtgaatatatctatatgaataccacaacattatgtgtgtgtgtgtgtgtgtgtgtgtattcatgcttatgatattcttacaatgaagtgtaaaataaagtatttcttgcaggcccaactcgtacattgcttgactgactcttgtagaaacctgcaaatgaaatccttgacttttattggcaacattttctcacttttctgtatcaggatatatctgtcttcctgctatacttccacaccatgatgaaaaatgtatcattggccaccgtttgcactgtcttataattacttctatgcctattttaactctcaaatttaggaagctatgtcagtagagtgttcaatgactgattgagggtagaccttgcaaatttcacagattcatgtgctttgcacatagtctttcatcattaaatacatacctgctagacaagtgaatgtataaatgtgtgtacatcagcagtcaagtggaccaggttgatttgatggaacagtactgcataaaaagcacaactgtattcctgcttaaaaagaatcagaagcttctacagaataacttataatggttaattagtctaaaaaatcaagatgctttttgtaagttttgagttctttttcaaattccacttctattctttgacacacttaggacgtgcagactgctccgttaagtcattaaatattaaatgaactaaattaagcttgaaaaactaccttaagctatttttcccatcttgagtctcagaaataaatcaaacaaactacattttgtgtgaggtccttgctagccagagaaagactgtagaagagaacagcatgactgaatttatttaatttttcttggttttcatacttacttttgacagtaagtaaagacaattatttttttctggtaaaaagaaacagctgaaatttgctctttcaagcatatactttatttaaagtggcgtgattattgtacctgcaaattatacaatggtttaggggctcaggattggtttgcttttcctttcttccaaaccctttactcttatccatccagctgtcagttctctctaataccttctcaattcacacctttcccttaaatttcattagcaaaatgctcattttcttccctcctcttatctctcatctctggatttgacaatcttgccaatgtctactttaagcaagcagagatgaaacagtgaatctagtctctgaaataatgcttcgtaaaaatgtgaatgataatagctacagttgatggcctactgtgtttctggtacttgacatgtatttccaattttcctagcaaccctaacagtaagttttcaccactgctcatttgaggagagtgaatctgagagagtttaagcacttcctcaaggcaatttagctggcaagtaaaggctagaatttgtgtctagctatagctgataccaaagctctctttccacagtattgtcttgtctatatatatatatgaatttgccatttatagtcaattatgtagactacagagacagaggccatatatatatatatatatatatagagagagagagagagagagagagagactgactacagagatgaggtctctctctacatatatatgtatgaatttgccatacatagccaattatgtagactatagagacagaggtctcagattaccaagaaaagaaaggaccaagaaaaagattgtatctttgatgtttgtaatgctgacaccaatttgccattacatgattagtgtatatatatacacacacacacacacaaatcatatatacatctaatatatatttatatataaactaatctcatatatacacattatatatattttgtatgtatatataaactaatcatataatggcaaattggtgtcagcatttagaaacatcaaagaaaaaatatataatctttttcttggtcctttattttcttggtaatctgagacctctgtctctgtagtctacgtaattgtctctcttgagaatattgaaaactcacaagttttactttgctcctaaatgtcaagaaggcatagcctaaatgtcaataagcatcaaaagtctttctgaatgagatagtgccagcattcatcactgttccttctcagaacctcaagcctactctttccaattaccctcatatagggaagccccaatacactggcccctccataccccttttatctccttctggcaggtctcttaggcagttgctccattggcaacagctcccagcaatgatggctgcattactactcccatcctcataccttcagtgacctttggggtgtttgcagcagctttccctctaattaagagcttgcaagcctccgtgtgcttgggaaacacagctgcaaaccactggagagaattccagcaggaagtactcatccctcgctcccattgtctaataccagctgaggtgtacattacactcaagaaattttattctttcagatgtataatgacctctcattttacgtcaggctctgggtttaaaaagagacagacagaaaatagagaataaaagaaaaaaatcccaccatctctgtctttaaagagatcagaatcagatgtgacatagaaatatgtaaagagaatattgctttagactgtgttaagtgcttgacaacgggagacaatagattcactaaggtgtcttagaaaaaacaccctcgacatgttctaacaccacccaaagtatacttatgtatgctccaattcgtttagctttaaagttgcccaaaaccacaaactgaataacctcaaggagagcattcagatagttcagagcattcattcccatagtcaaccaaaaagtatctgagacaagtctcactcagtttagaagtctattattccaaggataagtacatgcccagaagaaataaaaacggaatcacagaaactgtggtctgtgcctttctacaaagataattttgagggcctcagtaaagggaaaagtgggctggaggggaaagaggaagggtatggtaacccacatggtgcaagagagaaggagcaggtaagggaataatcaattatgtattcctctcatgctcagtaaatcagcactttacataaaataaggtgaacgtagagtaggatttaaccttttatctgtagctatctgcttaagaaaaacaggaaaggcagcttctagtatgactcagctttcagctttttccttttggcctagtaaattgaggtcccagtttttattttcctttcacaccactgaagttgagaagctgtcatttccccctgccatctatttgcataactagagggcataacaatggtgccagattctttgccagtttcccccaaggagtaactgactagctatgtaaatcacattgctggaagccttctggaacttaaacaaagagtaacttgagttacatattaattttaaaaaatgtaaaggctctccttcttgtgaaataaacatagctcaagaaggcctatacaaattgtgatagcttggccatcttcagcatcttcaccatcgctgttcaggaatccagggtttttattgaaagacaagcatcagcttgcttctgtccagcctcttctctccaactacccattctgtgactcttttcccacaggacattcccttcatattttcctttagagtagcaatagttataagctactacacttttttaaaatattagggtatggcttgaaatcagtgggtaataaaattctaatgataaagtcaggagccacggaaatactggtagaagaggcacttccccagcagaggcctcaccctcaagcctggagaccatggccctaaatgagaacagttatccctgttttcctgcctaaatgttgttttttccaaaaccaccctggctcaccatgactgctccccccaccaaatcctgtacccataaaaaccccaaactcctctggcagaggagcagagtggcatggcagaaaaggagagaagaagcatctgaacatcaaagaggcagctggacagtcagagaggatttcagctgggacagccaagctccaggggaaaattagctacctactccatcccctttccagttcctcatcccactgagatcccacctccatcactcaattcaccatcctttaagtccctgtgacctcattcttcctgtatgccagacaaggacctcctaggtgccaagagggcaagttgtaaaagactgtcacctgactccacactgagcttgttaacatttggccatccatggaaggcaactgctgaaagagcactaattgtaacatacccctagatgctaccatgggtctggagcccaaaagcattcaccctggccccagcacacactcgcctgcatgctccccctcccacaagcagctgagtaagtgaagcacacccaggtcgcaaatcctctgaaggggtccagggagctctcccatctccctaattctgtgttagcctaatttgcacaagttgataaataaatgaatatatcttgatgaattcatttcactgtttagcttatccttggatccataccagagtttttaaatcactacgtaaacatgtttactctaatttcattctgattccaagttaaagatactcatttttaattcaatgagttccttgattgttgtgcacacttttctcatgatacccattttttgattcagaacactcccttattggatttcttatcttcaaaattaatgtcacaggtgcgactagctggggctcgtcatgggtggtaaaggaatttaccacgacagtcataggtgaagaaaggcagatttattagagaaggtatgaagataccttgcaagaaagcaatgggcattacaacagagaagaggctgtctgcagagaggcaaggggtggagggaagttttatggggttgtgctggagggggccacatgctgaccgaagccatgctgctggggctatgtgtggaaggaggtcactgtgtccacaggttacttgtgattaacatttctcagaacaattattcattattcttccccacctggggccctttctttgttgttgcttacttatcaaggctccacatttaacctttctggaatctcccaagtatattcatggcatccagttctctagcattagcccacctgagtggcatggagaagtgttgtctctaccagggcctgttgtctcctctgtttgtatatattgacacaaatacagtcattcagtagctctaggacaacggggtttttccaagttatttgttgtgtaaaggttttttgtaatgatcgccttctctatgcacttacattttaaaatatttggtaaaagatatatttgaaatctatcattaggtaaattaccttaattttaggtaatttatcagaaggttgtgaactcaaaagtatctgagacaggtcccagtcaatttagaaagtttatcttgccaaggttaagaacatacccatgacacagcctcaggagctcctgatgacatgtgcccaaggtggtcagggtacagcttgcttttatacattttagggagacataatacatcagtaaatacataccagatttacattggtttaatctggaagggaaagacaactcgaagctgaaagcctggggaggagagggctgggcttccaggtcataggtagatttgaaaatatttttggtaactggttgaaagagttattatcaatagaaaggaatggctgggttccagtaaggggctgtggacaccaaggttttatcacgcagatgaagcctccaagtagcaggcttcagagggaatagaatgtaaatatttcttatcagacttatggtctgtgttgatgttaatgttggaaagcataatgaagtatgtccatcccctcttccatcatggcttgaactagcttctcaggttaactctggaatgcccttggccaagaggaggggtccattcagatggggccttagaattttagctgtggtttacaaaattgaggctcaaatattttctaccatctgaatttttctcgtttctgttcctgtttggtgctcaactaaaatgtgagcatttagaattgattttcaggtggctagcttcctggatggaattttgtgtggatatatatatatatgaataatcatattcattttttgatatcttatattaactataagagccataggattaaaataagttggaacagtattctggttttgtcctgcagaaaacgtaagctttggttctggttgccgtgtgacatgatttctactaaatttcactgaagctccacttgaagattgtgtctttttcctttttatttgtgttgattttcattttctattgtttcatgttttaatagtgaggagttgctattctcattgaactatactatactgatataaataaatgaagcttaatacattgcataaaatagtagatagctatattaaataatttttggaaaggaattgtgacctgtagaacttactgactttaagtacagcatgaacataatatgcaaataatgcttagttcctactcataaccagagagttgggaggaaaggaaaaataaagagtgagaaggatttttgaaggccgtggcaaatttagtctgcatgaaaagcagaactttcagaatagaaattcactctgaaaagaggcatttacagagatagtggaggcccctcttatagaaatatttactgttgtttttaacttagcacctaagtatgcttttgaatcataacacttgaatgagttctggaaagttaaatgctccaagactgtggcaaaaaaacctaccagctttcatcttcctcctttccattcccaactttctctagtactattcaaaaactccctaattaggaattcctttgggaaattccaatatcagagttaactagccaacctattattgctaatcatttattcctaccctctatataaagatgaccagcatgtgtgcacacacacacacccagacacacatctccctataccgttttctttttttcgttcattttctttaaatttcccattatactttttaaaaagtaatattgtccaaatttatagcactgtagttcttggattgtttcttattacttttgcatcaagcaagaaatgatattcagaacacttaaagttctgattggtatggtatagaagctgcatttcccacagtcacaaagaaggtcatactccatgttaataccaggtagtatccatcattagcctattagaaggtactgatagtcacctggaattcacctaccataatgatagtggcactggcaaaggcattgtctcatccactggagtctgggccagtccctagcagtgaacattcacaggctgatattcgcagacacctctcatgaactcaagggctgcaaccatggttggttagtcaggtggcttaggacaaagactttttatgtaccttaactattttattattttaataattaataagagcgtatcaatgcataccatctatatatcagccccgggtatagtgacaaatatcttatcttgtataagtactatttttcataccaaatttgctaattattaagagtcttcacagttcacaggatttaatcttggtgaaaaaggaataaactaaataataacaataataatagtccaaaatcaatttgataccaaatcaatcaataaagtgatcagagctttaatgctactaggaaaatacttcagctttaccattttatgtttcatttcaataggcaattaatcaaagttaggaaagagtgagctagcttttctcctggaaatttcagcacaggccctatgtatcatattatttcactaattagaaaaaattttagttttgtgttagtgaagatggcaaagacaaaacacacacgatatttcttgttaattgagaatgattttgaacatattctcaactactattttgcccaagatacttcattctaaaagatgtcatttctgaataaagagcacatgcaataaaattgcatcagaaacagaatccctcacataatattcttacaaatttaacatcactttagagaatagctattgacttttgtaagactttattatttgttcattcatttatttttttattcaacaattatttgggttcatactgtgtgagagaagacagtaagattagaaaattgttacaagagagatatacaaacagggcagtagaataagagagaagagaaagatggttaaagaatcttcactcaaagttatctggtgatcaaaatctgagcttgctaggcaaatggaggagagaaagcacatccccaggaaagggaaaagtttatgtaaatagagagaagtctatatggggtatctgaacaaggggcactaacagatcatacagatctttagtcatacccaggagggctgggtatggtggtttatacctgcaataccagcacgctgggaggccgaggcataaggatggcttgagcccaggagttcaagaccagcctgagcaacgtagtgagaactcatctacaaaaacttaaaaaataaaaaataaatagctatgtcaccagaaaagggctcccaatccaagagaccccaagagagggttcttggatctctcacaagaaaggattcaaggtgagtccataaagtaaagtgaaagcaagtttattaagaaagtaaaagaataaaagaatgtctactccataggcagagcagccccgaggactgctggttgcccatttttatggttattatatttcttgttatatactaaacaaggtgtggattattcatgatttttctgggacggggttgggcaattcccagaaccgagggttcctcccctttttagaccatatagggtaacttcctgatgttttcatggcatttgtaaactgtcctagcactggtgggagtgtcttttagcatgctaatgtattagcttataattagcttataatgctaataattagcttataatgagcttataatgctaataattagcttataatgagcagtgaggatgaccagaggtcactcttgtcatcatcttggttttggtgggatttggccagctttactcaaccagttttatcagcaaggtctttatgacctgtatcttgtgctgacctcctatctcatcctgtgacttagaatgcctaacttactaggaatgcagcccagcaggtctcagccttattttacccaggccctactcaagatggagttgctctgattcaaacacctctgataaccataccaaggactatgagttgcattctgaaattaatgggggctctgtgaacaaaggcagtgagtcttataatcaaatgtatgatttataatgtttctgggaggaaggcaggctggaaataatcagaatggcctgaaaatgattgcaagttttggattgactataaagtaaggtggcatggtggctgaacaatgctgtgctggttgtgtcaatatgagtgtgagctgtgtcagtatgagtgtgattgtatcaacatgagtgtgagcacctgtgggtaattttaaataaaatgtgttgaaaaatacttgatttttattgaaaaattgcataaagtagctactcaagtatagagtgtttgctttcacatatgcatatcatgttacctacatgaggcaaaacaatgaaaataactggatggctgtagaaaggttttggagaaccattagatttttttaatgtttaagatgctgccatctagtgacacttttgtgaaatcactttgcagtgatattcatgtttgtatcttccagttcttttctcaatacattttatattttaataatttatattgtctaccaaccaatggggaaataattacaaatgcattaaacatagtgtagaagtcatacttgatttttcaacgtggtaccacaaatgtggccagaaggattttcataatgggatattgtacataaaggtttgtggtttcttcagtgtgccattctttataagtaattgataatgaaagtgctgctttttctatttcttgagttttcttagaaaaattgagttgtaaaaacaaatctgtgaaaatctgagctgtaaaaattgcttcataaaagttgctttaattggaaatgttgaagagaagaaaagagagtttcaaatttagaataattaacttttttccccatatggaatttcagtattataagtatatcttaaaatataaacaaataaatgtgtgtggaggggtgtgtgtgtgtctgttaaagctaaacattagtctccaaacctaggttgtgatgacctgatgacttctaagttttgatgaagattaattatattcatgtcctattactccttaaacttatattacaatggagcacttgtcttattttcatggtacgtattgctcattttctttggtgaggaacaaagaataaattaatctcccttcctccctcaaaatacagttatattgtgctgatatattgtccttttgtgagatactaactccagtcatactatagtgaatgaggttttaattaattaacttttcagtatattgaggtttctttatgcaaaccaatcctatagggtagaggtaagcacatctttccgtaaagaaccaagtagcaaatattttaggctttgtgggccatatggtccctgttgcaacaactcatttctgctgctgtagcgtaaaagcagccatggacaatatttaaacaaatgagactggccgtgatccaaaattaaatttacagaaacagactatagtttgcatgtctcttctctagggaaaacacctgtatttgtaatttggggttctttttttcttaggaagtgttagaacacttctaaaatttatttaagtatttacttcaaaaactttaattccattgagagttgtgtgccttcagtgttccaaaaaatctagtttggagcaggtatgtgcacttggtaaactaatcgtacacatagtaaactacacttggtaaaccagtcatacacaaacccagaggtaaaatgttttgcaaagttctatcacctgcatttagccagtttttaaattcatgttcatgtacaaagttgtcttaatgtggaatgaatctttatattttctcagtaaacattgcaacattttgatatgcagtaagttaaatgactttgatcatcagcaaataaattagaaacttcctacttgggtacaatttggataatatgtattcattgttccagtttgtgcttctgggaatttagtggaaacagagacttgcttttttaacattgtgaattccactaggcagacacacaaaacacttaaaacctcatgacaagtaaataactaaaacagaatggagtcagatcagaagagactcttagggtacaaagtcaatgtgtatgaaggagacagtagagttaatattaaactttgaaattctctcccaaacaacttcattcttcctctttatttttggataagaatactttttaaaaattaagcaccatataaaacagctggctcacattgaggatctgtactgtatcaaagtatgcatattttgcttaccaaatagtattaagcaaggattgttactcttattctaacatgagaactagaagaactcacgcagtaactgatccaagcctccatcttgtgatcctttggtatcttgtactctttaagaggaatggcaggggtaattcctaagaccaagtaaaggatgtcttggtttttgggagctgagtatatcaattcactcttcccttaaaatgctgtgtaacaaatcatcttgaaacttgttgtcttaaaacaataaccattgattttatggatcaccttggcatcagagcatcaaggtaggacttggctggaggggttctgcaagtctcagctgagctcattcatgtttctgtggcaaactgcaaggggtgaggagggcatggaggagcagctgatccagattgagttcaggtgaggatgattatgctccacatttcttttatcttccatctgggccagcagtttggcccaagcaagtccttctcatagagatggcagagagcaagagggagcaagcttagtcactcaagtacttttctgagactatttttattacatgtgctaacattctgttggtctaaacaagtcacatggctgatcccagtggctgaaacttacaccttacccacagtggaggaactagaacttacatggcaaataacatgggcgcaagagagggcagagaagcagaaccattgatagaatttataacagtgtatatacttgaactgattaaatatgcacatgatgtgggattaaatgctaaacaagaaaactattgactctttcatattactaggatacacttaagcagcagttcagaaactttttagaaaaggaaaccttttacactcttaaaaaccactgagggtcttaggagatttgacattggctctatatctgtatttactgtatttgcaattaaaacaaaattttaaaatgtatttatttgttttagaataacaacaaatgcattacatattaacataagcaaaatattgttatacaaactatgttttctttaaaaaacagtagcattgtttatatatggcaaatcgtattagcacctgacttaataaaagacagctggttttttatacctgcattcaatctctttttttctctttttgaatcttacaaagaaaataggcactcatgaagatatgtaatcagaaaaggcaggagtagttgaatagcctttccgtcaattttgtgtattctttgatactgcatcagaatttgacaagtgagaactttttaggagttctggtatggaatttgaagctgaatcactgaactttctgtactttattatattaaaattcattgactgaacttgcattttgaatagatcctttatcaatgcacaatatgtaacatcgagcattggccattcagaaaatattggttcattgaattatgtgtattttccaaatattgacatatttaatcatataataattagaaattatgtattactactatattcatcagaattatctcaataatgggagctagtcatactcatggaagtggatacaagtttttcaatattctaatttcccctggaaactctaattttatcattggcagcaaatattataagttgttttattgaagtgacactccattttcaaaagaatatctgttaaatacatcacacatgtgaatcgtcattgtttgtcagttgctctttcatgcagaaatggttgtccatgatataaaagtggcaggttcagcttgccactcaaataattgcataaatacattgctttaagatagccatcctacatcagaatgtggtcaagggttttatgtgtacttcccacactcaacattaaaaatatagaattaagatattgagatttaatgaaaattgatcatttttacagttttcacaaggatattttcacatgaaactttcccatgcccccaggtgaaaggctggaaccaatgtaatgactactagtacagttcggtaccgctgccttggctcctgctaaggtggcagctgttttacccatcactgcttttgcattatcaatgcaagtgtcaattcagcaaaaaaggcaaagaatgtcttagcatgatgacaattgctttgatctggtgggccttctgaaagggtcctgggaattatggatcatactttgtgaaccattgcatcaaagagcaaaccataatttatggtacagaagtttgtcaaatgttttcttaaaaatatttgtacttattatttctaatcatgaagcaaacttaaagcttattattgtgttcttccctagggttgttatgttggctttgatctagcacatgcagttggaaatgttgaactctacttacatgactggggagttgattttgcctgctggtgttcctacaaggtacaaacgagttaatacatttacatccctttatttcacattgactttaatctgaaggagaaactgggtctgtgggccaattttaaagatttgagttactttccctatttcttttattgtattttctgctttttgttaatcgagttatatgatggaatagtatgataattaatataattctagtatttctatcaatatagagaaattaattcttcaattccttggctgctatgaaaaagtcaggaggttctgtagaaaaatccctacacttaattcaaattgatcatctttttagtttttttattgataagttgtgaaatttctgcatatataaagataatatttagagaatcaacttagaattcatatttgaaaacagttgacagggagcatgaaaataaaaccaattacaatttacttgctttaaaaatatatttttattattattacaatattttaggacaaaataatttaaatgtatgaatttcaaagccagatctcattaaaactgctttctaccagctggagcaaaattgccccgtaaaagtaatagccatttattctcaacctaataatactattttttatttgtttttctttgaggaaggtgacctaagcttctgttttatcataaatacacaaataatcacacattttgaactgatcaaatgttgtggtttcaattaaaaaattcaaatgactacattgtttagttttgtcatatatttaagtaaacccacataatttaatttattttcaatctagtatttaaatgcaggagcaggaggaattgctggtgccttcattcatgaaaagcatgcccatacgattaaacctgcgtgagtaccatcttcagctaattctttggtgatgaacaaattaatttgcattaataatatgttaaatttacatgagttccttaagatgctatccaataggaattaggattggattataattattttcctactctgctaacaacaatatacttcatttgaaatacatgctttccaaagaattcaattggttgaacaagaaatttaatcaaaaagggaagcttcagtgctaaaaacaagtcactgcaatcatgtaaagcggatggtttaatgcaaagagaccacttgaatattttttttcaaaaattagactttagaaaatttcagattcctcacgttgatgaataaatcaaaggcaaccagagctgtgcctaatagagccttaaatgtggcatgttattattaaaattacatctacctttaaagctgtaaatgttacatgatagcttgtagggaatatcttctgtcctaaaagactttataatccatgaaacccgaagaagctgaacactgaacaacagactgactacataaaaagtaatacttttctgttttatagaactcttcatattttagagcaagtataaatgcaaatataatacaccaacaaacttacacatttttatttgactggggaattcataagtgttccttttacttttttctggtatggaaataaagaaataatatgctgggaagaaaaaaaaaaacccttttcatagttgttgtattggagtatgtgtggtgaggagactgtctagactcctaatagataatgtaataatgtttgattagttttctgaatttcctcagccactgactgagtggtaaaatctttacaagaattgaagctgaattagtaataggctttggagcacctcacatttctgaagttctgtgcatataaatcctaggaatttaagatgattttctatagtttctttaattgtgtctaaatttttttcaaggttttaaggttttaaacttaagacaacatttgtcttaagtttaaatatctttggacagatatttagtcaaccagacatcttacttgaatatcattatcagtacattagatttccctccatgtatgtcccaacatctctgagaagattaaaaagcaaatattataagaataccatgttttccacatagacagtatgtaagatattgcttgcttttgtatgatgactcacaaccctggccatttctcagtctccatttatttaaattgaaatagaggatctcatgtattatatcaacccaaagggtgagccagtgcccggatagaaggaggtggggtgggggggaagaagtaatatacataaattctagagaatgtcagtgttcggagttaagctttgacctcctagcacacacaggtcttgtacttgagatttctctcagcatggacaaggaacaaggacaaagggattgtattgtgctcacatatgcctcattttgtggaatttcaaaatcttctagacaatgtttaaatctatgttaagtctaagctcccaagagaaagaccatctaggcagaccaggttcacagttcagcttggtctttcaggggtctgtcacctggagaatcttctatgattgttcagtattctggtctctgagctgaggtagtaccagcccctactcataagcagttattgtgagaataaaatgagatgatgtatgtaaaacactaagtgtatcacttgaacatttaatatggtttggatttgtgtccccacccaaatctcatgtagaattgtaatccccagtgttggagcaggggcctggtgggaggtgatgggacaatggggcctttccctttgctattctcatgatggtgagttcttaatgaaatatagttgtttaaaagtgtgtagcaccttctccttctctctcttcctcctgctctggccatgaaagatgttcctgcctcccccttcaccctctgccatggttgtaagtttcctgaggccttcccagtcatgcttcctgcacagcctgcaaaaccatgaacaaattaaacctcttttctttataaattacccagtctcaggcagttgtttgtagcagtgagagaatggactaatacagcattatatgtgatcaataggtatggggttatatgaaaaaaaaaatccaaaatttacaatatacaggaaaaagatgggtgacattctgtaacaccctagcccaagtattgtttggtaattatttagtactgacccctaagtacttcgttgactcactgagaatgtgcatagtaacatgtagactttgcccagtggagatcatttctcttaagcagaaaatataacctcaaagtttatggtttgtgactttgtaggacattagtttgtaactatcaccaagtttattttagcagacctttgatgagctgactgtagaatataatctccattccttggagatataatctctcttatatgctataagaaagaattctggccttcctaccatcttactgattccgccactatttagtgggttgaatgagatctttcatggctgtttattttgtgtgtgtatgagaaccttgcttttaagttttttggaaaattatatgttattagctgttgttgcattttaacaatttagccatggaaatttatgggacttaaattaggcttgactcatgaaggccacgttaaggaaaaccttggttgtttttctgtttattgttttctcacactcctaagcttctttttaagtgatgtcagtgactgatctcagtgctgtcaacttctagccttggctctctattctgtaccaagtatcttatattgtacttcatttgcattaggagatcggagttctttaattaggaatggaatgcaacagatttggacaagtcaaggacaaggtattttccagtcatcacttcattgtccctgataggaaaagaaatgttttgctgaaacttaactttgtgtcccttagtgtgttttacttttttattcacctgaaaatcaaataccacctgtgagaagagtgataaacaaagaaaagacccaaaagcctacaatatcacgctgctcaaataagtgtaattgttcagatgttacgacaatgttccatacataaaatattgtgaagatggggagaggaagttttcttgtgaataatatttatagttccacggtcaaatccaatttaaactttgagtaaactttagagtctgtatgactactgactctatttgccaattaataattatatttcagttgttagcattccacgattagctggtttaactatgtttaataagccttctgtcatcttacttttctgttctcttagagctttagagagaccaaagagtttttcactgttaaagtgtccagtatgtagccgagaaccatatggagaacatcaaatacagtggaacaaatgtaactgctattgatgtcacactttgtgaagtagtctttgttgcttaaaaagggtgacatctagtggctaaacatgttatttcaaataaataatatcgaaataacatttcttctcatggtccactcattcactctttaacaagtattttgaagtatatatgtttgaattatgtgttcttctttttgacaatttgactatatgttgatagtgcaataattgtgcagtttaagccttcaataaagaggtagaatgtgatgaaaattggaaggaaacctgagggggcattcttagtgcttggttaaacagaaagcttaacagttcatgaaggctggtctaagaaaggaattataagcatgggtgacccacctggtgtagagagtgtatccccagatatataacattgcattttagaagtctaatatttggtatataatttttgaaatagtcctttatgtgatgtttccattagcaaacagcaaattgcatctgtaccaagagatttcacttccttttttgtttaaatatgcattttggacattgttcaaaacctatgacctaaggcttttccaagagccctttgcccataaagagaatgaataaattagaggccagagtcaacgcacggcattaagcatcataactcaagctgttattctcacctagaatttaaccttttcctagttcattattaacttagctcattgcaatgtcatattctaaactctgtctgtacaataaattaggactggtcatgacttcttggatgtttttgccccacttcaaggtagactttaattcagtctacacagttaattattgctctgaaatatgaagggaactactcttaattgtacaaatttgacaatatgaaatgtttcactaaaaacatgcttaaataacattgtaaattttgaatgttttaaaaaaagttacaaatgttaaccctcatggcacactttagaggactatttaacctttcaactttaggggattcaaagctttgtgaatcctttaaaaggattcttctgtaagagcccatacattgcgatttaagataccacctccctctttttttgttaatagagagtctactatgaaaacaggagtggataatatgaggtattacaaatccatctatcatttacttttttatgtgagccagtgaaatcatacatactgaaaacctgctgttcctcactcttcacgctggtgtagcaaacctccacatgtgcccattgtattagattctcctaaaatgcacatttcccttgggatacttttcttctgagcttttttgaatgggcaagaatggggccgactgacaattttgataaaaatacttgaattttaaatcatgccaacacatttccataatcagctagaggtatttgattgaaagttttaaacagtgatgacattttaaaggccttattaagggcttgaattatctcctttattgtaaagagtaatttgctggtgaaaaagaaccagttgaaaaggctggctgacttcagtgcatggttaagaaataagagttgttactatttggcaacaacattagaaaaacaatatgcatcaaacaattcccaggaaagtcccagaaagaataaaaataaacatccagaaatttcagcaaaaagacttaaaaaattataactttataccatgcttgtcccaactgtacagttaacattgtatgaagagatcgtcttttgcacatttgttcaggggaacactgacttatatatttcacttccatatgcttttccaggcaacagttgagaatgccatagcccaaaacttatctataatttaaatcctgttttagttttctaatgatgccttctgaattactacttatcaagtccctatctagtaccagaataaggccttcttgtgcaaagtttgagacaacaggaagcataggtcgcagtagcaagatgtgtgacttcacaacacttctgatgctttcaaatgagatagaccagtaccaatagatttctcagtgagtttttatagaatccccagttgaaatatgacctcggccttctgagtcacctgttctgcttgtttagcctgtatttagccagtgttaatatggatgactttccagctacaacttcttggcttctcagccatatataattggctatctcctttgtctttaatatttgcctcccacatctctaaacttctgtggtaccgttttcttttgcttctgctccaatggatgtgagaactcttctgtattttaaaatgtttactttttcaccttttcattgattctctcaaaacctcagtccttaatcctcttgcccaaaagtatctcatccacagttatttcaacaatatacaactggtgtagaagaaacgaacttttatttccagctttaccacttgcataatttttagcccttattttcatctgattgcaaattgcaagagtttgtcattattcaaacatgatctcagtccccaaagatataaggaaaatattcactaataaactccctgcttgtaaaattagtccttacctgaacatcattttccaagtagcagcatctatctctatgaattactctacaaattcttagtatcttgctgattatataatatcataaatatcagataatacagtgaaaatataatgaaaatgattttaaagtaagatttttcaagggagattcaggatgtcatgatgcaagtgaatttggaaaactcctgaatcacaaaatcatggctaatgataatatgtcagagcagttaacaggtgaagtagaggacatttgacaatgtacttcaaaaggaaataactggaatatcaggcattcaagataaatgataaatgcctcacaaatctatgtaaaaattatctttaaggtcatgctgagaaagttaagtatactataaaagggatgatattttgctaccatatcattttgtcaagaaatataccaaaaaatcaacacaccttatccttattcttaattattagaatattataattttaatctatatttctccaaatcatatattaaattttaaaaataattttaagctctatattttaagatagcatctctgtcaaaccttctgccattgactttaaaattgatttatttaagtggttttttcatattttcatttgtcatcagatattaaggactttggatatgtctgtatatgtgtgtgtatacatacacacacacatacatctttctatctcagaaactaaatatggtaaaacttgcattttatctcacataggtatctttctaaggtaatcttcactttctcatgtaaagagaatgatcctgagtttattaaagagacatgaacaaacataaccaaccaatatttttgtgcaaaaagctttcatagatgaaaaataaatataggctattgcctgcgattttaaaatgttataattcatttggagatatatcttttaaccagttaaataagtgatttaagtcacaggcaacccaagcttagaatatgtgccataaggcagcctctgattaattactgggtgaattctcagactgcttttgccgtaggggcagcggaggtatagcagactgactcagagctgcttgggaagagcttgagcaaggaggtggggaaactcacagatacgaatcttctgtaaaatggaatgcaatactaactaagtgaataaatttactttgttacattgaaaactaaaattgttgcctgtgagagagattcatttcagaagttccataaatttaaggggatataaaaaagaagaaagaattacttaaatggcatttcttaaaggaatatgccaagtgatcttttcctttttattctcctcattagaatttttatggaattggagttattgacttaacattttaaagcctgcctcattatcataaaattgttctttatctttcaacaatattttagccattataaacagtggtaaaatcgtgattgctttaagctctcccttcgctctgggaacacactcttgaagtgggttacacctgtcatcagtcttagtcctcaaatggtgactgtaagggacccaaaagtagacacaccacttgaagaaaactcatctgtggaatcatgacatacaacctaaacctattttcatttagaaaccattttagatcaataatttttaaaggatttttttaaaaaatcttcctggcttgacaatttttactgtgtgaaattctccagataattttcttgtgtagggaatttaagctgtgatcataaaaataacttacatgcattgaggcacgagcacagttaaaaataaattcagtaaataatctgtatttttttaactccagagatgaagtaatcctagatcttaaagaaagccaaaatagtaattatcagtataaaaacatacattaaagctattcttgcttgtaaatcgctactctcagataatgatgaaatagtcattaatttgagaacactgaagtcctttgaaacctaaacatttattttctgttctaaaactgcagtccagtgtctctgaagatatatagggtcaatgaacctttcaggcataaaaagtaaaacttgtcaaagagcttcagctcttgttttaattacttcaagttttagccctaaagtaacctttgaaatctgcagggactttatttttttttcttactattaatcgtgaagagctattgctacattttcatgtgttcttgtttagaacatacatgtatccatctggctttttatgatttccaagcagacagggtggaagtttgttgtaataatccatgctgtgtgaagcagcattgcgagctgcctcagcaacacagaccaggtaccaagtcctggtacttccaacactgaggcaggctaacttcacagtctacacaagaatacttggaatatattactcacaacaaacttctaaaccacgtgatccatattctccatgttcacctgttttgctcttcaagaggagagaatttgattgggtgggaattattcttttgtccagagctagcatctattgtcctcatgaccaactcatgtatagatagcttgctttgtctcccatatcagtccctgctccaatcagctttggtcaggatttaagaagatttcgcacaagccatggcaatttaggcagaaaataaccatgtggcactatgttttttaagggcccaatgatccctatgaaaattcattttagcatgtcttatatggttgcttaataagtttattatagattgaaatcttaattctaaattctttgagtcctgggacattgtcctgttaatctttctttactttcataatctacagtgcccaagaaagtattttttaaatttttgttgttgaatatatggctctgtctttactctcagcataatagacaaaccatcttctagcatatggaagcatttctactttgcaaattattctgaagcgggtatgatttgcaaaatactgtcaaattaaatatgcatttccatatgcttctatgaagaccaaatatatccatgaaaactagctacagacaactttaaaatccttcatgaatttttaatcaacattgatgaacaaaattcaagtcgttctttctaaagtcctaaatctagaaaactttctgttcttggacttggagcatcggtattaactcaaaggattattttaccaatatttcaaaataataagatatttcagaaaagtatattcagaaaatgttcaaaggcttttttgttactaatagtctcatgccaaaaaacatattgacttagctcttataagaacaacatattctgaaactttagaaaacaatttttattaactaaaatttatcatttctggaagtgcttttttatgactatgcttatcatactgttagcttactggacatattagaacaagcctcttacagagtaagatttgaagaggtaattgaatatgtaacagaaccaagtgaagcactaatatttacagatgggtgggcaaatgagaagaaaaaaatgaaactgaattttatgatacatcctaaaactactttctaaaatagcattaagtcagctaacttcgaacaaagcagaacaattgtgattagatgaatattttattaaactaggaattgatagagatctttttaaactaagagtatgttagcaatattgtacctgtttaatggcatggcatgccatgccaagccttctaatgggcatgcttggggaccagttgctggcatcaaggggtgaatgtacagtttatgagctgaagcaatctactttctcagttttcaacactttttctttgtcattagtacctttgaatctgcttttgtcacttagccatacttttgtttttcctaccgctatgctgattaccaactgcctggatttagactctgtttgctccttctctcattgttttttgttttgtgttgttttgcccacttgttttgatgcatatctactgttttgtctgattgtcattttataggcactagttcggtgttctctatatgtgcctgaactactcttatttctgaactcaaatatctgcttgcactgtaccaaacgtgtctctgtttcctaagcctttcttctcactacacatggtagtctagcaacattaatgccctaccgtgggaatatggctgaagatcttgactaggggacttatgaacccatgcagccgtgcccaaatcctaccaaactgaccttactttcttgaagacggaattgtagtatggtcgagctcatgctttttgtagtaggccatccaaattcgattgactggctaaaaaagattgttagtggaggctggaagaaacattttggctgatgatagatgaatagagcttggaacaatcaaaaggaaaagcagaaagtctatacctattcataagaaaaagttagtatgtttaccgaacattatgaaagaattatgacattttcaaagttttaaaattttattttgtagggacggggtctcattgtgttgcccacgctggtctgtttcttgaggatttactatagactgggctgtattcaaagcattggggatacaggcatgaatgagcccccattgtcctgaacttaccattcagtctgggcagtgaaagaagagggatgttgggagaaccttacaaagatgaaatgtaagctaactggagaaatcccctaactttcagtcagactgaaagggaacaggcagtaactgtgggtagccctcttgggcagggtgattttccacatgtgccagtcaggggccagaacattaagatccttatgttccaactaaggaattttgattttattttaaagacaaaggggagccactgactgttcatgaggaacaagattacaaattcaggtctcttcacctctcattaagtcttggtttgcctgtggaaaaaataaatagaccccagtgatctctggaagattctcttccagctttcgaatgctgtcattctcaagtgataaaaatgaagcatcacaattgagtgaactgctggtagtgatagctcagaaactaaaaccagcttgatggaaatctgagcatcaccggctatatcaataacttcagtgaccctcctttccactcctttctgtaataagtgcatgcagtaaagtacagccagttcagacaacttgataacaaatttgctataacattcttatctttttccttttctcaagtatgaatgagtactatgtatatatttcttaaacttcagttgctaaagtttttactgtgaatattaagactatatcaaagttatttaaatggataaatttccaattgttctctaaacaaaacaagatttgtggaagttttgactctatgaaccctgattatttaatgaggaaaataagtaacatacttcagattaggttatagaggatgctaggatgacagacattctaacttatcccaagttgttattacagactttgtttatttttagaataaacaatcatgctgtacccagcatgttccatgtttttgcaatgctatgacaatttgtctgatcagcacattttttaaagccaaggaaacagtaagacaattatatttcattttaagttatagcctttaggaagagagagaagaggaaaagaatgttcgcattcctgaacacaaacttaaattattaaatgtatggtaataagttgccaaattaaagaaacttatgacagcagtcttctatgaaaatgtatgttcttaagaaagattgtgaactatttttattatattttgatttggtgccaaaggggaaattgttctttaacataagctaagaaacagatgtttgttgtttagtttttgtgaggttgaggtgagagataaggggtttaaaggataagttaatgaatgacatatttaggaattcatattgagcattttgctattaaagacttgctgaagagatcaaggagagtttggatatttcatttcataactcctcacatccgaaatcatattcactagatccccagtggctttctcttactgaatctgagtatcatgcttcaaagatgtctttatgataagcgatgctttccatttgataacatttatttgaaactacttttttggaatttatgatgttcaaagaacacacagcatattaatatgtctgcttttattatttactggatctcttccaacacgttacttctctcaaattctgtttatatctccattcttagtaaattaattccctttttgatttttaatttttgatgagaaaacatttgaatttctagtccaagcacaaggagattgtatcttaattgttattgttgacatttagtttttaggaatgatttatgagcccattgtgataatagctacttataaactaattcagtggtttttaattttacttcattagctttcaaatatttgctttttaagaatccaagatttcattacgattgcatttcttttgtgtttggattttacctttcctacattccaagtgatggatcttaaaatgaatttaacttcctcctagattctgtgcaatgtatttcgtgtttaaatgttgttttgaaataatcatttctttatttgctttttaaaaggttttaaacagcgcttatttctgtttgtaaagacttgaacttgtaacagatgagtgatatgcttactcaagttcactaaatcaagtgtctaggatcatgcattttgaagaaaggcaactccttatagagattctaaaagaatagagaaggtcaaaagaacatttgtttgagggagtggacattgtatatactaaaaagaatagcttctgtgaccaggcgcagaggctcatacctgtaatctgacactttgggaggttgaggagggcagatcacaaggtcaggagattgagaccatcctggccaacacagtgaaatcccaactctactaaaaatacaaaaaagttagctgggtgtagtggtgcatgcctataatcccagctactcgggaggctgaggcacaagaatcacttgaacctgggaggctgaggttgcagtgagcagagatcacgtcactgcactccagcctggcaacagactgagactccgtctcaaaaaaaaaaaaaaaaaaaaaaaaaaaagaatagcagctctgccatcttagcctattctagtctatcctagcctagcattctgccagccccaaacccggaagtagtctggagaacattgcttttattaaatcactggttcatttttaaaaacctgctcccgatggttttgcattttctgtgaatatcctgggtcatgatggtctatatctacatttggactttaacaataaataactgtggaatcttagactatttatcaagaattttagagccttcatttcctcctttgtattataatgtggataatgatagtataattcataggattattttaaaaattaagtgattgctttgaatggtgtctggcttataataaaatctcaattaacatttctttttgttggtctcaatattattaaaacaactaaaagaacctaagtggaagaaaaatcacacatgctctaagttaaacttgtttgattatttttataagaccttagctgagtgtttgaggagtcatcaatcacctagggtcaagttgtgagctagcaattggaagataatatgggaaacaggctctctaatattgttttactaaatgtaattattttttattttcttatttaaattagtaatgtttttcaaaactttagctaaccatgtatcagtatgggctgttacattaaaaatgtaatatcattgatgttgttcgtcatgaaaatattcagaatagcctgaaaaatgtcatacatcatagaagagagccaacatgtctttatttcacaaggggtatgggtaaaaataaattttaataagacagaaatctcatcttcttgttatagtaatccacttaaatgattaaatttcttttatcaaatgattaaatttctttatcaaatgaacatgtagagcattcatcttaccaagttgcaattttttccagaggagataacatttagaatttcattaagattgaagatcaaaaccaccaattattaaaataacaaggtaattattaatactctatatccaaataaagacataaaggaagaaaaacatcatatgaaaaattagtgacagtccgaaataattagctaccaatggccccaggactttatagcacatataatacgaaatattccctcccctacttttctgttgctacatggcagaaaactatgtgagtctgtatttatgactggttgaattgttttgatgaatattttatttaagtaattgctatgaccactgaattcaatgatatcactgttacatcgagatattaatctttatgccatgttttacagaaaattgtattattttccacatccagagtactctgactccctttactactcattgttagagaattataatataaataaactctataaagagcaactattttctttattctattgatcttactcttattgaggtcaaaatagaatacagagacaaatctctaaatttaacattttatttgtgaatcacagaattgcaatttggggcacacatacagatcaggcagtcatcagcatgtctaaagaacaaagaaaatgttggggtatttattttaaagaaatgttacatatccttttgaaagaaatctctctggcactagaaaagcttttggaagctggcatatctctaactggtgagtgacagtggtaggtaaaactagtcttagttatagcaggtatttcagcagatactaagtgaaactgggcttcgggttacagcaggtagtttcagcagctgggcttgtggagaagtcaattcttggagcagtgctatgtgccctgggtgctttttttcctctggcctttagactttgatttaggtgagtatgacaagaatgacccaatttgtataatcagcattcaccctcttctccccttgtaattgcttcaatattcatgtcgataaaactgaaacatcttatcttgagtctctggtttcatatccttcagtgtttcaatccacttattgcctcactcatgatgggatatgtcagcactttgtcttccttaagtactgactatgaaaatatcagacacctagctttgactctattttccttctcttcattctttctatctcactttgtcccctggattgttacttcttggtgtggagtcacagatcctatctaggcaagagggagtgagttagacaaaggcatgaacactaggagggcactttaagagtctgcctaccacaattccattgaatatacttaattaccccctaccccagccatcctcacacccaatagactttaaactattggacagggatggtgggcagagacaatgcctgttttgtcttatgctgtctctctcgggcttctagcaaattgtctcattaactatttttggattattaataagtgaaacataagaaaactctaataagcctccaaaaagaaggataatttaatcaggagcataaacaatagatatagagcccttagtaacaagtatcaactgtagagttgttaaaccattttgctttactcagccctacttttcacctctgctcttccattcagtttccagggaccgagcatctcagcttctgctttcctgctggcttgttaagatactcagttttactccctccttcaactttgttctggttatgctatcttgatcacagcttcttgcttgtggtcagtgttcctgattatttattgagcaggacattggcttaactagctgtgcccctttggatgagtcactcaaccactttaagccatacttttctcaaatctaaaatggtagaaagaatatctacctcaaagtggtgttgtaaaaatttaagtgagaatacaggaaatgactatgcccatttcccagcaaacatgtcttagtttccatccatttttccttagcagctagatgtgcagaagctttgctaaactattccttttgaacaggatttcttattggcacaggagccaataatttgattcgccaggccattcttaaatgttctatgggattttatagcttccatacaggggtaatagatccacaggtaatggggatggggaaagacaatggatggcaaacaattagaatcttcggtggagctggttcaaggtccaggtgctctctttgtgtcctttgtacaaagctggcggaaatatataatttcttaagtgaataaatgcaaaaaagagatattagcatgaaataatgagataggcaacttggaaattctttctttgtaaacaatcatattgtacttatactttttcagatataaagcacttttgtaacttcagtaaataaaacattaataaaaccccaatgtcttgaccacagttacggaatcagttctgagttcttttttcctaagaacacattttactcttcgtgtagtcccttgtttctttcatatttgggttatgaaaatgtcatcactattttcaagcacaagttattatttcctcctgtgatactgtttgaacgctaggtctttgatgtttctgtcagatatacccagcaatcatcatcataactcatactcttgaatttttaatatcactccacacacagaagtgtcaagtacccagttctttagtgaatgcacaaaaaatgaaagaaaagtttgttaaataagaagaaagattgaaatactgaaatattcctcctgatttttgttttgatcccattgaaaataaatgggaaatacatgttgctatttttttcattgctctgtctcacagccactgtttgcatcagatttttaaaaaagaaaatgccaagcagtacattttgaatcagtttccacagaaaacattatgtgcataaaatttcatatattatctttgatatgtaaatataggagaaataagtttctttggtaaattttagcatttcttcttttcaaaaaataaaacataaaataatagtcaatggccctatggttgtaaactatggtgaatgcatctgattcatttatgctagaactccttccttatttcctcctttttatgcaaacattatcttaccagccttaatgggggagtcacaataagttcccctcagtactcagcacagggccatccatgcttgcggaaagaatgggctttgaatatacatcatgataaacattagtacattaaataagcaattactttctaagatgattttgtttttctacacaatttaactcattaatatagctcagttatctgttcaaattaacttaagatagctgtccaatcctgattctgatatttaatacaaaaacacttctttacagctggggggggtggctcacacctataatcccagcactttgggagaccaaggcaggggaatcacctgaggtcaggagtttaaggccagcctggccaagatggtgaaaccccgtctctactaacaatacaaaaaatcataataataaaataaaatagccaggtgtggtggcgggcacctataatccccgctattcaggaggctgaggcagataattgcttgaacccaggaggcagagatttcagtgagctgagatcacgccactgcactccagcctgggtggcagagtgagactctgtctgaaaacaaacaaacaaacaaacaaaaaacacttctttacaagactttggtattcatacttcaaaattttgtcattaattttgcttgtctacagaaatttgattttttttttctgtaaaccagatgatatgggttaggttagggtctaactggaatatgaaggaaggagtagataacaaggccattttgaagaataaacaacaaaattaataactgataagactcaaagagaagagggaaataacctaatggtgtccaattcaggtgtctaaaactacctaacagaaagagtggagctgatgaataaatataaagaacgctgtgtttgacatattgtgttttgggcagaggcagaactagagaatagggcttctgacttctaatcgaagacattctcctattacttgattaagatcttccatgaacaaacatcactttcatttactttaaacttccagaagacagattacttaatatgcctatcattttgactaattcatgaaaatgtaacaaattcattagatgataggcttctacatttccttccccatgcattaattttcaactgtaaggtttaagatgaataccagatatattcaagtagggagggaatctaactaatgtttacaataagcttaccttgacaggcactgtgctagaaacttcacactttgtttaaccataggcctatgaagttatagatgaataaactggtgcccagctctctactggtagaaagttgtgggattgagattcaagtctcaggtccagtaaaatcttccttgtcagctctcaacatggatagttctaaatgtgttgaagctgctagaggaaataaaaaataaaggcagcctggaatggttgctcacacctgtattcccagcactttgggaagccgaggtcagtggatcacttgaggtcaggtggtcgagaccagcctggccaacatgatgaaaacccgtctctactaaaaatacaagaattagctgcgtgtggtggtgtgcgccaccactcgggaggctgaggcaggagaatcactttaaccagggaggcggaggttgcagtgagccaagatggcaccactgcactccagcctgagtgacagagcaagactctgtctcaaaaataaaaataaaggcaatattcatttttcctcccgagcatacaatactatctttactatcaccaatgtttcctaaattctagttaaactaggtactactaacttaagcacttagagtgatgaaatcatatctcattaggtgtcacctggagggaagttaatctgccatcaccagtatctaacccccctctactaacggggtcactagtattattttcattggttgggtgccatctgatccaatgcatcaccaatcaaatcacctcaaggctaacataaattgtgttttctctaaataaaaaccaacaaaaatatcttgccctagcttaagctaagagtgaggcttcctgataagtaggtcatccagactctagggatatgttttccccatgttggatggaaagatctaccctgtagtggagatgtgaggtatttgacaagtgtaatagatgattcaagtctgacactagcaaattcattaatactatgatgagactgcagtcacagatggagagatcaatccttcccccaggcactgtctaacactgctttaaagggtagaaagcgaaaatgacctacctggttgtgtctaaagtttgcttagggcagtcacatttcactttaagaagtacctgtagagctctcatataccaggttccatgttaggacctaggcatgcaaagagaaacagaacaaggccctgctcataagagtttccagcgacctagagaaactggaaagaaaatagtctggccctttttgtcaacaagtcacatgtgcatctataataggagtgagaacttgacgaaaaaataagaagaaaggctcagtcatatgtcagtaaatttcccgggaaagcagaagtatacaaagttgtatgtttgcaatagtataaatatatatagcataaaatagtataaatatacaaaccttgtatatttgaatagtacattatttcccaagtatttttgttatgattaccaaagagaaaaaacctggaactatttaggttggtgcaaaagtaattgtggtttttgccatggaaagtaatgacaaaaaccacaattactttcgcaccaacatgtaatatttctgggtagagaatgatagattattggtttacaaagaccagtctgaatagaaaaggatggaaagcaaggtaaagtttgctgcagtctaaagctacaagtacacattgcttcagttcatgctgtgttccaacaatccatggaagtcctcagaacccaaatcactgaagctgtaagtagagtctagaatactaatggctctgggaggaaatatccaaagtcactgctgattcagctagagaaaatacactggagggaggagccaagatggccgaataggaacagctccggtctacagctcccagcatgagcaacgcagaagacgggtgatttctgcatttccatctgaggtaccgggttcatctcactagggagtgccagacagtgggcgcaggccagtgggtgcacgcaccgtgcgcgagccgaaacagggcgaggcattgcctcacctgggaagcgcaaggggtcagggagttccctttccgagtcaaagaaaggggtgacggacgcacctggaaaatcgggtcactcccacccgaatactgcgcttttctgattgacttaaaaaacggcgcaccacgagattatatcccacacctggctcggagggtcctacgcccatggaatctcgctgattgctagcacagcagtctgagatcaaactgcaaggtggcagcgaggctgggggaggggcgcccgccattgcccaggcttgattaggtaaacaaagcagccaggaagctcaaactgggtggagcccaccacagctcaaggaggcctgcctgcctctgtaggctccacctctgggggcagggcacagacaaacaaaaagacagcagtaacctctgcagacttaaatgtccctgtctgacagctttgaagagagcagtggctctcccagcacgcagctggagatctgagaactggcagactgcctcctcaagtgggttcctgacccctgacccccgagcagcctaactgggaggcaccccccagcaggagcacactgacacctcacacggcagggtattccaacagaccctgcagctgagggtcctgtctgttagaaggaaaactaacaagcagaaaggacatccacaccaaaaacccatctgtacatcaccatcatcaaagaccaaaagtagataaaaccacaaagatggggaaaaaacagaacagaaaaactggaaactctaaaacgcagagcgtctctcctcctccaaaggaacgcagttcttcaccagcaacggaacaaagctggatggagaatgactttgacgagctgagagaagaaggcttcagacgatcaaattactctgagctatgggaggacattcaaaccaaaggcaaagaagttgaaaacttcgaaaaaaatttagaagaatgtataactagaataaccaatacagagaagtgcttaaaggagctgatggagctgaaaaccaaggctcgagaactacatgaagaatgcagaagcctcaggaaccggtgcgatcaactggaagaaagggtatcagcgatggaagatgaaatgaatgaaatgaaatgagaagggaagtttagagaaaaacgaataaaaagaaatgagcaaagcctccaagaaatatgggactatgtgaaaagaccaaatctacgtctgattggtgtacctgaaagtgatggggagaatggaaccaagttggaaaacactctgcaggatattatccaggagaacttccccaatctagcaaggcaggccaacgttcagattcaggaaatacagagaacgccacaaagatactcctcgagaagagcaactccaagacacataattgtcagattcaccaaagttgaaatgaaggaaaaaatgttaagggcagccagagagaaaggtcgggttaccgtcaaagggaagcccatcagactaacagcggatctctcggcagaaaccctacaagccagaagagagtgggggccaatattcaacattcttaaagaaaacaattttcaacccagaatttcatacccagccaaactaagcttcataagtgaaggagaaataaaatactttacagacaagcaaatgctgagagattttgtcaccaccaggcctgccctaaaagagctcctgaaggaagcgctaaacatggaaaggaacaaccggtaccagccgctgcaaaatcatgccaaaatgtaaagaccatcaagactaggaagaaactgcatcaactaacgtgcaaaatcaccagctaacatcataatgacaggatcaaattcacacataacaatattaactttaaatgtaaatggactaaattctccaattaaaagacacagactggcaaattggataaagagtcaagacccatcagtgtgctgtattcaggaagcccatctcacgtgcagagacacacataggctcaaaataaaaggatggaggaagatctaccaagcaaatggaaaacaaaaaaaggcaggggttgcaatcctagtctctgataaaacagactttaaaccaacaaagatcaaaagggacaaagaaggccattacataatggtaaagggatcaattcaacaagaagagctaactatcctaaatatatatgcacccaatacaggagcacccagattcataaagcaagtcctgagtgacctacaaagagacttagactcccacacattaataatgggagactttaacaccccactgtcaacattagacagatcaacgagacagaaagtcaacaaggatacccaggaattgaactcagctctgcaccaagcggacctaatagacatctacagaactctccaacccaaatcaacagaatatacatttttttcagcaccacaccacacctattccaaaattgaccacatacttggaagtaaagctctcctcagcaaatgtaaaagaacagaaattataacaaactatctctcagaccacagtgcaatcaaactagaactcaggattaagaatctcactcaaaaccgctcaactacatggaaactgaacaacctgctcctgaatgactactgggtacataacgaaatgaaggcagaaataaagatgttctttgaaaccaacgagaacaaagacacaacataccagaatctctgggacacattcaaagcagtgtgtagagggaaatttatagcactaaatgcccacaagagaaagcaggaaagatccaaaattgacaccctaacatcacaattaaaagaactagaaaagcaagagcaaacatattcaaaagctagcagaaggcaagaaataactaaaatcagagcagaactgaaggaaatagagacacaaaaaacccttcaaaaaaatcaatgaatccaggagctggttttttgaaaggatcaacaaaattgatagaccgctagcaagactaataaagaaaaaaagagagaagaatcaaatagacacaataaaaaatgataaaggggatatcaccaccgatcccacagaaatacaaactaccatcagagaatactacaaacacctctacgcaaataaactagaaaatctagaagaaatggataaattcctcgacagatacactctcccaagactaaaccaggaagaagttgaatctctgaatagaccaataacaggagctgaaattgtggcaataatcaatagtttaccaaccaaaaagagtccaggaccagatggattcacagccgaattctaccagaggtacaaggaggaactggtaccattccttctgaaactattccaatcaatagaaaaagagggaatcctccctaactcattttatgaggccagcatcattctgataccaaagccgggcagagacacaaccaaaaaagagaattttagaccaatatccttgatgaacattgatgcaaaaatcttcaataaaatactggcaaaccgaatccagcagcacatcaaaaagcttatccaccatgatcaagtgggcttcatccctgggatgcaaggctggttcaatatacgcaaatcaataaatgtaatccagcatataaacagagccaaagacaaaaaccacatgattatctcaatagatgccgaaaaagcctttgacaaaattcaacaacccttcatgctaaaaactctcaataaattaggtattgatgggatgtatttcaaaataataagagctatctatgacaaacccacagccaatatcatactgaatgggcaaaaactggaagcattccctttgaaaactggcacaagacagggatgccctctctcaccactcctattcaacttagtgttggaagttctggccagggcagttaggcaagagaaggaaataaagggtacccaattaggaaaagaggaagtcaaattgtccctgtttgcagatgacatgattctatatctagaaaaccccattgtctcagcccaaaatctccttaagctgataagcaacttcagcaaagtctcaggatacaaaatcaatgtacaaaaatcacaagcattcttatacaccaacaacagacaaacagagagccaaatcatgagtgaactcccattcacaattgcttcaaagagaataaaatacctaggaatccaacttacaagggatgtgaaggacctcttcaaggagaactacaaaccactgctcaaggaaataaaagaggatacaaacaaatggaagaacattccatgctcatgggtaggaagaatcaatatcgtgaaaatggccatactgcccaaggtaatttacagattcaatgccatccccatcaagctactaatgactttcttcacagaattggaaaaaactactttaaagttcatatggaaccaaaaaagagcctgcatcaccaagtcaatcctaagccaaaagaacaaagctggaggcatcacactacctgacttcaaactatactacaagcctacagtaaccaaaacagcatggtactggtaccaaaacagagatatagatcaatggaacagaacagagccctcataaataatgccgcatacctacaactatctgatctttgacaaacctgagaaaaacaagcaatggggaaaggattccctatttaataaatggtgctgggaaaactggctagccatatgtaggaagctgaaactggatcccttccttacaccttatacaaaaatcaattcaagatggattaaagatttaaacgttagacctaaaaccataaaaaccctagaagaaaacctaggcatggccattcaggacataggcatgggcaaggacttcatgtgcaaaacaccaaaagcaatggcaaccaaagccaaaattgacaaatgggatctaattaaactaaagagcttctgcacagccaaagaaactaccatcagagtgaacaggcaacctacaaaatgggagacaatttttgcaacctactcatctgacaaagggctaacatccagaatctacaatgaactcaaacaaatttacaagaaaaaaacaaacaaccccatcaaaaagtgggtgaaggacatgaacagacacttctcaaaagaagacatttatgcagccaaaaaacacatgaaaaaatgctcatcatcactggccatcagagaaatgcaaatcaaaaccacaatgagataccatctcacaccagttagaatggcgatcattaaaaagtcaggaaacaacaggtgctggagaggatgtggagaaacaggaacacttttacactgttggtgggactgtaaactagttcatccattgtggaagtcagtgtggcgattcctcagggatctagaactagaaataccatttgacccagccatcccattactgggtatatacccaaatgactataaatcatgctgctataaagacacatgcacacgtatgtttattgcggcattattcacaatagcaaagacttggaaccaacccaaatgtccaacaatgatagactggattaagaaaatgtggcacatatacaccatggaatactatgcagccataaaaaatgatgagttcatgtcctttgtagggacatggatgaaattggaaatcatcattctcagtaaactatcacaagaacaaaaaaccaaacaccgcatattctcactcataggtgggaattgaacaatgagatcacatggacacaggaaggggaatatcacactctggggactgtggtggggtggggggagtggggagggatagcactgggagatatacctaatgctagatgacgagttagtgggtgcagcgcaccagcatggcacatgtatacatatgtaactaacctgcacaatgtgcacatataccctaaaacttaaagtataataaaaaaaaaaaaaaagaaaatacactggttgtccccaaagcggagggtgtccccaagttggaggttctccaaaatacaaaatgtttcctgcgacaaaggagaacagaagaaagcagctatctcagaaggggctctggaccaggcacgatgactcacgcctgtaatcccagcactttgggaggccgaggcgggtggatcacctgaggtcaggagttcgagagcagcctggccagtatgacatagctccatctctactaaaaatacaaaaagttagctgggcctagtggtgcatgcctgtaatcccagctactcgggaggctgaggcaggagaatggcttgaacccaggaaatggaggttgcagtgagccaagatcatgccactgcactccagcctggatgacatagcatgactccatctccaaaaaacaaaaaaaaaaaaaaagaaagaaagaaaaagggactatggagtacaaaggcccatgtgtcatttcccataatatttttcatatttttgttttattttttactgtgtatatttaaggtctataacatgatgtatgggatacatagaagcagtaaaaggtcgctgtagtgaagcagattaagatatccaccttcatgcagttacccattttttttctagcaagaacagggaaaatctactcacttagcttgaatcccaaatataatacaattgtactacccatagtcctcatgctgtacattggagttctggacttgttcatcctgcatatctgctactttgtgtcctctgacctacctgtctgcattttcttccctcacacctgtctttggtaaccactcttttgttctctatctctgtatatttgaattttttttagatttcatacataagtgagatcatgcaatttttccatgtctggcttttttctttctttttttcttattaattttttagagacaaagtctcactatgttgtccaggctggagtgtgatggctattcataggtgctatcacagcacactgcagccttaaactcccaggctcaagtgatcctcccacctcagcctcccacgtagctgggactacaagtgtgtaccaccacacctggctctggcttattttacttagcataaggtactccaggctcatccatgttgtggtaaatggcaagaccttattattttttagggctaaataatatttctctctctctctccctgtctctctctgtttctctgtctctttctctgtgtgtgtgtgtgtgtgtgtccatcatattttcttttccactcatctgttgatggacacttaggttgatcccaaatcttcacaattttttgaatatgctgcagtgaacaaaggagtgcagatatctttacaaggtgctgatttcatttcctttgggtatatgtccagagaaggaattgctaggtcttatggtagctctatttttaatttctagaaatttgatagttttaaagaaaagttgcatatatgaatgttatcaggtcttgaatttaaatgagcaaataattttattttctttgtttttgtctatctgaatttaattctatcctgaacccacatctgtttcttgaaggaaatttggtcttgtaacttctaggtaagcttagtgacttttgttgtttttctcagtaaatttggagtttaagttctgttggttcagcattcttttcctttcctccacagaatgacattgcaaaggtagatgatatacagaacactcaggcataggtaagggagaggcttcggacccacagccatctcctggagtacattgagatgtgcttgtacccttttggtcaactgctctcattaccattacattctccaagatgtgtatgaaactgaaatggcctcatgccttttatcccaaccatcccaaagctccattggagacttggggtctgtcagtcacttctatacctatccctgggggagcaggaatttcaaaatagtctcttgcgtctttagaggatatagtatgaacctgggttttaaatggaggtgctatcacacacaggtccattctcctaacattcctacacaaagattatggcaccaatttggggcatgaagaaattctttacaaacctttggactgccccttagggctgagggaacatggctcaggccatttccatcatcagatcttctcaaacatatgtggagttcccactgacctctcaaccctcccagcctcatcccttggattttatctagtggtatggagtacaacctggctaagtattgggaacctgaatcaggtatgaatctcatccttttctgaggcttctccttccccagcaggagcaaatttggtttaattaatgggttagatccattgtttcttcagttttcttttatatgtgctgtttctggcataaattttatgctgggctatatgtaacacatgatttgagatcaaacatgtctactgcaaatcaaaagtcttggcttttagagagaattgtctctgctataagtttcagaagtttgttttggaactcaaagctaaaaattagaatttttgttctatatgcaccgtttggtgttctccacttaacaaatgatcctgaagcaataaaatgtattgattcactgtggagaagaagaaagttacgggagaccatttataaatgatgagcaaaattcttaatacatttaaagttttatcacctcaaacattttccaaacaataggatatgagtagttgtctctgaatccatacagttttcaaatcagaggaatgacaacatgagatttaatataacatagaaaaacagggacagatttaaaactcatcaggtgtttgtttatttgttttttgggttcgtttagagacagggtctggctccgtcacccaggccggagtgcagtggcgtgatcatagatcactgtaatcttgagttcctggactcaagtgattcttccaccctagtctcccaagtaggtgggactaaaggtgtgtgccaccatgccttgctatttttttgttttttaagagacagatcttcctatgttgtggaggccagtctcaaactcctgccttcaagcaatcctcctgtcttggcctctcaattgatgataagttttctaatcagatttagtgcttttctggaaaaatcattagacaacaattctgaagctaaatattaagtgtgtgcctaaaaatttagcaaacttaatggaagaggtcctcagaactcttttaagatcaaacagttcaatactaaaagtaaaaatttgaatggaaaaagagggtgtggggaaaccaaattacctatcctgtatgcatattggaggtggaatgaacagaccaggggcatcatgcaaaattctcaggcgccaagtagagtgaataagtgtgtggtaattattcacagtgtcaatgcatacaactgaaaataggatcagtacttaaatgctggatataatatattatcaggtcaagactcatgacctgataaagaccatctgtatgtccttaaatgtccttaaatgctagatgtaagcttggatatttgtttatgtttatgtgaatgacattccttctttcttcctgggtttttgtccctcttttattttgttctgtttatggagatgaagttctgcattagataggatcagtgaaatataaacatagatttgtgagcgtataaatgagactacccaaaacatttcccctcaaattaagactttatattttgagacacactggaatcagtgacgtcagtttggaagctcagattttcctagcaacaaatagtgtggcttagacagaacgtcagtttcaacagtgaaattcattgataggttctttgaatttaactcagtggctcaagttcagtttggagtaatgccggaggcatgtctttgccctaagaatagtctatttcctcacacctgaaacatattcttatctcctttcctttttttctccagactgttcaaaatctgtcctttagctgcaagtctaaacaacaaccaattctagaatatagttttctctaaacgttcattctgttgaaatattttagcgagttaacacttaaaataaaacttgctctgaggctttgaaaagtgaaagtggacgtctgtacagataaagtatcaagtttattactatcatgtaaaattttacagtcagtgattatttcctttggaataagatttatgtacttcacctctgaggcaagacctcatattcagctgtatttcaaattctgtttttcacatagatgcacatttcaatatgttaatatgtaatttaggaaacaatttggttgtctctaataggattataaaattctctctttcatgtacacaatgcaggttgagaattttctcagtggacatgaatttttttaaatcattaccagaaaagtctcaagtactttatgcctgtcttctaaatcaattcttaataattttccaagtgaaaatccattatgattagcttgacatctcatacaaacaactgtgtcaaaatttttttctcccagtttacccccactgatgtagttcagttatatgaactgctgtttatattagatttgagaagggttctgacttgtgttctaaccataccaaaaagaaaattagaactttttataattatgactttatggtttagttccagtttgtttatttcttattttttatttttataacttcaccttttattttagattcagagggtacctatgcaggcttattacctgggtatattgtgtgatgctgaggtttggggtcctactgatcccatcacctaggtactgagcacagtaccagtagtttttcaattctcaatcccctccctctctcctcgctttagtagtccgcagtgtctgttgttaccatccttatgtccacgttcccatctttatgtccatgtttagttcctacttatcagtgagaacctgcgatatttggttttctgttgctgcattaatttgcttaggataatggcttctagttgcatccatgttgctgaaaaggacacgctttcattccttattatgactgtatagtattccattgtgtatatgtaccatatttgttttatccaacccaccattaatgggcacctcggctgattccatgtctgtgctattgtgagtagctgcaatgaacatacaagtgcgtgtgtctttttggtaaaataatttattttattttggatatgtacccagtaatgagattgctgggttgaatggtatttgtaaattctttgagaaatatccaaactgctttccacatagctgaaaaaaattacattcccaccaacagcgtataactgttctcttttctccacaggctcaccgacattggttgttttttgaccttttctctcttttttcttttttttttttttttttttttttgagatggagtttcagtcttgttgcccaggatggagcgcaatggtgcaatctcagctcactgcaatctccgcctcctgggttcaagtgattcccctgcctcagcctccttagctgggattacaggcatgcaccatcacgcccagctaattttgtatttttagtagagacatggtttcaccatgttggccaggctggtttcaaactcctgacctcaggtgatccacctgacttggcctcccaaagtgctgggattacaggtgtgagccataatgcccggccatttttttaaccttttcatagtagccatcctgactggtgtgaggtggtgtatcattgtgggtttgatttgcatctttctgagtgatgttgagcatttttcatatgtttgttgaccaattgtatgtcttcttttgagaagcatctgttcatgtattttgcccatattttagtgggcaaaatatttagttcaattgcttaagttcatttcttttgagaagcatctgttcatgtattttgcccatattttagtgggcaaaatatttagttcaattgcttaagttccctatagattctggatattagaactttgtcagatgcatagtttgtaaatatttcctcccattctataggttgtatgtttactctgttgatagtttcttttgcagtgaagaagctctttagtttaattaggtctcacttgtctatttttgtttttctcacaattgcttttgaggactcagtcataaattctttgccaaagctgatatccagaatggtatttcctaggttttcttctaagacttttatagttttaggtattatatttaagcttttaatccatctcgagttaatttttctatatggtaaaaggtaggggtccagttttattcttctgcatattgacagccagttatcccaacaccatttattgagtagggagtccttttccgattgcttgttttgtctactttgtcaaagatcagatggctgttatgcagctttatttctggattctctgtcctgtcctattggtctatgtgtctgtttttgtaccagtatcatgccattttgattactgtagccttagagtatagtttgaagtcaagtcatgtgatgccaccagctttgttatttctgcttaggattgctttgtctatttgggctcttttttggttctctctatattttagaatagttttttctagttctgtgaaaaaataatgttggtagcttgatataggaatggtgttgaatctgtagattgctttgaacggtatagtcattttaacaatattgattccatgagcaaggaatgtttttccatttgtgtcatctctgatttcttttggcagagttttgtagttctccttgtaaagatcattcacttcttggttagatgtattcctaggtattttatttatttatttatttccagctactgtaaatgggattgtattattgattttgttctcagcttgattgttattgatgtatagaagtgctactgatttttttacattgattttgtggcctgaaactttattgaaattgtttatcagtttcagggcccttttgaaagattatttagggtgttctggatatagaagtgtatcatcagttaagagagataatttaacttcttcttttcctgtctgaatgatttttatttatttctcttgcctgattgctctgtctaggactttcagtaatatgttcaacagcagtggttaaagtgggcatccttgtattgttcctaccttagaaaaaaggctttcaatttttcgctgttcaatttgatgtaagctgtgggtttgtcatctatggcctttatgttattggggtgtatttcttctataaccaatttgttgagaatatttattatgaaggtatgttgaattttattaagtgccttttcagcacgtattgaaattatcataaggtttttgtcctagattgtgttcatgtgattatgacatttactgatttgtgtatgttgatggctcaagcatgttggatgcaacatcctttcatccctgggataaatgctacttgatcatggtgaataatctttttaatgtgttgtttgaattgagtttctagtattttgttaaggattttagcaactgtgttcatcagggatattgcccagtagttttctttttctgttgctatgtccttgtctgctattggtatcagggtaatgctggcctcatggaatgagtttgaaagtattccctcctcttaaatatttgaaatagtttgagtagaattggtattagttcttctttaagtgtttggtagaatttattagtgaatccatcacgtctttggattttctttaatgggaggctttttattattgcttcaatcttcttactgtttcttcatagttcaaccctggtagatcatgtgcatccaggaatttattaatttcttctaggtttttcaacttgttgcatatagctgtttatatagtctgtaattatcctttgtatttctgtggtatcagttgtaatattcccttttcagtttgtgtttttatttatttgggtcttcttttttcttagtctggctaaaagtttgccaattttgtttatctttaaaaaaaccacagcatttagttttgttgatcttttatatttgttttattctcaattttatttatttctattctgatctttattctatccttccttctactaattttgagtttggtttgttcttgcttttctagttccttgaggtgcatcattaggttttttgtttgaaatctttctactttctacttttttgatgtaggcatttattgccataaactttcctcttgcactgattttgctgtatcccataggttcaggtgtgctatgttttaattttcatttgattcaagaaatttttaaatttccttcttacattcttcattgactcactggttgttcaggagcatgttgcttaatttccatgtatttgtacagtttccaaagttccttttgtaactcatttctagttttattcccttatgatcagaaaagatacttgatatgactgcaacattttaaaagttgttgagaattgtttgtggcctaacatatggtctatcctggcaaatgttctaagtgctgatgagaaatatgtgtatgctaaagtagttgaatgaaatattctgtaagtgtctgttaggtccatttggtagactatagtttaactttgatatttctttgttgattttctgtgtagacaatttataggttcctttcgatcttggactgttactaaaaagatgcactgagtataattatacataatttacttcatacttattcaaatacttttggagattaaatttccagaaatgaatttcgtaggtcaatggtgtttatctttataactttggtagctattgctcatttattttcacagaggtgcatcacattatactctcaaagtaatacatgggagttagcccttacccacagtcacaccaatagagtacataatcagacttttgtatttttgtcaatctgagaggtgaacaatggtatcgcaatgtagttttaatttgtatttatattattagtaactggagagattttctttttaacttttaagaactacttgtttttcttttctgtaaaaggtctattcgtatcctttggccatttttcttagatttttatttttgccttattgatctatatgtactcttgtactagaaagattaaccctttttaatatgagctgcagaggatttttaaaaaatatattgttgtttgataggactttctcttctgattcattggtctatagagttgatcctgagtttctctagctttattaatataatgagttatatattgttttttagagatttcttaatattatttgttttcccaaatgacattagaatcagcttttcttcttcccaaataaaaatctatttttactggtgtgttaggcttttctcacattgctataaagaaatacctggtactgggtgatttacaaagaaaagaggttcaattggctcgtggttctgcaggttgtacaggaagcatggtgctggaatctgcttggcttttgtagaagtgtcgggaaacttacaatcatggcaggaggcaaatggggggcaggcacctcacgtggcaggagcaagagagagcaaggaatgagatgctacacgcttttaaacgaccagaaatcacaagaactcacacactattgcaaggacagtaccaagagggatggtgctaaactattcatgagaaatccatccccatggtccaatcaacttccaccaggccccaccttcgacattgggaattacatttcaatatgagatttgggcagggacacaatccacattatatcaactgagatcatattaaatttgtgcatcaatttaaggataattgacattttcttaatattgaatattgttcaagtatttttattgttcaggaatgcaggtcttgaacacttttttggtaatatatctgtttgttgcaatttagatttcagatatttatttcttatattaattttccaccagactaccatactaaagtatctgaatatttatatcaaataaaaaaattatgtaacttgaaagtacagtagtaataatttacatcttctttcctatttttatatctgccaaatcttggtattaacgaaaattacttcggtgttgctaaatcagagtttgactttcaggctgaggttgctgtatttcattacattaagtatctttctactattgttttctttagattttttaaaacttaagaataagaatgtcgtaaatgtctttacagggtttaaggagataatcttatttttcctttagctttattaataaaatgaattgtatattcataaatttgctagtatagacccatttttgctctatgtgaaccctactgttcataatgtgttgtttaatatgctgttagaatctgtttgcagtattttatgatgtttgtattaatatttttaagactgaatatgtatgcaatcctaacctagtttaatattaatattataatagcatcacaaaaaatgataatatctcccatacctcttttttgatttggtttttgttttctatgcactgagctagtttaaatagcattggaattatctactaaaaagtattgatagaatttccccatgagattaccttcttttgtgagttttagatgtttaagtcttttctctatttctcctattaaaatctattagtttccattttgttccttgctgggattaggatgaataagtaatattctcccaaaaaattattcaattaatctagatttgtcaatttaagcaatgtctcttttatgatgtgcttatttttccctattttgtgaatatccttctgcatatgtttttcttttcatagctttaccttcttatgttttcttgatcaattggtattcctctccctcaccacaacaaacttgacttatgtatcagtgtaactgtcattttatgttttctaactattaatttcagcttttttctttgttaattgcataccgctgctttattttagatttgtttcatgtacttttataacactttttagtcttattattgatttatttgttttctttctaattttaaaattgatctacagtttaaagctatgaattgttctctctgcactgttttggcaatttcccaaaagtcttgatctggagcttttaaaaatcattcttataaaggaaattttaccaattcagtatgtatttctctttatcctaaaagtaatttcagatcaatttactttaaacttgccaggtaattgagtcttttcattttctgagttttttattgattgttagtcttattggattatactcagataccatggtcagcaatatatactttttggagatattaaagattttgtatagttatagtcaacattttatgagcatttcttttgaaagctataatctttatttcaagtcacagcgttaaacatttatgttagatttaccatcttaattgatatatttgtccccttgatctgtcatggacttaggttaataaaacttctgccacaggatatttctctctccttatagtctctgtaatgtttgctttatgagtgttggtgtggtattgtgttatgaacagcaattcataactgttttatctttactgtgaatttttcaaattattgacaaaactatcaagtgataacagattaggtagaaggaagaggaaagctgctaaatctataattgttcaaggaagagaactaatagaataaagaaaaagaaaaatttaaaaccttaaatatcaaaataagtactaaataaaaaataagtaaattactcaaaaaaaaagcaaatcatctcatgttgaaagactttttaaaaaagctttagaaatagaaaatatgacattaaatgacattgaattaagaccagacatatttgtcaaagtaataaatatcaataggtttaattcacatattgaaagataaagtcatcagattgtactacgaagcaaagacactcaattaaaataaataactcagaaaaaaattgaataaaaggatgagcaaaagtataaatagaaaatgtaaaataaagcaagatgcaatctttatatatgacaaaatggaattcagaccaaaaaaaaatgatgagggatacttttgtcaataattttaactttcttgatattcactttgtattcttagatttgattatacttgttttacctgatctatcatgtttaaattatggatagtgagtaaaactatgttaactcctctatttgtttagttgtttatttttacactttcacatatcatttcctatttactgttaccttaatctccacatttgttcagtctcagtcctataattaaatatattcgatagtcacaatatgtcattttgttatagtttcaccagtcatctcttggctgacttaagttctttttccagtaatgaagaattcatgggaaaaatattagctgaacacttgcttgatcaataccagtaaaacttatacaatttgacttggtcaaacatagcattcatgtatcatgtttttttttctctgagtattgtacaggtatttctatattagtctctgtcattgaatggttgcatttgatacatttgaagccaatctgacatttctttctttattctgacttaaccttttttgagtggaacttcagttttttctctatccttaaaatccaataattttaataggcagtaaccaaaattgaccattctgagttaatcgctcccaactaactcagaggatgttgcattttttcaatgtagattcaaatcatttttatttcctcaaagttgtcttgaattataactttaaaaaatattcttctcaggcttttcttctttggaaactcattttgattatgatagaacttatttatctgcttactaaatttgtcattttctctctaaactattttaaatatatctttttgtttattttttctcacaactatcttttgtcccttgctagtttttccatagtatcctgcctttcttgaagtttttcaaatcttttttcctttcttttatgtgttttgtttttcttttctagttctttcctgatttctgcatgctcattttcatccctcctattgttaagatatgttaatcctattcctacatttttacttggctttttccaaacgcatggaatattatttcattaagcttctgttgttttctttatgtattcattttcattacatttctcatccactttcaggcaatcttttcctcgtgcatatttttcatctgcttgtagatttctcccatttttcatggaaaatctttgtgttggtgctatacccagttcttttttcattgttcgtcactgaatgtgttgaattttcctagattagcaatttgggggaggtacctaagcaggaggctaggggagaaaggatacagtagcccttcagatttttcatttgctcactacttccatcccttaggggtcctgttgattctttctatggatgtgcctcctttttctgcaggatacataatgtaaccactgctctgaaaatggccctgctctcttgtattctatacccttaattgtatcaagggtgtagcttttggaattcaaattgggcaccttgtttttactttagataattttttttttaaactggaacttcagtagatattccatcgcttgagcttttaccattctgctctgacttttttcagttcctcctatgcagattccacccaatatcatcaatataggcagaagaaccattggggacaaaaagagaggattattaagtttctcataatgaattacttgaaacgagagaatatatattagaaataaggtttcaaaggtatgcctgggttggtacactatgaattttaataagttagaactgtatgatatttttaagtgatggattttaaaaaattaatcatttgcataattaatcagactctgctaattaattctataaaactatatgcaaaatgcataaaatatttttgaaattaaaatttggactaataaagaggagttaaaatgataattagaaactttctttgatgcaacaacaatatgtgctctttaagaaaaatctggaaaacataggaataaagcataaattaaaatatttaacattttggccatagttaaatataaatgcatacatgttattgttttaaaactagaatcacactcaaaatattgtgatctctattttaatctttttgtatatatattcttttaaataggatttttataatggctgcagagtatctcttcatatgcaaaggtgtaatttgtttttatcagttctccattataagatattcagatggtttcgacactgaaaattgtattgtgttaattgtcctaatgaagcaggatatttccctgaccccttcgcggaattcctgacaggggtgcctcatttactcagccccgctcgctgctctcagctcctcgcgggagggagtgcacgagcgaacgagtacgggagctggaatgaatgagtgctggaatcggctggccacttggcgctggtaggacccaaccccactcactcggacctgcagcgttccacccctcatgggagggagcgcacaggtgagcaggtgtaggaactgaccccacactttagaaccggcaggattgaactccatgcaggccccacagcagactccaaccgggggtgcctgcgactctcagagccccagagggcacgttacagtgctcttttagctctgctgtccgcagtccgcagtccgcagtccgcattagtgttaatagctcagtggggcctctgacttttcacatgaggcggctgccttccaccagccagggtgaagagccagtgtgacagccagactcttctcgaagttacgaagttacgccaccaagctgtccctctgaagtcaagccacttctctccgatgcccagctgtatcctgtctactggctgagtctgggattaatataggcacaggatggggcggggtggggccatgagtggtttaggaaaaagcaacatttgagcgggaaaacagggatagaagttctcactttgggctgtggtttcaggcttttcagcttgagggtaggaattcctggggacctactcttttctgcctagattttctgtgcctgctgttccctatcactaatacacaaatcttggtgtacttcaaatagtgtaatccaaatagtgtaatccaatttagataaattggaaggagtaaaatttctgggacagaaaacaatgcatatttcccatatatcttcttaaattgtcctctagaaagattttattacttatttattatcattattcaacagtggttgatttccttttctttgaatctttaatgaaaatatgcataattttaagtcattttgtatatttgatatataaaatatggtctcatctttacattatagtgtgaaacattagtgagattgaggtgtttttgtttgttttgtttgcttctcctgaattcatggggcacagacatttctcctttataaactgcctgtccctgctctgtagctgggttgctcttggtacattgtcctttttctatgtaaaaactcttagtgaaaactctttcatatgggacaaatatcacttctcttccccatctctggtttgccttgcaattttgtctgtctttttaatacagaattttaaatgtttataaatctgttggtatgttcctttgaattttcttctgttttatacttagaaatttctgttttgaaaatcatgagtatgtaaatataattttttcatttttgcattttggaaatgtcataattaagaggtgataattgtgacatgatctgaggactgtttctgtatttaccgtcatatctcatttgtctcactgatgtttctttactagaattagtctcatttatgtactgcattttataatatgcaatattatcatataaagcatataagatactattacaagataatatagcatattcctcactatacttttctattctatataaattttaaaacattttgtcatctcccaaaaaatagtgtcttggaatttttatttggacatcactaaaactaaaatatttagggataattgatcagaagcaacatgatatttctctttctaaattttttatatttttctctaaattgttttatagtctttttcatgtaatatatacacacacgtatgtgattttccctatatattttgtattttatgtctggcttattttacattcttttttttttttttttttttgagatggagtctcactctgtcacccaggttggagtgcagtggctccatctcggctcactgcaacctccccctctgggttcaagcgattctcctgcctcagcctcctggtagctgggactacaggtgtatgccaccacgcccgtctaatttttgtatttttagtagagacggtgtttcaccatgttggtcaggctggtctcaaactcctgacctcatgatccacccgccttggcctcccaaagtgctgggattacaggtgtgagccacagtgcctggccaacattcttattaacaatatgaggccaggcgtggtggctcaggcctgtaatcccagcactttgggaggctgaggcgggctgatcacctgaggtcgggagttcaagaccagcctgaccaacatggtgaaaccccgtctctactaaaaatacaaaaaagttagccgggcgtggtggcacatgcctgcaaccccagctacttgagaggctgaagcaggagaattacttgaacccggaaggcggaggttgtggtgagccaagattgctccattgcactccagcctgggcaacaagagcaaaactctgtctcaaacaaaacaaaacaaaacaaaacaaaacaaaaacaatatgaaagcaaccaatttcctttaaaagtatttttaaaactttcaacaattgtatgggctttttgggtacatttctctttagagattctattgtgaaaatattgtattaattgtttgacctttttgagcttttagcttaattttaaaataaaaactgcttaatatttttgttcattttatattaaataaaaaccggtcattaactataactcttaagttgacatttcacacaaaaataataatagagatggatagatttttatcctcattcttttaattataaatattaattaccatatgataccagatagtattttatctgctgaagtatttgatgacttatattacaaatggctttataatgcaggccccagatttctaaattagtagtgtttatttttatagatcaaaatatcatgtccagtcacagtggctcatacctgtaatcccagcagtttgggaagccaaggctgatgaatcacttgagctcaggaactcaagaccagcctggccaacatggtgaaaccctatctctactaaaaagacaaaaactagccgggcatggtggtgcatgcttgtagtctcagctacttgagaggctaaggcacaagaatcgcttgaacccaagaggcagaggtggcagtgagctgagatcacgccactgcactccagcctaggcagcagagcaagactccatccaaaaaaacccccaaaaacctaatgtttttatttatattttagattagtgggatggtttggccatgaactcagcaccagatttaagatggataacagtaagtgtatttattttacctaatgccatttttattttaactttatttcaatgttcatctgtctttgtattatgtgtaatgtatatgccccagggagagtgcacttcaaaaatgtcactgagaattctcaaataagaaatgacatttccagagtgtaagactaagagtttatagattttagcatgattttgagtctatcccttagcagggagataaaagaaaatgaagtccaaggtaagggtcatgtggcttggtcaggtgccatcaacatagagtgcctgaaacactgggcatggaggacaggaggaaatttggggcttggagtcagatccagaaagacctgggtgttaatcacactttgctgcttaatagttttttgatcctgcacaagttatatcatcttgtgtcattgttttttctttcccacttatctaatgtgaataataaaatctatttaaagatttggttttagggttagtcaagctcaaaacaataagccaagtaggacacagcagtaccttaataaatactcattttcactcctcttttttcctattttccttttgtggcttttgccatgtaccaaagagtgtagcaattcctgtgagcagttaaccccagcagatagaagtgaaactctaccatgcagagcttccttttcctgcatgacctcatttctcaatcacatgggatgcagaaagatcatacgtgctttgagagttcaacataaacttgatccttcagattgctttaaaccctgagatactgttttaaatttgttttcattttttattgactttatttttttgtttttgaaacaaggtcttgttctgtcacctaggccggagtacagtggtgcgatcaggctcagttcagccttgatattcctggctcaagcaatcttctcgccttagcttcctaagtagctgggactagaggtgtgcaccaccatgactggatgatgatgatgatgctgattattattattattatttagtggagatgaggtcttgctatgttgtccaagctggcctgagataatattttatatatataggtgctctttgacttacaatggggttatttcctgataagcccatcataagctgaaaatatcataagtaaaaaatgcatttaatacacctaatctatagaacatcatagcttagcctagcctaccttaaaacacattcaaaacacttacatagcctagagttgggcaaaaccatctaacacaaatcctattttataataaagcattgaatatattatatgatttattgaatactatactaaaagtggaaaacacaatgggcgtatgggtagtcgaagtatggcttctacttaagatgtactgcttttgtatcactgtaaaattgaacaattttaagtcaaaccattgttaagtcagggaccattggtatgcagatttgtagcaaccaaattgcaaaatgggatattccagtcaagtcaggatacctgtattttaccttggctgctaaaataattagatctgttattataccagttatttaaattctttgagatgggttttcttatttggaaataaaggaattgaatttgatcaggggtagcaaactttttctgtgaaaggccagataggaaatattttaagctttctaggctatacagtctctgtggcaaatactcaattccgtcattgtggtggtaaagcagccataggtgatacataagtgaaagattgtggctatgttttcataaaactgtattttaaaaagcagggcctggcacgaagactcacgcctgtaatcccagcactttgggaggcaaggcagatggatcaattgatcacaggagtttgagaccagcctgggtgacatagtgagaccttgtctctataaaaactacagaaattagccaggagtggtggtatgcatctgtagtcccagctacttgggagcctgaggcgggaagatcacctgagcccggggaggtcaaggctgcagtgagccatgattgagccactgcactcaggcctgggtaacagagtgatactctgtctcaaaaacaaaaacaaaactagtgggtcaaatttggcccacaggccatatggccatatattagtctgttttcacactgctataaagataccacctgagactcagtaatttgaaaaggaaagaattttaattgactcacagtttcacatggctggggaagtctcaggaaacttacaatcatgtcagaaggcaaagggaaagcaaggcacatatgaggtgatgggaggtgagagagagagagaaagagagagagtgcataaaaactgctgtttttggccgggcgtggtggctcacgcctgtaatcccagcactttgggaggccaaggcgggcggatcacgaggtcaggagatcgagaccaccctggctaacactgtgaaaccccatctctactaaaaatacaaaaaaattagctgggcgtggtgacaggcacccgtagtcccagctactcggaaagctgaggcaggagaatggcgtgaacccgtgaggcggaggtttcagtgagccaagatcgcgccactgcattccagcctgggcaacagagcgagactccatctcaaaaacaaaaacaaaaaaaaaaaacaaaacaaaaaaaactgctgtttttaaaaccatcagatcttgtgagaactccttcactatcatgagaacggcatgcaggaaactgcccccatgatccattcacctcccatcaggtcccaccctcgacatatggggattacaattcaagatgagatttgggtggggactcagagccaaaccatatcaccatagtttgcttaatcctggatttgataactataaaaaagtcatcaagttttaacattcttttagtcagtcatagtgttaacttatctctgactagctatcttaaccctattgaatttaacttgctacagttcaatctgcttaattctaattagtagagcatctgttattaatttaccttttttatatacttaggcagatcttttttttaaagctccctctattgtgtgtgtgtgtgtgtgtgtgtgtgtgtgtctgtgtgtgttctgtaagagaaaccacttgacctaacaatcctagagctaaaagtcagcttcataggtcatttcattcatatttctgcctttgggagacattacaattacatgccactaaaagctgatgctctctctcattgacatggtttcataatagaatagcaaatgttgagcagaataaggaatcctggcttgggaataggaaggcagagaatgagatccagaaaaacttccagaagaggtcatttttaccttgggtctaagatttctggtgttctgctaagaagttggggacaagggaggtgggaactgctggtaaacgggaaataacgtcgatattttagttccatggagcttatcttaaatatctcagaaatcctacttaggaagaaaagtttaagtcttgctcttttactctccagtactctagtatctttatggacacttttaaagttaccttctatgataatgacatgatattaatttctcagaactgcagttaatccctggggtctgtggattccgaatttcaaatcctcccattttgttggtctgttccttgcatgctagtttagaggtaagtgatgtgtgtttcaaccttcccacatctttgcgttttttcttgatctgtttgtgacaattcatagtactttctctgctacacagcaagatgatacatgtgcactgtgcatgaacaagggacagaaggcagcattcccctttaggacagtgatgatgtggtgagggtctcccttcattcatgtcaccagcccccagcacaatgcttggcacattgttggcacatagtaaatattaaatggaactcttttggggagatacgttttttactccacttagaatctgtttaaacatgaataagttatttaaccttctcttggcctctctttataccaaataagcatgcaatatttagttcttcataaattcgctcattcaacataaatttattgagaaaatattgtgtgcctgatgtgattactagggactgtactttttctagttcattgtaggtgaatgaactgaccaagtaccatgtgacaaagctaggaaagacttacttgaaggaaaaaagaataatcagagtaaaccaaagattaaataaggttgtctcataaggtagggtggttttatgatttttttaaattgggacttctatgccattatgtccatttatagtctccactatcactgactcaatattttcctttaaattaatttatatttttatttaggtaaatttagtctcaccctgaaatgataaatatacataacaagaaaatgaaattgtgattccttagatactattatttagtgttagactaaatgtggccaagtaaaaatatataggttatatagtataaaattcatatataatgtaaatgtataaatatttacataaataatgtaaatatataaagtaattgtatattttgtatacctatatttaagtaaaatatattttaagtaaatgtgcatatatatttctaatagaagttttacatagaactattcaaacaaggatttgaaattttttcatgtctccttctaaaatcatgtagtttatgatattttggcaaaaacttatagaggatttcagcatcaaatgagtgacaggatgaagattcaaaattccttctaatctaaaattgcataattctgtgaacacttacagcagtttctcattctggccactggatggcagcatcaagttcctctgtttttattaaatttcaccactggatagtgatcatcacctcatttcattctgtctcaatttaaagcgcacctactcagtttaaccactagatggagcttgtgttgttttcacttcatggcagaatttttctttaacttggaaaatagacacagtaacgagatttttcagccagtgatatatatttttgacagttttttgagtaaaaatctgcttagtaaatcagataatgatatttgagttgtttttatagtatccattcagataaatattttgtttaaacattttaaaacaaaataaagtttctgcattccttgcaagtttgtatcagcgagatgtgtgacaatatcagaagcaccaggacataccttaggaagagcttgtacctaaagtaatttcctctggtgcccatatctttgcaaataacttctcagacgtacctggaaatttccttttagacgccttcactttggcatactttctgcagtggactggcttttctagtagtattcacccttctcttgtgggaaaggaagcacattcctattcttccagccactgttttcctaccacactgtattagagtcacctagacaaagtttttattttcagttataatctgagaactgatttattttttctttttaatatctaaacttaaacctcagcctcctgagtagctgggactacaggtgtgcaccgctacaccaggctaatttttgtagttttttgtacagataaagtcttactatgttacccagtcaatatctaaacttaaaaccctaaaagccacaagaagaatgatatgcatttctctggatcttctaatcacttacatatttcccttgagcctctttctgctcatttcactgctgagactatgttctaaccaaaattatctttagttaatcaagccttatgttggtaaaagtgttttttcaaaattctttcctactgtaaattgcaaaatttttgaattacaaactaatgcattgaattgcttccctttctctgttaaaatgtcttattttctagacatttatgggtttctcatgtgagtaaacatcagtgaattaactatgcttctattaatacttaccttcctttaagttttatttatttatatttagagatgaggtcttgctctgttgttcagactggaatgcaatagtacgatcatggcttagcatggcctcaaactcctggggttcaagtgatcctcctgcccccaccttccaggtaactgggactgcaggactgcaccaccacacttggctgattattattatttatttattttatttctttatttttgagacagggtccccttctgtcactcctagagtgcagtgatgggatctcagctcactgcaacctctgcctcctggactcagttgatcttcccacctcagcctccacagcagctgggactacaagagtgcaccaccatgcccgactaatttttgtatttttttatagagacaggattttgccatgttgcccaggctgatcttgaactactggctgcaagtggtcctcctgagtagctaagactacagggcatgccactgtgctcagcttatttttaaatttttttagagatgaggtctggctatgttgtccacgttaatctggaactcctggcctcaagcgattctcctgcctcagtctcctgtttgaaatgtttgtttttcagtgctataaagaaatagcacttgaacgcaaatttaatttatttagtaaggccatttttacttcctgcagagaggatacactcgccagcagttttgccatgagagtacaccgaacaaaggagacagggtcatttataacctgacgtgtccaccctactgctgtgtccagttccaatggctggaatgggacctcccattctgtatttgtcccgattggctagtaacttagaactttttaaaagacgtaaaggtagagggtaacaaaggaaggaggaagtaacttgtggaatgctaagaaaggtaaaaacacttttaaataaggaagaggaacaggctgtgacctaatgctgcttggaccagtataagcatgccagggcaaatatttaggctaaattgtgggagctaaaaacataaagtatattgatttatttattacagctagcagatatttaagaatgttagcacaggtctttgaataaattttgcttctaagagaagttactatttattcctaattagacgggaaggaaagtctttgaagaggaacctctactttactttttatactcctaagcagttgggatgacagacgtgaaccactgcactcagccaccttatctttttaaaccagtttattccattttaggagataggtggttgaagtttcaataaacgaaagaagtaaatgcatgaatcaaactgcctctttgttgtctctacttttaagaaatattcaacacagtcaaatacgaactggaggagagattctatacttaagaatcaatcacatataaataagaccttagatttttaatgcaatgactttttaaaaagatattaatatggctttttttaataaatacatgtgtatatggttgattgatataaaaaatagcacattgtaatcagtttcaaactgtccttttgtttatatttttttatctgaatcatttatacaatagttcttaaaatattgtggatcaagggatgaagcctgaggccaggaacctggtggcaagtactctctccctcaatggacacgaagtgtgaccttacacaagcaacaactccctttggatgtatttgccttattttttaaagtaagatgtttggacaagattattttggaagtctcctcactttccaaaatacttaaatttaaacaatacgtatattatattttgagggttcatatttatgtgtagcgataggtagacaatatttagtccctttcagtattctgaattcataatgaaataaatggcttcaaaatacaaagttagagcattcaattaaaatacatggcgagtcagaagactcaacaaagaaatgtactatacgtttcctttcaaatttcctagagagacagttttaagaatttaagagaaaaatatgacaattgaaaacatcacaccaaacttatttttcctgtttaaacttatctagcttttcaagctttgtgttcattttgtcagtaagaaaaaaaatacaagtagttgaaactctgcaaagtattatcttctaagctgaatatttttcaaaccacagttttcattttttctaatttaaaaaaattattttctcaatattgaaagcataacatttatgagaagcaaaaaagaaaatagaatatttatgttacttccctattattctctctcaatatttttatgtgaagctcagaatagacttttaccctctgtgagatgaatttaaaagtgcctcagaatgcagttgcccttattgtggttgtaatggagaaagtaagttttatatttaaaagttattttatgatttaaagagtgttaacattccacagtatattaagatggaagctatttgtcataccaaaaaaattggtttctagttatcaagagaaagcttcaagagcaacattccctacgcccctttaaaaactaaatgcaagtaatattcctccaagttttactaacctatgcacacaaatgaactatcattaaatgtgatacttcacatatcgattgcccccatgtacatattagggcacccatagcataaccacaaaatttcctagaattatttattatttagaatttcttagaatattattaagctccagagagaatcttggaaagattcctcacatagtctttttattccaaacttcacagccaaaccagctgtggcccgtgccttgcctgtccctgctcctctgggagaattttgattcttgtcccttgacccaaaacttggcagtgttcccttgagtcttcattatgccaagtctacctacatttgctttgcccaagaaaatgaaggagatgcctcctaccaagttctgtgtaacctgggtcatctgaatcttggagcactattatttgtactgcagatctctctcgggagcttatgaagccaagatatcagcctctacttgagctgtctctgtagacttcagacattgtctgggagttgtggttgaagagagagacaggcaccattctgtcctgtttttcctctcttgcttagatatcatttaccttcagtacagttcccagcctctccttcagccaatccatagcctctatacagtatagttccaggaaatctatggctgaatggtttgagttttattagagtgcctgcctacacatgccacgtgtacatacaggaataactgttttcatagacttgataaagtctcaatatcaccaaatgaccctatctttgctcttgatatctttgctcatgacacagaaaaggaacattaagtggcaggccagtgcatcacgctctgtttgcagttcatttagttcttatacataggatatatttttacactctacttgaccttaagagataagccagaaaagcacatctgttctgacccctaatattccaacaccagttattgtgtgcccttgtcactcatcttaatataagacatctcagcccacaaatggcagtattttcacaccagtgctagagtttagaaggggggaaatgagagaaaccaagcccaaatgcttcagtaaaaataaatgcattatctaatattatttgctttcctctctgaggaaacttagcattattatttaactgcttgttttcttattgttaaactggaagagatttgggagtcagtaaagcagttataaatatcaccagtaacactgctttacacatttgcacatgtttagatcatattgcacttttttgaggataaacaaactttacatcaaagttggaaaagtcttcttgattatgatttcaaaaagtggttttggggaaaagcttacattgtatgatatttaaatccatttattaaggtatgttttacttgattatactaacttaatttaaaataattttgaaggtatgttcccggaccaaattgagggttgggctgctatttctcatggcccaataacaagatgcagatgaacaggggaggaagagagtttttatttctgtaactggttacagggagaaggcctggaaattatcaccagaccaactcaaaattacaaagttttacaggtgtaagtgtgcattcatctgaagacataagtgattaacttcttttaatctacaactaaggtctgagtcctgaagaccttcctctggagcctcagtaaatttacttaatctaaatgggtccaggtgctggagtgattacccttatcttgtcttctgctaaatcactgaagtttgaggagttcctttagaccttcaataaacttgtttgtagaggcctggagagtttcttcacaaccacagtaaaacttgtttaatcctgaatgggtcctgttaagaattccttcattattctgtcatgctttaaggcccagggaaagcctaggcaaaactcttgataggcttttgttcatcccagcctttgtataagggcactgacttttttagtttttaatatttaatgtaaccactcggtcagtactgaaacagttgtgatggaggcctgcattagtgaaacctggcctgccacaggtacatgatattaacttacattttcttcctttgcaagttttatttaagtgacatttgtacaatttttctgtcatggaaattttaccttcagtatttaatagcaaagcatttaaaggagggcatgattttacacaaaaagattatgtaaagggagatatttattggaaagatcaaatatgggcatttcctttttatgcatgatttactcttaatttttgcttctttgtaaatcaataagacactttaatctgattgtttctcattccacagatctttaagcaagcgacaatgaaggcattgcggaaaaaatctgttttgctaactggctatctggaatacctgatcaagcataactatggcaaagataaagcagcaaccaagaaaccagttgtgaacataattactccgtctcatgtagaggagcgggggtgccagctaacaataacattttctgttccaaacaaagatgttttccaagaactagaaaaaagaggagtggttgtaagtatgtcttgctttgctaccagattttgtctatgggccgcatgttagggataaaatttggactctttggtttattcattgttgcatgttatttcacatcagtcagtcaattaaggataaattaagtgccaactaagccctcagcactgtgctaactgaaaggcatagagatctgtcgtttctgataaaagagaagataccacaaacttggcttataggaatagttttttgtaacttactcattcttttcataacagtttgggcagaaaaaagttattatttcatcatactcagtcaggacattgttttctctagtctgtactacaattcatttattggatgaatggaattaaagatcataccaatttattgaagggttaaaaaagaaagtcttatttagtcgcttgatcaaattaagttattttcaaccttgtcacttctgtcaaaaaagatatatatacacttctcaggagtggtaacattgcaaggaataatttttttttaacccttcagcctatatgaccttcttggtctcttgaagagaactaataaatgtgaactgagtaatttcagggaaaaaagataatgtatctacttccaatgattatgtaattaaggcattgcttggctcatgtttacctgtaggagaggttactcccagatgctggagacacaagtcagaaattcaagtttctaaatcaaactctgctgtcgtcaaactctgtcctctttggaaagttcattaggatctattggcttgaaattttcatccgtatttggggtataaaataaattacctccaagagttgtgattggattgaaatgggacagcacacataaactatatactatattgtctagcctatagcaggtgttttctaaagttaaccatagtgatctctaggcatgtcaaattatctggtgctacttcaggacctacaatgtagcccacttcttatttgtgagatcaaagattagagaattaagttcaaggataatttactaaaactctccagaccctaatgaggttttcattcacttaaattcacccaagaattccagtccttccatggggtccccacgggaaaaaaaaaacaaaatgtatttatggtctattaaatgcttaaggaagatagttgctgaatagatttcaggaatctatcttggctatttatgcaccaatccattcttatttcttaaattattatcaagagaaaagtttcataaaacagaaaaacaccatgttttaaagtaaaaaaattttgcatatatattaatttttagggaaatcattatgaaagtgctttacataagtttatctggaatgtagattttcaacgtgtgaataatgctaacattattgtggctttattttttccccacagtgtgacaagcggaatccaaatggcattcgagtggctccagttcctctctataattctttccatgatgtttataaatttaccaatctgctcacttctatacttgactctgcagaaacaaaaaattagcagtgttttctagaacaacttaagcaaattatactgaaagctgctgtggttatttcagtattattcgatttttaattattgaaagtatgtcaccattgaccacatgtaactaacaataaataatataccttacagaaaatctga

SEQ ID NO: 904 - DNA, 164692 bp, Homo sapiens; identical to SEQ ID NO: 903

SEQ ID NO: 905 - DNA, 111913 bp, Homo sapiens
agcagttctttgaatttctcaccctaagatctggcctgtacattttcaaggaattcttgagaggttcttggagagattctgggagccaaacactccattgggatcctagctggtaagcttgaggcgctgataaaaactctctaccctaatgtttactccatgttttttccaaatgaaacttctgtcagctagaatccttgtcatagtgttttagaggtttttttctgctactctcttctttttttatatatattctttttgtaaataaaaatggtatgaccttcctaaaggccccacctttagaaatgggttaaatgaaaagatctttactaatgtaatagaaaagaactgatgaacatagtgcactgaatatggttacatttgacaaaccaaagttagtcctgttcttatttgagtttaagcggtaagattaggtcaaactccagacgagggaaagatattcttaaacagattttaagtcctctgttttctggtaactttaattgtcttatgctgctagtagtcatattaaatatttatttagagaagtgaaaatgcctactcttgaacagagtttcttcccctttcattttatgaaacctaagaaaagaaagttgatacactttttaaaaatatactagattttcttttttcctttctgcttttattttgaggccagtggggtgttatttagtagtaacactgaagcaaatgtattgattttcttaacgtgttcagcaagtaattcatatcctagatatgaaatatacactcgtagcagagtaatgttacccatttctcaatgatatgcttaaagaatcttgctcaatatgcatattgtttttccttttttctttactaatgaaaaactacacgctttctcaacatatttttaagtcaggttctaaactttgaactcctatgtacaatttgcttatttcaggcatgaatgtgaaactgtgtaaagattaactaccagacactcagtcatttatttaactatttagccctaaatcagtgggtgactaggagattctgaattctgtgatttcgttaaaatcaatcagtttttaattattatacaagctttttactttaaagttgtagctgtctaaataaaattgtgaaagcacaatttccaaacctaaatcgaaggcacattgatgctgtccatcagaaggtattgataatttaaaaaaatattacaaactatcttttatctttttataaaggacctaatgtcatttgagcttaaccataatcctttgaagaaagtaaaatttaactttaaataacattgacatacagagcagttaggtgatttgtctgagaccatatggtatgtatgtcccccgtcttgataaaattaacactaaatatgtaacatttgaaaatttgtaaaatatgtaaaagttgaagtttttaaaagtttggatttaagttcttcctttcagaatatgagcatgtcactttatttgcaaactaaacatggcataacattatggcttgtgaacactaattgtcttagctgctggggtgaatgcagaattaagcagcaattagtatgagtgaataaattgcatccttagagtgagtgcactatgctattctgggaactaaagactatatttgagaccatgcgaagttgtgcaagtggtggagtagggcagggtgcagtcatttggaagactatgcccatcaggtatctcaaggtaccccagatgtgacaggcccaggagcggaaccagccactttaacttttgcctggctgaaactggactgggaaggatggattaaaaaggtaaatcaattcatacgtagcttgtggtcctttgcagcttaagtgtaggactgaaaaaagaagccaaagaaaaagggaatgagctgaagaaatacacacacgtacacacacacatcaggaagcaacaggcaaggaaaaataaagtgagaggttcaaggcttcgaggaggaattgagctctgtgcattccattcatgggctttgccaaagaccagcacaatggactcagcatctcaggcatggttaagtaccctactgtgcactctgctatccttttagtccactggtttctactctgtctgtgccaggttttcatctcaatatagaggaaaaggattctgatgcctcaggattattacaagcattaaataagatacagatagaatgacgctaatgagtatcatttttaaaataaggaaagttgaattttattcagaatctgttggtaacaaactaatctctttatttaagtaaccccacttagagtttaaagtcacctccaatcaactcaaagggctgacctcccaaagaaagtctcaaatataaggcaagctctcttgattctgaatttcattagaaatgtttgtctaagtctttctcatatggtcagaatgagagagggtgcccttctagtaatatgtcattatgtcaaataattcatcaaccaattttgtttattctctcgaactgccactttggcggcaggggtactctgtctaaatgagatgtctataaagataaattaaacatgattcaggcccccaggtagagttcagttcagtagggtagaacagcaactcagtccagctaccatcagtaatatgtttgtagtaagactaatctgatagtaaggcagaaaaacatctcatggaattttaggaatagccaagaagatgggtcccctggagacttgcacatagcatgttgcatgaaggattcagtgacttgcaagatgggcttgtcttgtcaccttttcaggagacatagctgttcaatcccttgccattgtgtaactaagtgactcttacttgctgctggaatcacttcatgcttttcatgctttaacaatcagtggttctgttttactttgaaaaatgagtcattctatgacagtattcctcctagaccctagcatttcatagcttctatctatgattattttaaattctagctcctgtatctaactgaatgaataagcacatcccacagctcagattcctgaaagaatttgattatgtactcagctaaacatcatcactgtttggttagagcttttatagcaaataattcacagatctttgatgaaactacattgtctttagtgggtaagtgtccaacagaggtctaataaactatgaccaggcaattgataatgccaagcggtagagacacagtgatctctcttcaaaatgcagtttccttcatcagaaagctatgtgtggggagccatttagaatcaagtttcaggcatagcaaatgtttttgatctttcctatccatacatatgtccaaataaatatagtacctggcagaatgtattattatcgtaagtaaagtacataagtgtgctcttaattgttattggtgttcagaggaagacgggctacttttgcctgagacatcctaacaggcctcttgaaaaaagcattggagcattaggtctttgaaggttggctagaatccaaacaagttgaaggggagcaaaacattttaggcaaaggaaatggcatgagaaaaatcacagaaatagaaaatttcatgtggaggacaaataatacttatggtcagatattgaaagcaccatccatcaatgttgaaatcctacacttttgtacagaaccatggattgaagcagttaggagtcacaactgatatcaaagtaaaaaacatgcaatggtgaaccttggtatctttgtctaggaatataaagaatggcttatcagtggagaccatcgacagttgagaaaagaagaagcccaaaaagtacaagaatgaaaatcgagagtgtaagaagaatgtctgttttactggcattatctaacactcagatatgcaactctttattgccaaacactgtgtgtgttagttaaggtaaaaggtgaagggaggcagaagaatggagattgaattgaattctagagctttagttctgtgtgagtttgggcccccagaagttctagacattaagtacagtctgaattgagaaatattaaacatatcttgtgatccaatattcccctaagttatacactcaaatatccaatgaccagcttgacatttctacctgcatgttcaatacttatttgaaacttaatatatcctaaatataatttttttttaaacagtcatgctctgttgcccaggatggagtgcagtggcacaattagctcactgcaacctcagactgctggtctcctaccccatcctcctcggtagctaggaccacaggtgcatgccagtgccagcacacctggcttttcttttcttttttctttttttttttttttttttgtagagatgacatcttgctacgttgtccagactggtctcaaactcctggcttcaagcaatcccctgcctcggcctcccagtgctggggtaacaggtgtgaaccaccacaaccagcctgctaaactgaattccaatttccctcctcaaaatttttcttccccaggtatttttatttcatcatatttcacatatttgcccatatcccaaagctagaagaaagctcctttcctgtcctcactagaaataatctatccaccagtcctatctactttttctccaaactacatcataaatccacactcttctctctacctttgccctcatcaccaaatttaattcaccaccgtttctctcctgaactactgtgttatccttaatcggtctcccttttcaactttttttttttaattatactttaagttctagggtacatgtgcacaacgtgtaggtttgttatatatgtatatatgtgccatgtcagtttgctgcacccattaactcgtcatttacattacatatttctcctactgctattcctcccccatccccccactccacgacaggctccggtgtgtgatgttccccgccctgtgtccaagtgttctcattgttcagttcccacctgtgagtgagaacatgtggtgtttggttttctgtccttgcgatagtttgctcagaatgatggtttccagcttcatccatgttgctgcaaaggacatgaactcatccttttttatggctgcatagtattccatggtgtatatgtgtcacattttcttaatccagtctatcattgatggacatttgggttggttccaagtgtttgctattgtgaatagtgctgcaataaacatacatgtgcatgtgtctttatagcagcatgatttataatcctttgggtatatatgcagtaatgggattgctgggtcaaatggtatttctgcttctagatccttgaggaatcaccacactgtcttccacaatggttgaactagtttacagtcccaccaacagtgtaaaagtgttcctgtttctccacatcctctccagcacctgttgtttcctgactttttaatgatcgccattctaaccgacatgaggtggtatctcactgtttttaaaactcattacagagctaagtggtttttatttaatgtaaatttatatcacattacttttctactcaaaactccccaatggtatcccattaaacttataaaatttcagttttctttctggctcccaaatttctttttttttttttttttttttttttttgagatggagtctcgctgtcgcccaggctggagtgcagtggtgcaacctcggctcactgcaggctccaccccccggggttcacgccattctcctgcctcagcttcccgagtagctgggactacaggcgcccgccacctcgcacggctaattttttttttgtatttttagtagagacggggcttcaccgtgttagccaggacggtcttgatctcctgacctcgtgatccgcctgcctctgcctcccaaagtgctgggattacaggcgtgagccactgcgcctggccccaaatttctttatgactaccttctgcctttgttttttgcatatcacagtttgtcattcctccttccctctttttccctccctagtgcatttagttgaacaagccaagcccatttccaccccaggaactttgcacttgttgccaggttcctccaggtccaggtcttcacatgatgtagacattctcatctatcactttctcagaaggatgaacatgaccctttaaggtagctcttccacactccagtgactctgtcccattactctgctgtttcctcatagctcttaagtctgaaactacattgtttttctattcttcatttacaaataaattgtacaagggttggcacttatgcactctctcatacactgctgtcctgccattactgggagtcacataataggtaccaaataaatacttgttgaaagagtaaataaatgtataaattaaatgaaatcagcaaaactatatgtaaatctaactagcccaaagaaattttatttcctgtaatatcattttgttcaaaaaaccaaacttaggagaggagaaatataaacaaacaagcttgggtgaagtttaaaacgtatgtgattaaatctccattgtcatttatccttttccaaaaagtgggaaatgttgcatgatgattaaacagaatacaatgtggtttcaagaaacatcacacaatcctgtttgttctaagataataaatatggtgttgaaaggaagaaatttataattactaacagcagcaggtggatgaatctctttggtattcatatgaacaaaatactaacattttaagtaaagttaccttttccatgaatatggttttcactcacaaaaaaggattttgttcaggttcaatatgtccatagttttaaaaccatgatccaagaaccactgggggtgggacagtggagttgggatatggagaaagacaagctaagtgggatgctgcttttcgacactttgacaaagatcatccttaccattatctcctcataagatacctagaggaaaaggtgatgacattatatatatttggaagccacaagtgtggtacatatttctagataataagaatggaatgagctaacatttattgggaacttactctgtcctgagcactattatctaatttagtcctttcaatatctctaagttactattattttgtttctcttttccttttttttttttttttttttttttggtttgtgttttgagacagggtcttgctctgttacccaggctggagtgcggtggtacaatcccagctcactgcaacctccacctcctgggttcaagcgattctcctgcctcagcctccctagtagctgggattacaggcgcctgccaccatgccaccttttcccaacctcaggaataatatacttaaccaaccagcattaaactccatgcatgagtttttctcatatatgaaaagaagaaaataggccaagcgtggtggctcatgcctgtaatcccagcactttgggaggccgaggtgggcggatcacttgagccattttttgtatttttttagtagagatgaggtttcaccatgttggccaggctggtctcaaactcctgacctcaagtgatccgcccacctcggcctcccaaagtgctgggattacaggcatgagccaccatgcctggcctattttcttcttttcatatatgagaaaaactcatgcatggagtttaatgctggttggttaagtatattattcctgaggttgggaaaagggagtcttagtgaaaacaaaaggtgtattacctaaagggctcattttctacaggaaaattatggtggctagattatgttttattattctctttcagttttagagaacaacttgtaatggagccttcatctcttgagctgccggctgacacagtgcagcgcattgcggctgaactcaaatgccacccaacggatgagagggtggctctccacctagatgaggaagataagctgaggcacttcagggagtgcttttatattcccaaaatacaggatctgcctccaggtaagaatgctgggaaggtttttaaattttatttatttatttatttttgctactgcatgtgtttattataatctttgaaaatcattgttgtattacataatagagctgttgcaattatgtttgaaaagcagaagatccctggtgctctcaatcaacctgtcagcctaccttagcctcaaattatctgttttctcccctcctctgaatgaaatacatgcagggtacttatactgtcaactacttctctgaacaattgagtgactgattgaaaattacaggcagatacatttacttgttctctaagcacttgggattcaaagcaattattttagaatgcagtgttagaatagctcttatattctggcacttagtttataataatatgatgtttgtcttagagaaaatattgttttgtgacctggatatattagaagagatgttatatgaatagccatctttgcatgctgtaaagatggcgagtgtaagagttaccaagaaaagaaacaacaaatgcccaacaaatacatactacattttaaaataatgtagtaatctgactctgttctgggtttgaggaagtcatttaaaaaaataaaacataagtagcaaaggtataacaataaaaaatgattcatcatatttagctttactccattttacattaataaaaaaggttcccaggttgaatggaattagtctaccaaactgggtttcgcatcctttataatagtctgattccatttttattcagattaaataaggtacaattttgggtccagtactcaggagccatgaaggtcagctaatacaattttaggatgtctggtttgtataacactaatatatactatgtaataaatgttaaaaacacctatttgtcttcagctatgtacccaacaacctatagaattctggaagaatgaaagaagagaaatacctgtatctgacttaaaattgtgtagtataagttgagggagatattgatggaaatgacagctagaagagacgaaataaaatgaggctataagtgatctgagaccatagaagaaaaatcttctaggtcattctagaatcgaaaattaaaaggacatttttatttgaattgtaagggataaaatactgctatgggagtgaattgtgaggaaataaaatttaggaaaggaattcttaacggaaatgggagataaggggcttggtgatatgtgcatcacacaatgtggaaacctttagaaacagcgaggacccacatgagacaagtcaggtctggttgatggtggccctgccctgatgtgctctctggcctacagggctcctgtactgagtcagaacccagtttaaaaatagcattgtacagccgggcgcggtggctcacgcctgtaatcccagcactttgggaggccgaggcgggcgggtcacgaggtcaggagattgagaccatcctggttaacacggtgaaaccccatctctactaaaactacaaaaaattagccgggcgtagtggcgggcgcctgtagtcccagctgctcgggaggctgaggcaggagaatggcttgaacccgggaggcagagcttgcagagagcggagactgcaccactgcactccagcttgggcgacagtccgaggctccatctcaacaacaacaacaacaacaacaacaaaatagcattgtacctcactaatcaccaggaaaatgcacatcaaaaccacagtgagatatcacctcacacccttttctatgactactattaaaaagtgcaggatataaatattggctaggatatagagtgattacagcccttgtgcactcttagtgggaatgtaaaatggtgcagccactgtaggaaagagtatggcagtttcctcaaaaaccaaagaatagaattaccacatgatccagcaatctcacttcaggatatattgccaaaagaattaaaagcaagatccccaaaagatattagtacactcatgttcatcatagcattattcataatagccaaaaggtggaattaacccatcatcaatagatatgatggaaccttattaagttttaaaaagaaccatgctctacatggttcacatgaatgaactatgagaacatcatgccaagtgaaataatccagacgcaaaaagaaaaatactgtgtaattccaattataccaagtatctagattggtcaaattcataaaaaccaagtagaatggtagttgtcaggaacttggagagggagaaatgaggagttattgtttaatgggtataaaatttcaattttgcaaggtagaaaaattctggagattggttgcacaataatgtgaatgtacttaactgaattgtacacttaaaattgttaacagaataaattttaggtgcattttagcacagcattttaaatatttatcaaaaataaaaacgttttccccttagagaaaagcagcattgtacatataatcacttctgttatacttaaaagttgacttagtatcctaattataggtataatattgattttgattagttatccaatagaaagtaactgaaggattacaaccttggataagtcattgctgattcttaaagataagagatagaaattggtttaataaagaatttaaatagtttgcttgtttaaaaaatatagttttgctggacacggtggctcacatctgtaatcccagcacttagggaggcggaggctggaggatcacttgagtctagaagtttgataccagcctgggcaacatgacaaaaccccatctgtacaaataatacaaaaattaattaggcgtgatggcatgtgcttttactgccagttactctggaggctgaagtgggaggatcacctaagcccagtagttcaaggctgcagtgagccatgatcacaccactgaactccagcctgggtgacagagcaagaccctgtctctaaataacaataattattctaataattttgaatgatgtaaaactttattaaccccaagtgttcttctacatcagtgattgtcaaaatgtgatcccttgaccaaaagcatgaggttcactagagatcttattaaaaatacaagttcttgtgtcctaactcagaattactgaatcagattgttaaggtgaggcccagccttctattctagatcctctaggataagatggtatcctagagttgggtcaattaattccccttcttactattctcacgccagttgcatcttaatgtctaaggattcatgtattcggcaaatatttaatagtcagttaccctactcgagacacttctgtcagaacggttcagagaaccaaagagcaaagctgtcgcatacttgaacgtgtatctagtatgacaacagataataaccaaacttagaaacaattatgctctaccatcatgtagcactctaaatgataatgagggctgtgaagataagggtgtgaccttacccacagaaatatggtgaggtgccatctgaacaaagatgacagcacagtgaggaagtgagcctcatggagcacaggtgaagctgagcctggtcgtggtccacgtttatgctgaacagaggtaccaactcaggagcacatgatgtaggagcaaaaagataacacatttttcataaccatcacaaggggcatggctgatgtttctataacaaagacaggttagcaagagaaaaacccagggaaaacttgagattttatgctaagttgaatgaaagaaatgaatagatgtgactaaatagaattggaatgaaatatgatctaaccgtaatcaacagacagtggcggggggactcagcaagtcctgtatttttggattcttcttgctccctcggtgtagcatttcttccctctgcatatagggcaggacacctgtcatatgaaagtctatccgggagaagggaaaaggtcagtgcgtgagctttctaggttttaaggcttgctgtaggagaggatttcagtttctttgactcacctggctgcaggacacagggcaggggattggagaagatcagaaagaccttgtttctgaggccctctcaaatctccttcagttccaagtactcagcattccaaggcactgtattttagaatactatgttctgacccccaacggtgttgaaatttccttcttttttgttttgacaagatgtgaattcatcaggaaaccagtgttccctatcttattaaagccttccaagagcatctaaaaatggtaaagcatgttggattatttttggagactagcataacaccaagaaaataaactttctttagcagttctgaacaatgaaaaacagaacagaaataaacaagttttgaacaaatgaaaggatcacaactcccaatatgagatttttttttttaatcttgaagaaagtctacaggcatagcctgtacttttttgatgtttttctattatatattatgttttctctgggtttctaatataaattttattaaaataagtactttcattttctattcttagatggtgcctgagatgttatcagagaaaggggtcaaaaatatttttaatcagcttttgtacttatgttcaacattgtcctaaagagcacagctgaaaaataaacaagcaaaagaaaggaggaagagagagagagaaggaaagaaaagaaagaagggaggaaaaaaggaagatataagaaagaaataaaaagaaaagcaagagaaatgcaaggcatacatgtggaaagatatctttctaaaatttttaaaataataaatattcctgtttgaaacatcctcatacctaaatttctgaaagcatactggatagccccataagatatatggcttttgcacagacacaggacaaagacaatctttttcagagtgtcaaactgccatcccagaaacaagttgtgcaaatttacatttcctccaacagtaaagacaattgcctcactaactttggggatcagtaggattgtttttgtttctgttttttggagacagggtcttgctctgtcacccaggctggagtgcagtggcgtgatctcagctcactgcatccttgacctcccaagctgaagtaatcctcctaccttagctcctggggtagctggaactacaggtgcgtgccaccatgcccagctaatttttgtattttttgtcaaggcagagttctgccatgttgctcaggctggtctcaaactcctggactcaagtagtcctcccgcctcagcctaccaatgtgctgggattacaggtgtaagccaccatgccaggcaggattagcagttttaagaatctttgctcattagataataaaataattattccattcttctttgaatttgcagttcttagacaaccgttggagatagttttcataaactccttggtcattgctttcctttttgtcttaagttgctcataatgtatacatttaattttaaactaaaataaatataagtggtaatgtttcattttttttctcttaaggatataaactccttctctcatatatcttaggaattttaagtgaaaatgtccagttaatatagctggctaatagcagaaccagaaatgggttccaaatattgtgactgctagcccatgtgtcttgactcaatcctgcttttacttttttaaaatcactcaattgaagtataatttatggaccataaaattcatccattttaagtatacaatttaataatttttagtaattgcatatgattacagtaccattataatccaattttagaacatttcttcattccatttttttatctctagcctaggcaaacagtaatctactgaacttgctgttattttgatctatatagaagattattaactcaaagaatttttttactattaaactatatttggagaaaaaaaaacggtgctgctttcaatattcttttcatagtcaaataaccctctccttcaatcttaccacacatccaggagagagatcagtaaattgacacccaactttagtagactttagtaagtacttataaaatttaaagttatccaaacaagatcttttataattttgcacatgtaattgtttggactcagataaaattggcatagcaaaataatcatgcttcagtttgtctccagggcttccatataacataatagagagcctcttaaactcaactgcttttaggcttagaaggctgtgacagatatgagttatcagtgcatgaaatacaggaaagcatacttttctctataaactagaatcttttattcaacaacagataaagatatgttaaataaaagattttatccagctataaaaggacatgtatttataactgtaattttgatagtctgataaatctctaactttcataagaaaacaattaagagtattccttagttaaaagtttaattttgtagacattgagacttttttttttttagatggggtctcactctgtcacccaggctggagtgtagtggtgcaattttgactcagagcaacctccaccccctgaactcaaagaatcctccctcctcagccccccaattaggtgggactacagatgcataccactacacccagataactgtttgtatttttggtggagacagggtttcaccatgttgcccatgcttgtctcagactcctgagctcaagtgatctgcccatctcagactccaaagtgttgggattacaggcgtcagccgccatgcctggccaatattgggagcctttcatgttacttaaattctgcatttagtggacatatttgtaaccttgttatttcatttgcattggactgtctgctccctgagtgtaggaactgtcttctttctctgtgaatgtgtgggagtcacctaggcagaccttagtgtggagtgacgtccaatcatgaagagggaacagcatttgcaaacacacaagagaaagcatagttactttgatccctaagaatagttttacatgatcaaagaatgtcatgtaaaaagctgggtattggtaaatggtaaataataaggtacggaatagggaatatagggtactaggatgattggtataatagggtgaagagtaaatgagtgcgtgtgggtacctaacagtaagtctgaagaagtaaatgtaatagaagtggaggtaaaggaaaatattcagtaaatacatgaaatactcattaaataaacctgatttagtagtaggagaggcataccatgagccataatttctgttttaggtgaatagtggtgatattcactgatacaattaacttgttttggaaactattcattgaaagaggaactagttttttatttgtttgtttatctcttgttgccctgtcacctgtggccttgacctccgagtccaagtggcagctgttacaagcagtgagaatcaggcagtgacaaagaagaaaagacaaataatgtgtgtgcactctcccttgagaaaggtttcagtttgcctcatgagttttaacgcatatatagacctaagcccctgggccagtgtttggtcatggccctgcctatctgcaaagaagactgagtctaaaacacaatttttgttcttggtggccacatgcaaagctaacaattctatttctgtaaaggaaaaatgaaatgcatgtagggtacaactagcagttgagtttagttagaaggtagaaatttgacagtcatcagcatttaggtaatagttgaaactgtgggtacggatgatattatcttggcatcatacctaagtgagaagaaggtggtagaaacaaaattctaggcattgacaaagaaagaactctagaaagagccagagacacagaagaacaaggaaagtgtcgtgttctaaaaccaagggaagagacatattcaaagaaatcagagggcttgccatcatcagctatcacaaagactgtataagcctttcatttagcagtcaggagagctttattaaattgtcttaactttaacagcttcactggaatgacaggcagggaaactatgtacatttctagatgtcattgaaggagtaaagtatcggaaatgagatttttaggcttcttttccaagaaaccttgctgtaaaaggaaacataacaaggaacaaaaggaaatgaatgaatgcttttttcaagcaaggtgggggcttgaatatgattgtgcattgagaagatggtatgggaaaaaaaagagacagacagacagataacagaggtgaatgtgattttcagccaagcagagtgcatgctggatctgttgtctattcccacctttttcagctcatggagcccaatattctaagataatgcaaattgctgaagacaatctttccctactctctaaggatatattggccccaatgtctaaggtcaacattagccagattgagattttacaaagaaatctcaaggtcccaaccaacttttccatatttttgggcaatatgataccaggcataacatacctcagccacaggacaaaggactgggaatagaaagattcttacaaggagagtacactttcacctttgcctgggacaatgtttggtcttttctgtcttgccatatgaactctttcctcaaggaattttatccacaaaggcgtggaaaatctcttttgaaatcctcgaaatacgaagtgtctctccctcagatgccataccactcatcaatctagacctcagagagaactaatgggttcaaaattaggcaagagtatctaaggagtgtgtgcaagtagactgtagtgatcctacatttttctccatcttcttcctgaaattataggaattatattcaaagtccaagaagcttgttgggagcatagccttgtatggggcatccctattggaaaaaggacatgaatatttcctcagtgcaccaccaggaaatttaatattatgaggtacatagcaacacaaaaaaatcttcactcactaccttctgaataatagtaaaaagaatatacttttttatttagtaaaatgcagaaatcatacatctctacaaattttacaacatgagcacctctgtgtaacaagatcctagatcaagaaacataacattgccagcacttgggaaaactgcctcgtaccccctttcaggaactccttctttagggttaaccagtttttctgtagccagtatgcgagtatcaacttgtggcatgtgaatgccacaacttaatatgtatttaagaaaatatgtttaatagaaaataggtttaaaatgaaaatatgtatgtttccatatatagagagagatggaagaatatatattttcttttttaaactaatgccatagttcaattatttaagccagacagctaaaactgcttctttttgtccaagtatatggctcacccctgtaacccagtactctttggaaggctgaggcaggaggatggcttgagtccaggaattcaacaccagcctgggcaacatagtgacaccctgtcactacacacctttttctgttcatacttctatttaacaagtgatgctggaccatgatgttcccagcattttattttttaatttcatcctaagatctgctcttatcccccattaagaaggattggtagaatgttctctttcctaatgacagaagtatgaaataacttgttcatcaggagagtttattattgatattgttaatatttaaatacacattccataaattggaatattttgttgtacagtctgagatttaacacatgtatagaattatattaacacaccttctctcagtatatagaacaatttcataacccccaaaagactcctttatgctagccctttgtaaccaatctctccactatacctctaatccctgataaccactaatctattttatatccccattgtcttttccagaataacatatgaagaaattatatactgtatttagtctttggagactggtttcctttacttaaggaaatgcctttgagattaagcaaagttatgtcaatgaagtgtttcattttattgctgaatagtattctaccccaagaatggactacagtagtttattcatttgtccactaaaggccatttgagctgtgtccaattttggtgattatgaatagctactattaacattcatgtacaggattttgtgtgagtgtaaattttttatctaaattttttttttaagatcagatagtaaatatttcactcttgacaggtctcatgtattctttttttatttttatttttttagaaaaggtcttgccctgtcacccaggctggagtgcagtggcataatcacagctcactgcagccttgatctccctggctcaagcaattcttccatcttagcctcctgagtagccagggctacaggcgtgcaccaccacaccagtctcattttttaactttttgtagagatgaggtttcactgtgttgcctagtctaatcttgaacaaagctcaagcagtccttattccttggccttccaaagtgctaggattacagatgtgagctactgcatctttccaggtctcatatattctttctcttctttttttcctttgtcttctcctagtttttcttctcccatttataaatgtaaaaacattcttagctttcaggccatacaaaaacaggtcatgggcttgatttggaactcaaaccacagtttgtcaagtcgttttagaatgctataagttgattgctggatcatattataggtatatttttaactttataagaaactggcaaacttttccagagtggctgtaccattttgcattttgcattgccaccagtaatgtgtgggaatgtctgttgttccccatattcacccccagttggtattaccagttttttgttgttttgttttttagtcacatatgtttgtataagtatcttattttggtatttatatgcatgttcctaatggctaatgaacttaagcattaaacatttcataagcttatgtaccatccatgctctagagaaatgtctgctcaaatattttgactacttttttttaattggattttttgttttttaattgttgagttttgttttttggggattttggagctttttgtttttttgttttttgtttttttaaagagacaaagtcttgtttcgttagccaggctggagtgaagtggtacaatcatagctcactgcatccttgaccttcttgggctcaagcaaatctcctgctaattttaacagacagggtctcgctttgttgcccagactggtcttgaactcctgactttaagatatcctcccactttgacctcccaaggtgctaagataacaggcgtgagtcatgttttcagttttaagagttctttatgcatttcagcgtacaagttgtttgttgaatcaatgatatgaaaatattttctcacagtctgtagctatctttttattctcttattagcgtctatcacagaacacaagattttaactttgaggatgcacagtatatttattttttcttttatggattgtgctttagttaccatgtctaaaacctcctcatctaaccatcagtcttaaagacttctttcgcccataatttatttagaagtgtgttgtttaatttccaagtatttgaacatttcccagttttctttttattactgatttgtagtttaattgtattgtggttagaaaacatttgttaaggtttgtttttgacccaggacaatggtctgtcttaatgactctccatgtgcatttaaaataatatttattctgcagctgtttgctggagtgttctttaaaagccagttacattcatttggttcctggcgtttttcagttctggggattatttgtctgctaataaaatgtagacctagttcctcagaggaccctggtcacagatttatggacataatcataaatcccacttaagcactgttccaaattgctgaaactcaattcaatattaccagcaactgtaacaacacaacaaataaatcacattagtaccacaattattaagattgggaaagttttataattagacagttgtcacccaacaaattcatattagatgcttatatttttcttggtaataccagagatccaaataatcaaagcacaaatgaaacaaacacagctgaaatctttatgctttctattactacttataatacaatcagcaacaatttcaggttcaccaatctgcagaaacattgtatatctttagggatgtgcttttcttctttttccttaaatttttggttaaaaaaaaataagcaacacttaagtttctcaaatgaacagtcataatatgttaacattttaacctacgatatctaaacaggagagcattctaataaaacccctaaactcacctggccttttagtagaatattatctttacatacagatatggaggaaaatatgttaaatgtaaattcttttttcttctctctatcttcatttatttatttatttatttgagacaggatgtccctttgtcatctaggctggaatgcagtggtgctgtcagagctcactgcagcctcaacttcctggactcaatcgatcctcccaccacagcatcctgagaagcagggaccacagacatgcaccaccatgtctggctaatttttaaaaatttttccccaggctcagtgtccagctcctgggctcaagtgatctgcccaccttggcctcccaaggggctggaattacaggcatgagccactgcacacagctgaattcttttcaaaaccagcaaatcatacatttctcatagaagttaacttccacagagatgttttattttctttttctttttttttttcatacttcgaggccaaaaaattgtcatcaagatcctagcaattgctgcagccaatcccaggactttgcttccacagtagctattgagcatcaaatgctctcttagatcatagaccacaactttgatgagctttcattcttagctatgtcttaggattctcctgaaatatgaagggtaggaagttgtattccctagttcaagggaaaaaaaaaatcaatttaaattcaatggtattaaaaacaatgaatatttacttcaaaaaattattataaagcaaaatatggtacaaactagtttttccttctaaactcaaatacctagctagtaatattccaaaaataaacattaattatatggaaagaatttttaaatttttgcaatgctgaaattaatcagtgggaatactgacgctcttacctgtgggtctttgttcttagagctcccaagatggggcgggccgctcccaagatggcagcaagccttttgttctctgaccttgggttcttggcctcacagattccaagaatggaatcttgggccatgcggtgagtgttatagctctattagaagctgtgggtcacggaagaaaaccatggaacccagcgactagtgttcagcttgattaggatgaacccaggcacttagctgtgcaggaacaatggtgagcctttagcccgatcgggagcagaaatgggcaccttgctggatcaggagcacagcagacactctgctagatccagaggggtgggagtcaatggtgggtctgagatggtggcaaacagcagtggtggacccgggtgggagtcaatggcaggtctgtaacagcggcaaacagcggtggtggacagtgagcaaaagctcagctcaagccgtaacaaacacggaccagaagagcgtgcagttgcaagatttaatagagtgaaaacagagctcccatacgatgggaggggacccaaagggggttgccactccctgcttgaatgcctgagtttatatcccgatcattgtccccttgttgtgctctcaggcgatatatgatttgactgtttctttacctcctgcttttagcctaatttgtgtttcagtgagccctctttactacccgattggtcaggtgtgagctgagttaccagccctgtgtttaaaggtgggtgcagtcaccttccccagctaggcttaggaattcttagtcagcctagaaaatccagctagtcctgtctctcagtcccccatctcaacagaaaaacccaagtgctgttggggaagttggccgaacaacgctcttaactgcttcctgctgaattggggcatagtaggggtcgtgcaattgagatttcctcaggaggagtgcctttgatgtcatcaacataggagcatgggctaggaggctgtccaggggcccacagtagatcttagtcatgcatctggggctccatttgaagaatgatttgtagttttatagctttgattctggaagacacaaacttaacaaggaggttaaagatacagggattgaaatgtaggcctgaagtgcaggggaatatttctttggcacacgtcacaggccctgactatctgcttgatagttttgaaaaggcctggtccagtaaataatgattcggccatctgatgggtgctatcaatgcctaagtgaaagtgttactggggggttctagctcccagagctcccaagatggtggcaggccccttccaagatagcggcaagcctcttgttctctgacctggggttcttggcctcaaaggttccaaagaatggaatcttgggccatgcagtgagtgttatagctctattagaagccatgggtcacggaagagaaccgtggaacccagtgactagtgttcagctccattaggatgaacctgggcacttagccgtgcaggaacaatggcaagcctttagcctgatcaggagtggcagcgggcgcctcgctggatcaggagcacagtgaacacactgctggatccagagaggtggaagtcagtggtgggtctgcaacggtggcaaacagcagtggtggatagcaagcgaaagctcaggtcaagccgtaacaaacacggaccaaaagagtgtgcagttgcaagatttaatagagtgaaaacagagctcccatacaaagggaggggacccaaagagggtagccattgccagctcaaatgcctgggtttatatcctgatcattatccctccccctgtgctctcaggcaatagatgattggctatttctttacctcctgtttttgcctagttagcattttagtgaactctctttactacctgattggtcagatatgagttaagttgcaagccccatgtttaaagatggatgcggtcaccttcccagctaggcttaggaattcttagtcggcctaggaaatccagtcagtcctgtctctcagtctcccttctcaacaggaaaacccaagtgctgttgagagattggccgatgattgctctaactgcttcctgctgaattggggtgtagtatgggctgttcagttgagatttcctctggagaggtgcctttgatgttattaacttggagcatgggctagcaggctggtccgggtctgcagtagattttagtcatggactgcatctggggctccatttgaagaacaatttgtagttttatagctttgattctggaagagacaaacttaacaaggatgttaaagatacagggattgcagcaggtggagcttgcagtgagccgagattgcaccactgcagtctggccttggcgaaagagcgagactccatctcaaaaaaaaaaaaaaaaaagatacagggattgaaatgtatggcctgcagtgcagggggttatttttttgacacacttcacaggccctgactatctgcttgttagttttgaaaaagcgtggtccagtaaataatgatttggccatctgatgggtgctattaatgcctaagtgaaaggtttggtgaagggttttaagtaatttctattgtttagttgcaggcaaaagtatttttcctttttcggtggctagccattctgaggggaggaaactacgtccttgtgaggttccccgttctatttctcctgctgagtagcagcttgggttcccagaggggattaccccatactaggggtccttctataagcatttttaatggagagttctgccttgtggctcttttagctttaatacccgcttggcagtttccttctatttttctttccttttctttctgatgaccccggcagtgtaagactgccacctctttaggtttctgtacagccaataataatctcctaatggcttcctgatgtttgataggtgttccctcagaagttaggaattccctttttttccatattgctgtgtgggcgtagaggactaggtaagaatactttgagtctgtatgtatatttacccttttccctttttttaattctagtgcccgagtgagggctattagttctgccagccgagagctagttcctggagtgaggggattactttcaagtattccattattactgaccactgcatacctcgcttttgaagtcctttttttacaaaggaattttcattaatatacaagttgagttagggattagtcaagggaacctctagaaggtccctcgagtggtataggtttgaacaattacctgttgacagttatgttttatctttttcattgtttggaagaaatgtggcggggttaagagttgcgcaagtatgcagttgcagcactggccctttaattaatagagcctgatatttaagcaaacgattgtctgacagccacaagtctcctttagcagtgagtatgctgtttacatcatgagatgtccacacagtaagatctcttccctgtattattttaactgctttacatactaagactgcaactgccgccactacccgtaaacaatgatgccaaccctttgccactacattaattttcttacttaggtatgccatggtttgcaagctggtcccttgaacctgtgtaaggactcctggagctatttctgttttttgtgacatatgaagaaaagtcttgccccgttggtaagcttaacactgagtcttgggttaaggcctttttttagggcctggaaagctgcttttgctttaggagtccattttactaaatgggtattggctttctgagcttccttaattagtgtatataatggcctggctattttgccgtacctgggaatccatatttggcagaagcctgttatgccaaggaaccttttatttgctttagggttttgggatgaggataagccagtataggctggatacatttcttactgagggccctggtgcctttggataattttagccctaagtatttaacctgctgtaagcagagctgagcctttggtttggaaaccttgtagccacaagtggtgaggaagtttaaaagcgcttgggtggcttgatggcacaaggttttttcaacaggcagctagaagtagattatccatgtaccaaaggacaagactgttcaggtatgagaactgtctcaagtcttgagctaatgcctggccaaatagatgtgggctatctcttaacccttggggtaaaacagtccaggtgagttgagacattgggtttgaagcatctttaaaggcaaataagaattgagaatcagaatgtacagggatgcagaaaaaggcatccttaaggtccaggactgtaaaccactctgcttcctctggtatttgggaaagcagagtagaagggtaaggtacagctgggtatagaggaacagcagcctcactgataatcctgacatcttgtactaacctccactgtctattgggcttctttactcctaaaattggaggattgcaggggctattgcatggttttactaggagtagggcttttaggtccttaacaattttttggagtccttgttgggcctcgggtctaagggggtactgcctttggtagggaaaggaggtggaatcctttagtttaactagaacacgacgggcattatttgctcgtccatattgtccttctgttgcccagactttaggattaattcctttttcaagcaggggacaacaaacgggtgttccttttcctatgttcaggtgtataatggtccctgcttttgttagaatgtctttccctaacaagggagtggggtttttaggcataattagaaaagcatgtgaaaagagtaaagttccccagtcacagcttagtggctgggagaagtatctagtggctgtcccaggaccccttggatagtgacagatctggagacagttgtccaggacaggagagtaagactgagaaggccacgccagtgtccaggagacagttaacctcctggccctcaatggttaagcatacccggggctctgtgagggtgatggcatgggctggcgcttgccccaggcaccctcagtcctgctgctggatcatctggttagtggcttctgactcagaggaccttcgtcccctggggcagtgggccttccagtgattcccttgacataaggggcatggacgaggggggtggcttatttctattagaacaatcttttttaaagtgtccttgtagatcgcactggaagcaagccctattaggcattcaatttgtccagactttccctgttccagagcctccgaagtcgtgcttgcctgagggccatgactaaagtggtggccttttctttatcccgtttatcctgttctgcctgctcctcctgatctctattataaaaaaccgaggttgccaagttcaatagggtttctaagttttgctctgggcctaaggtggacttttaaagtttttttctaatgtctgcagctgactgagtgataaacttaacctttaagattagttggccttcaacagagtcaggtgacagagagtttgcttcctcaatgcctcccttagtctctacagaaaggcagtaggattttcttcctttccttgtgttatagtgaacatcactgaataatctataggcttcttcctagttttccttagtcctttagcaagcaagttagcaaatgtctgtggcaccaattccatgttctgattctgtgtcccaatgagggtctacactgggaactgcctgctggcctgtggggaattgttctttttcctctgttgtcatcctatcattgacctgactgagataccagagatcaccaaactctcaggctgcagttatggcagcacttctctcatttgggattagtgtctgatctagcagtaacattatatctctccatgtcagatcaaaggattgtcctaacccttgtaaagcatcaatatagccaacagggttatctgagaatttacctaggtctattttaatttgcttcaagtctgacagggaaaaaggtacatacactctgacaaggccgaattctccagaatacattttaggggtgtttttgccttggggggaatgttttgccagcacccctagtcattttctgatgagcttagttctacagtgttctctatggtcctttccacggtgtgtaaccacccatggacctctgcttatcggattagttgtgctcaccaatgtagcagtcctgcaccccttttcccgcctttcttgaccacaaagaaagggatccgggctgctggattctagtggtcctttaccagcgtgcccaacattgcctttgtgctcaggggtgagtcctagagctgggctgagttcctgagtctttcataacaacctggctgcccatcaagatgcattcccataaacaacagttcttatgcaaattcgtttcagagagggtgaaggtaaccttttgagtcaggagtgagatggagttctttgcccactagggtctttgtccttctttacttttgtaggaatatgccctaaatattgatattaagctttttgttgccccagattaagtccttttgggtacgaaatatgagagagggatcctgtttatcttatgtgcctttttcctacgaggagagcaaggagaaaaagatgggcttgctggttttgtaggtactttaaggcttggctgagtgcaaacagctcacacgtttgacagaccaacgattagggaattctcctaactcttcttccacaagagtctcactatcaattaatgaatacccattgtggtttttttctcaatcacccgagaggaagcatctatccttgtgtcccgaagggagttcctcctaggtctggtaggacctttgtatggtaattaagatttaaatcccctgttaggaaagctgctaggttaagggaattttcagtggttagtgttaaatcaccgttttctaatagaatagcccgatactttaagatttttgagttagtaagctacctttttgcttttttgacttaggatagctctgaactggttatgtgtgctcacaataaggtttcctctaaaggttatttttctactttcttctgttagcaaagcagttaccgctactgattgaatgcatttgggccatttgtgggttactgggttaagaatttttgataggaaggctacaggttgtcagtggtctcagtgtttctggctatgcccttgtttacactgacaacaaggtagtattggagtattatagggtcacagagaagaccttcgattatcaattataggttttaaatttaccctggcttttaaaggaatagggcacactgtttttctttactacttctatctttctatttctttctctctctctcatctctgtctctctctctctcctctctgtctctttctctcccttttctctctctctgcctctttctctttctctcctctctgtctctctctctctctcatctctgtctctctctctgtctcctctctgtctctgtagatggattttggaaaacagcagaaggaagttcgcttgttgaccccatttgccactataggaatatgtgcctccctttagtttactcaatttgctttcatcctgatctattatgttgttgtagacccagttccagaagttaaagtactaggtcatcagttctaaggccctggccaaggagccaaggcttgaagattgtattgaagattgcattgtggggtggtgggtcgggggatgctgggtagaaattaggggaggagagcatcttaaacaatgagagaggaatcctagccatttacaaactcagggcctggcaagagtggtggagaacgggtcccacataactgcccatgtcaaaagttatatacctaaattgggaggggcaccagggacaagattccctggtttcatagcctagatgcctaaggatgcagcatagcgcttccttagatccctttggagatacaacctactctaatacttgggagagaaagtgaaagtctgaagcattagtatctaggaggcagggattggaggaagtagattcagaggtaaggagaattttggggctacactttcaagaaagtcatggttaggacccaagaggtatgggtcagaaggacaggtaggggcgcacacatgggcgactgttgagtagagacttctagcctgcaccatgatctcgaccggccaatgccaggggttcaggacgacagctttctgcctctagttgacccttggcatccctaggaaaattgtgaaagtggaagctggttccaggcagaccaactctcccaacccagaagttgttagaaagccttttcccaggaagcctcacacctgagtctttagtccggtggccatgctaatcgtttttaaccagccgacaggtgcccggtattttcctccaattctaaggtagaggacagaatagcaagcaaaagtggtctgatattactcactgctttggagaatccccatacgaggccaccaaatgttaccagcggatctttgttcttagagctcccaagatgatggtgggctgctcccaagatggggcaggccactcccaagatggcagcaagccttttgttctctgacctgggcttcttggcctcacagattccaaggaatggaaacttgggccatgtggtgagtgttatagctctatcagaagccgtgggacatggaagagaaccatggaaaccactgactagtgttcagcttgattaggatgaacctcggcacttggttgtgcaggaacaaaggtgagactttagcccgatcaggagtggaaatgggtgccttgctggatcaggagcacaacctgccagatccagaggggtgggagtcaatggcgggtctgcaatggtggcaaatagcagttgtggatggtgagcgaaagctcagctcaagccgtaacaaatacggacaagaagagtgtgcagttgcaagatttaatagactgaaaacagagctcccatacaatgggaggggacccaaagggggttgccactccctgctcaaatgcctgggtttatatcctgatcattgtccccccgttgtgctctcaggtgatatatgatttgactatttctttacctccttcttttagcctaatttgtattttagtgagccttctttactacctgattggtcaggtgtgagctgagttaccagcgttgtgtttaaaggtgggtgtggtcaccttccccagctaggcttaggaattcttagtcaacctaggaaatccagctagtcctgtctctcaatacttcaaatattctttacacagacaagccatttaaaaaaaattagagcttacctttgcttttccatcaaaacatattgttacttctaggtttcctcttcaatttgcaaaaggaaaaggaaaatataggtaatttctcaattaaacttacacctgattttcaatatgagtttgtttattgagtgtttgtatatgtgtgtgtttggcagttagaagtatgctgagatttttattcttttagcctttgggggaactggactggcccttcacctctgtcctaatgtagctttttaattttattacaaatgggaaacaatgtaattttctgtatgtttcatctgtgaaaagtattggaaagttttgagttcatatgtattttattattgaattttaaaatatttaaaatgaacttaattaaatcttaaattacagtaaccttatgctgtagtaagttgaaggtaagctaccttctgtgaccttgaataatttaattaaattgagaagtctgttttttttttattatttgttttgtttttaatgggtaaattaaatgccaggcctctgaagtgagttcatataaggaactggttgtgggattttttttaaaaaaaatatgcctatattagagtcctacaccaaaaaaatttagagtttttgactcaaacccaggcactggtatttgttcaagctcctgatgtgatagaccagtatctaagtcctaataaaatatgaaatgatcaattttttttttttgagatggagtcttgctctgttgcccaggcttgagtgcagtggcacgatcttggctcactgcaagctctgcctcctaggttcacaccattctcctgcctcagtctcctgagtagctgggaacacatgcgcccaccaccacgcctggctaattttttgtatttttagtagagacagggtttcactgtgttagccaggatggtcttgatctcctgacctcgtgatccacccacctcagcctcccaaagtgctgggattacaggtgtgagacaccgtgcccagccaaaatgatctattttctaattatataattcaaaaaattgtttcaggaatattattctaaccagttttaaaagtaacatatcaatatatgtatgacattaacattaatggcagtttgtctctttcaaacacagactatctggtacttgtatctaacaatgtatttacaattgtgatcatatatggctagtgttgatgctattaataggatgttccaaacatatatcaagtttttttttttgtggaagtcattatgataggtaatccatatttgtagaagatataagcctttacacaaagactttaacataattacaattcagattaaaattagctttattgggatgccaacaatgaatatattaaagggacatacaggcataactcattttactgcactttgctgtttgtattttttttttaatttcaacttatattttaggttcatgggatatatgtgcaagtttgttatatgggtaaactgtgtgatgccaaggttttgagtacaaatgaccctgttacccaagtagtgaacattgtacccaataggtagtatagttcctccctttatagctatatgtaccaaatgttagctcccacttaaaaatgagaacatatagtatgcagttctctgatcatgcattaattcatttaagataatggcctctggctgcatccatgttgttgaaaatgacatgattgcattctttctatggctatgtagtatttcttggtgtatttgtaccacatgttctttatccaatccaccattgaaaggcatctagaataatttcatacctttgcttttatgaatagttctgcaatgaatctacaaatgcttgtgttttcctagtagaacaatgtatttttctttaggtatatacttggtaatggggttgctgggtcaaatagtagttctattttaaattctttgagaaatctccacactgctttccacagtggctgaactaatttacattcccaccaatgatgtataagtgttttatttctttgcaaccttgtcaccatctgttattttttgatgttttagtaatagccattctgactggtgtgagatggtatctcattgcagttttgatttgcatttcactaacaattattgatgttgagcattttttcatatatttgttggctgtatgtatgtcttctttcaagaagtgtctattcatgttctttgcctttttttttttttttttttctttgagacagagtcttgctctgtcccccaggctggagtgcagtggtgtgatctcggctcattgcaatctccacctcccaggttcaagcgattctcttgcctcagcctcccaagtatctgggactacaggcctctgccaccaaacctggctaattttttgtatttttagtagagacggggtttcactgtgtttgccaggatggtctcaatctcctgacctcgtgatctgcccgcctctgcctctattctttgcccattttttaatggggttatttgtttctcgcttgtcgaattgcttaaattccttatagagtctggatattaaatatttgcaaggaatagtttgtgaatatcttctcccattctgtaggttgtctatttactctgctgatagtttcttttgctgtgcagaagctctttagtttaattaggtcccacttgtcagtttggggggtttttgcaattgttattgaggactcagtcacaaatcctttgtcaaagccactgtccaggatgatatttcctaggttttcttctaggaattttataattttaggtcttacattttagtcttatccatcttgagtcaataattgtatttggtgaaaggtaggggtccagttccattcttctgcatatttctggctggttatcccagcaccacctattgaataagagttcttaccccattgcttgtttttgtcaactttgttaaagattagactgttgtagatatgtggctttattctgggttctctaacctgttctattggtctatgtatatgttttggtcccagtaccatggtgttttggttattgtagccttgtagtttgaagtcaggtaatgatgccatcagccttgttctttttgcttgggattgctttggctattcaggctctttattggtcacatacgaattttagaatagatttttctatttctgtgagaaatgacataggtagtttgataggaatagctttgaatctataaattgctttgagcaatatggtggttttcatgatattgattcttccaatccatgagtatggaatgtttttctatttgtgtcatctataatttttctttgagcagtactttggagttctccttgtagagagctttcacctccttggttagatgtatttcttagtgttttactgttttttcgctgttgcaaatgggattgtattattgatttggctctcagcttaaacattcttggcatatagaaatgctcctgattttttaatgttgattttatattctgaaactttactgaaattgtgtagcagttctaggagaattttggtggagtctttagggttttctaggtatagaatcttatcattagtaaagatagataattttttttctatttagattccttttctttctttctcttgactgactgccctggctaagatttccggtactatattgagtaggagtgggagatatctttgatttgttccagttcttaaggagaatacctccagcttttattcattcagtatgatgttcgctgtgagtttgccatagatcgctcttattgttttgcggtatgttcctttgatgcctagtttgttgagggtttttatcatgaagggatattggattttactgaaagctttttctacatctattgacatgatcatatggtttttgttctcaattatctttacatcctgaatcacatttatggatttacatgtgttgaatcaattctgcatcccaggaataaaacctacttgaatgtggtgaaataactttttcatgtgcttctggatttggtttgctagtattttgttgatgatttttgcttcaatggggatattgacccgtaattttgttgttgttgttgttgttgttatttctttggcagattttggtatcgagtgatactggcttcctagaatgagtcggggaggagtcaccccctccttaattttttgggatagtttcagcagtgttggtaccagctcttctttgtaagtctgatagaatttggctatgaattcatctggcacaggactttttttggttggtaagattttatgactgattcaagttgaaactctattggaatgttcagggtcttagtttctacctggtttagtcttgggaggttgtatctttccaggaatttatctatttccttcagattgtctagttttcatggataaagtgttcataagagtctctaaggatcttttgtatttctttttttttttttttttttttttttgagatggagtttcactcgtgttgcccaggctggagtgcaatggtgcgatctcggctcaccacaacctctgcatcccaggttcaagcgattctcttgcctcagcctcccaagtagctgggattacaggcatgtgccaccgcacccagctaattttgtatttttagtagagatggagtttctccatgttggtcaggctggtctcgaactcccaacctcaggtgatccgcccacctcggcctcccaaagtgctgggattacaggcatgagccacagcacccagctgggatcttttgtatttctttcttccttttttttttttttttttttttttgagatggagtcttgctctgtcacccaggctggagtgcagtggcacgatctcggctcattgcaagctctgcctcccgggttcacgccattcacctacttcagcctccaaattagctgggactacaggtgcccgccactgcacctggctaatttttttttgtatttttagtagagacagggtttcaccatgttagccaggatcatctccatctcctgacctcgtgatccatccacctcagctcccaaagtgctgggattacaggctggagccaccgctcccggctggatcttttgtatttctgcaggattagttgtaatgtcatctttgttgtttctgactgtgcatatttgaatcctctgtttttttctttttaatctagatagtagtctgctgattttgtttatccttttaaagaaacagcttttggtttcattgatcctttttatgaatatttaggagttgatttcgttttctcctttgatttcagttatttattctactagcattggggttagtttgttcttgcttttctagttcctcttggtgtgttactaaattgggaattgcagatcattctaacttactgatgtaggtgcttagcactataagttttcctcataatactgtgtttgctgcatctcagagattttggcatgttggttgtgtctctgttttcatttatttcaaatttttttttgatatctgccttaattttattgtttaccccaaagtcattcaggagtaagttgcttaatttctatgtaatagtgtacttctgagagatcttcttggtattgatttctacttttattccactgtggtctgaaagtatggctggtatgatttcaattttttgaatttattgagacttgctttatctccaagcatatggtcaatcatagagtatgttctgttcacagacgagaagaatgtataatctgtggttgatgggtggaatgttttgtagatgtctattaggtcccattggctaagtgttgaattgaagtctaaaatgtctttgttagttttctgacttgatgatctgtctaatgctctctttggggtgttgaaatccctactagtattgttaaccatctaagtcttttcataggtctagaagtacttgttttatgaatctgggtgctccagtgtttgctatgtatatatttaggatagtttagtattcttgttgcattgaacattttatcattatgtattgcccttctttgacctgttttattgctattggcttaggcagtctggccactccttggcaccattacagtagcttctactggggctatggcagctgatgcctagctgctcagggatccaaggcctgtgcggctccactgggcttaagtggtacccctgcaaagattccaggctggtctctgtgttgatttggagttccactgaggtcaagggcttctcccatgcccaggattgcaaaggtccatggcagatgtttggatcccctgggaactctcactcatcaaccctttcctgacttagggaactttccccaggtctgtactggtcccaggtgggcaagtccttggctttgctcctctcttctctgtgagtcctcttgctttcttgttgaatcccaacatgacatcttagatgatctacttgaagtcgtagcatttactcaccactttgttttctctccatgagagcagcatatactagctacttctagtcagccatcttgagcacctcacctgttttccagattggaaaactgcccatatctggggagctctgcatttttctttagagtgcttcacagatactgcattttttacaaattaaaagttagtggcaactccaattccagcaagtctataggcatcatttttccaagaacatgtgctcactttgtgtttctgtggcacatattggcaattctcacaatatttcaaactttttcattattatatctgtaatagtaatctgtgatcagttctctttgatgttattattgtcattatcttggggcaacatgagctatgtccgtataagatggtgaactttatcaataaatgttgtgtgtgttctgactgtgctagagaccagttgtggggatatgtgagggcagccatgttgccaggcacatgtggggacaagaggaagacaagggaaatcaccatgtttggtggacccagtttctaatggcctttatttgcatattaaagcttgcctgcaggctctaagagccggggctttcctgttagacaagaaacatttctggagctgctttaaaagaaacaaaaacttcccaaggacgccttttcatctctatctgcctaaaataatttcttaataactcctataacaaaaatatactgcaaaagggtcatacctgagaagtctgcttgttgagttgtggtaatttttgcataaatattctagaaatatattgtatgaggtgggaagtggtggtagtgagcagatcgtgagacatcagcttaagtattcattaactacttcaggaaactggagattggaggtctccagtgggaaggagattttcatgaactcagaaaaaatacttcataagggaaagagctaaccaaaaagcaccaaagctggactaagattttcttgcctttctttttccactccattggaggaataagaagcagcagcagtgaggaacaagaaaataaattgttaatagacacattcctttgttccaaactgcagtttcctgaacttaagtcaagcatgagctagggctggggagaagatttaaatctgaagtgatgttgatattttgaaactagttcctaggttaagcttcatataaactaaaagagtaagctcataaggtccacagtggtggacatttttgatgcactaaaatgctcctcaagcaataaagtgagttttcagaaccatgagctttatagcaatcatactgtagccttttcaaagaaaggagcattccagaagaatggctctaacactgttgacttaaggactaactggagcaagccctgcttgttaaaagctgaaaatcttgagctcgtaaacaagtttgaagtcaagtgaacttttaagcagagtgctatgggttgaattatgttccctaaaaattcatgtgttgacagcctaaccacctgttcctaatactgtccttacagaaataatcaagttaaaatgagatattagagtgggccctaattcaatatgttgtgatgttcttataaaagggggaaatcgggaaacacacaggcatactgggagaaggccaaacacacaagagatggccatctgtaagccaagcagagaggcctagaacatattcttccatcacagtgcttgaaagtaatcaaccttgtcaacacttgattttggactcagagcctgcaaaattgtaagacaataaatttatgtttaagctacccagaagctttagttctagaagccctagtaaactaggggggcttgttacatgaagcaagtattcccagctcaaggaggatttactgaatgtggagacttggctgatagggggaactgatgaactcttttaacatgcccaatctgtgccagaatttgaagtgtgaccctaagacaaggctcaaaaatctctgccttctttttggaataaagtttttaggatcactgccacatttattttttaattatctatggcttttttaatcctatcataacaaaaaagaggaattgcagcagagactgtatggcttggaaagcctgaaatatttactttctggctttttacagaaaaagtttgccttgccttgcttaaaacaagggtactggttacagatcctgcctgctgggtattaacagaacaaatgcagcaaatgatgctgatctgaacatgaacccacaggatccccagatcatgacacctctcagtgtttactcagagtagatctggacagtatggattaagaggaagaaattgagacaccttaccccccttttcctccctctaataagatcaggctaaattcaatgcaggaagactttccagggaataagaagcaaaggcactaaaagaaagagttggaaaacaatacctacaagaagagtgaactgcggtcttgaagcattgtgacttaaccaaaattttgggatttactaacaggacatgtgttaatcaagcagttcactttgaaaaggaaagttctagtaagctccacggcctttgtgaaaaggccattgaagtgagagagaaaaccaagaggaccattgagaaactgcaaaaaatgtatgccctaattggcaatacctactttaaagaaaaatgtaataatatcacaatctctacaataaatgttttagcatagcactaaacccacaatatgctaaaaaagttgtcagtagaggagacagaaaataatcctaaagaacaggattgactggtgtacattaatcctgacttgcctttgggaaaaaaaggtaaatacaataaatgcttcagaaaggggaccctctcccacttcataagcattaaatactaaacaagatgtgcaacagaatccacacgacattgagttgtgcaagagtcagcagttggcactgaaggactgggaactatggatgaacccagagctcccatattctcaagggttgtgtagagaaagcacaggagccatgaaaactgtggatataatcccaaaggcactaaacttggactcaagctataaggagattatcagtaatgtccaaaccattgatgtgataaccttttattaaaaaaaaaaaaattaaatagagatggagtctcactatgttgcccatgcttgtcttgaactcctgggctcaagtgatcctcccaattttgcctccaaaagtgccgggattacaggcatgggccactgtgcctggctgacatgataaccttgaggatgggaaatggggaggcatatctaatcctagatccaggaaataatggataccttaaccaagaggaatcttctggcacacatgtgtaaacaatatatacatatattttattggtcaggcttaaaagatgccaatgaaaaacaatatctataaaagggatcaggttgaaatagatggtatgtctttaaaaagtctttaaaggtttaattaagtagtctgaagtaaagaccaacatagtacttaatgattccagtgaaatataaacaagaagcttagtctttttttccctaagatataagagaaaactcagtagtttacaaatgtgattgtaaacttgtgactttctggactacgtcttaagcacatggattggtttgtttgcagtgggttaactgtaggataaaaatcatcaaagtttgatttatatgaataagaagtagatgtagaaaacaatctttgcctatacatgtgttagtactatgtgtacgtgtgtatggatatagaatgaaaaaaaccgcataaatccagtacatctacttaagttatgtaaataattatttgcattttttaaaaaaattgccatgtctacaacacaaattagtaccgtgttagtacttgactaaattctggtaatcttcttatacaattagataggctgatgtatttcctaattaaaaacatttgtttttaactcttttctaatgctttggcaattcatgattggaagtacttgctaatttagatttcctcatggagcacagtaaatatgagagatcctcataatagcctctataggtttaaattatattttaaatgtaaatgcaaaacttaattattttttagaggacctgatgtcatccttgggagtaatttttaattactttttatccttcttagagttgattgtattaattatttgtactggcttaacaataccatactgaaaaagcttttatttttttttttttttttgacatttcttctgtttcagttgatttatcattagtgaataaagatgaaaatgccatctatttcttgggaaattctcttggccttcaaccaaaaatggttaaaacatatcttgaagaagaactagataagtgggccaaaatgtaagtattattttaaaagctactactctacatctcatacaaaaatttacaaaatcacattaggttgtctaatatttggaaagatgtgtaatagaatcctagtacagtcatcccttggcatctgtggaggattagttccagggcctccctatcattccaaaatccacaatggtcaagtcccttatatacaaatggcatcatatttccaaagaacctaggcctatgccatatactttaaataatctctagattacttataatacctaacacagtataaatgtcatgtaaatagctgttatactgtattgtttagggaatagtgacgagaaaaaaagtctgtacatgtttagtatatatgcagccatccatttttttccccaaatatttttgatccgcagttggttgaatccatagagagggaatccatggatacagagaaactttagctgctcagtagtctcatttgattgatgaaataactgaggatcagaataaggtgacatagcaagctagtggcagaatcaggactaaaaacttttacaatatttaaacgtttaagttcctctcatgtgttgacatctctaaaccacatgtaatcattttattttatttctttagtaactaacagaggagttaatattctgaagcttaatttcttcatgattaggctaaattatcaacacttacttttatgataaccagaaatattttctaattatttgaaactgaaaaatcaatatgaagatgagccaaacttgacagttaggaaaacgtttcagaaagatgaaaccaaaccaaatagaatttcagaggaaaaacatttggctgtcatagaaactcagaatacattctttacctttcttcattcttcatgctactggttttcaaattgggaacaatatccattctttaaagtttagtaggccagtcacaatggctcatgcctgtaattgcagcactttgggaggcagaggtgggcagatcacttgaggccaagagtttgagaccagcctggccaacgtggcgaaacctcacctctactaaaaaaatacaaaaattaggccgggaatggtggctcacgcctgtaatcccagcactttgggaagctgacatggatggatctcctaagctcaggagttcgagaccagtctgaccaacatggtgaaacctcgtctctactaaaaatataaaaattagcctggcatggtggcaagtgcctgtaatctcagctattcaggaggctaaggcaagagaattgcttgaacccgggaggcagaggttgcagtgagtggagatcaccactgtactccatcctgggcgactctgcttcaataaaataaataaataaataatgtttagcttacactgtgcaaatgattacaactatggctattagataacactgtgaagttcttaattttagtgattaagaacgtaatttcacaacttgatgtaagaatgatagtttatataatttattaatcatgttataactttatctgcataacttttatgcataatttgcaaaatacataccaccacatttgctctagcaagttttagtatttaatgaatgggggtcatagttaataaaaatggttaatattcatttttggccttaatgtaagagagggcagataattagattgaatgaatttgaactttatagagtgtccttgcctcttggatattcattcagcaaggttgtgaatttttatcccctaagcatttaaaatatattctgccctgctattctattcatatccttatggtcatccacttaagtaagaaaccggttgattattttcaagactttaaagttgcatttcaggaaagcacctcatgctcttctattgttttgtcttttatatttcaccttgtgatgatggaaaatttcatcattttaattaaaccttcttactgagttttcattagacagatgattcagaaaggctgtatattttaatgcttcaggcaatgtacagtgaattaaagaagacttctaagcaaatggacatctattccatcctcgctttgtttattttagtcttcttgttttaagctgtagtgactcagtcaacatcatggacccgcccataaatgtctgtggtgtttgggatgcctgatcacctgcctctttttcctacctcacccatcgtttttgatcccaaaagtgtttgctcattattattttttacctcccaaatatttagcttaaaatcccacttctgatgttttccagctgaagttctgttgggaggaaactttttctctaccaaatgagtacttaggtcaaagtgattgagggcctgccaattaattgacaacagacaggttaacaggagaaaagtttatttcacactcagatacaagaattctacaaggggtagtttgatgaacagccatgggtaagggtttatataccagcttgactaaagggaagagttttagagcttcagtgggaaaatatgaaagtttctattgggttttttcatcatgatgctaatgggcagtatccttcctagctggaagctcccaagagggagatgaatggcagctgaatttgtacctccaggtgctaaggtccatctacctctgaggatgggtcagtagcagctgtatttttaggaggctttgcttaagtttagataaatttctttctgtggctgctctttgttcagatgtgttcaaagtagtcagaccaggcatagtggctcatggctgtattcccagcactttgggaggccaatgtgggtcactttagcccaggaattaaaaccagcctgagcaacaaagagatggatgcagtggctaccatctgtaatcccagcactttgggaggctgaggcaagcggaccacaaaagcccagtagttccagaccaacctgggcaacattgtgagatctcaactctacaaaaaaatacaaaaattagctgggcatggtggtgcatgcctgtagtccaagccacttgagaggctgaggtgagaggatcatttgcacccagaaggtcaaggctgcagtaagctgtgattgtgccactgtactccagcctgggctacagcaagaccatgtctttaaatacatacatacatacatacatacatacatacatacatacatacatacatgtagtcttcatgccacttcagtggtctgttggtctcttcagttttcattctcactgttgccttgtttttttgtactaaaatcaaaccctgcatgtgttcagttgcctctacatccagggcctcccattattgtggtaaattttatctgatcacttcttcctctttgcctccctctatgccacttctgctctacttcttggttgatactcaagccaggtcagtgactccctttcttcttgaccaatggaagattatgggaatcactgagtcaaagaggattacacacttattaaatactacaatgcacattgaaagtagttgcttagttgaaaaagataatgttaaaaatgtataatcttgaccaggcgtggtggttcaaggctgtaaccccaggactttgggaggccaaggcaggcagatcacttgagttcaggagtttgagaccagcttgggcaacatggtaaaaccctgtctctacaaaatatacaaaagaaatttagctggatgtagtggcacatgcctgtagtcccagctattcgtgaggttgaggtgggaggatcgcttgagcctggaatgtgggggtttgcagtgagctgagattgtgacactgcactccagcctgggcagcagagtcagacccagtctcaaaaaaaattataatcttaacagtaacataaaaattagagtgcttcaacaaagcaagattttacacaggcatatagatgtcaaatctctgtctatccaagtattgtaaagtaggaaatgccatttggctcacggattccatcttctccagttttatggcctattgcagacatattgcctaccacacctaagtattgaataaatgattttttgtcataatgcagcctgattttgtaattcataaggctaccatctttgatttcttatactaaggaaaagccaagaatagaggtacaactagaaatattttaggatctgtcttggtttgttcccgctgctatacaaaatacctgagtctggataatttatagagaagagaaatgaatattcttacaattctggaggctgggaagtccaagatcaaggtgctggctgacttagtgtctggtaaggtctgctctctgcttccaagatggtgcttcttgctgtaacctcatgtggcagaagaggcaaacacctgcctcccacctgttttacaagggtactaatcccattcatgagggctctgcccttatgactgaatcacctcctaaagactctacctcttaatactgtcacattggcagatcaaattttaacataagaatttgaaggggacacattcagatgatagtagaaccaaatgatttctaaaacttacacttatttaaggaaaactgtgaaaatagttttcttagaatcttttacctctgtgttagttttaaaattctattaccattaatttgcattttcattttcaactctatgggatttctaaagtagattaataacacattgaagaatatatttgttttgcaaaatggcaatatttaggcaattccagtattctgaaatataaaactttttgggtgattatatttatttgatacttaataattataagtaaaaaggttttgtaacaagaagaagcaacaatatgcctgaagcctatgggtctgttggaatgagtaggcaataggcatgaagtatttgggaataatagtttatattaaatatttactaatgacctggattatttaatgaagaataacattggttaataatcataatgccacaattcagctagaacagaaggatatatcagtcctaaagagcatattgtaagctgggagatgggtattatgttcctaaaatagaatcacaatattttaggtcatttacattgtcaaatctgctacataaagggtgttctctctttttcataagagcaaaaacctactacagttttgtctctacagggattcttctaagaactgtgacagtttaggtaagattatttaaagacaaaaatgtccctttgaattaaatatcaggaataaaccacagagtttactttacatggcagtgtgtgtgtgctgacaggacactgataaaacatgccagagagatgtagatgcctccttcagacccctctagtctcatttaatttaaggatttcttccattaaaagcaatagtgtttgaataagagagcactaagaaaatacatagaatggcatgttacaaagatttttcacaacatctttgtttttgtttttctaattaacattctttttttggagtcagggtgtcactctgttgcccaggctggagtgcagtggcgtgatcatagctcactgcagccttaaacacttgggcccaggctatcctcccacctcagtctcctgagtagctacgactataggtacatgccaccaagcctggttaattttttctttaattttgtagagacgacgtctccctatgttgcccaggctggtctcaaacacctggtctcaagggatcaacccaccttggactcccaaaatgctgggattacaggcgtgagccaccgtccctggcctctcaacatctttattggctaatcatcaattggatcatggaaaaaaaattataatgtaatgaaggcagcccatgaaattgtaattatttacttatggaaggaagctttctaaaaacagggccatttttcactttgtgggatggttacagcatggtcctactttaaagaggatccaggtttctattaacttcctaattttacatcctgcaattctaattttgtgagtaaatactcctagtagatgtctcagaaaacacccacttatagcaatgatttattctgtggcagtgagttaactctctcccatgctctcttttcctttccagcatttgtaaaagaagattacatctatgctgcgactattttaagtagctttgtttgaacaatatattttttcttaactttaatactgatgtttataacggcactttaatctacatcaactctttctaatgacaggccactttactttgggtttatttgggtaacactttctaaatacatttcactaccccaggctagtgggctaacaaaatgaagaagcagactctgtgtggtattttaaagggagggagatgccaaaagcattgcaggaagaaacacatccttaaagattattaccacggtgtctaccagagtaaggagtaggtggcataacattctgagatataaattctctgaggcagaacatagaattttactacctaaatgtaataagatgtattgtgctatcagcaaaggccatggagctctatgtgatgaaaataaaaaaggatccaagtatcttcctttaactaccatttaatgataatgatttttgtctttagcatttatattagaaatcaagaaagaggcaagctgcaggctatctaataataatacaaataataataactaacaattgcccctctcttccatccttagttcttagcagcctatgtttattctcaaagaaagtcctcttccttcatcttagtttatatggtaatagaaatgttagtttaaaaattgtgttctacaccacatgctgatgaaggtagttttagcattagatttacattaggaaagaagactcagaaacagggtactatgtaaccgtctctttcacatgttatctcatttatttctcatgggaatcctttaaggtccatattgttacccatttacttgtacaaatgtggaaaatgaagccctatagcttccaataaatgtggtctcatgaccagtactgacctggagctggcttataccagatgtcaaaagccaattattaaatactcagaatttctgttggtagtatgaaatcacccatgatgggagtatttataccttggaaatctgcaaaggaggaaaaacagtgctctagtcctctggtcttaccaccccttttagggagtaccagcccaccagcaccagtttactgacacagattcaacccaggttggtactatacaaaaagcacattttcattcctttctttcaagatgacaaacttttggattcctaaagaattaagaactgttacccagaaaaaatgggttttattcttttggtgagtaacaaaggtctttctggagacatggatgatgctggaaacatcattctcagctaactaacacaggaacagaaaaccaagcaccgcatgttctcacccataagtgggagttgaacaatgagaacacatggaatcagggaggggaacatcacacactggggcctgtggggggtgaggggctaagggagggagagcattaggagaaatacctaatgtaggtgacgggttgatgggtgcagcaaaccaccatggcacatgtatacttatgcaacaaacctgcacgttctgcacatgtatcccagaacttaaagtataataaaaaaaaaagtcagaggaatatatagcaggctcaaatatttatctttttaattgtgaaatcatctttgcaatatttattatgaaataagttttaaaatattgcataattctaaaatatgatttaaaataaattatttctctgtagtaaaaaaaaatagagcaggttttgatcaatagaagtttgattacttggcataagtaaggaggacactgggagttttcacaaaagcagtgtctcccagaggaaaagtgacagggaagttttatggggtgatagggaagaaggtgcatcatctcatgtagaggaagagttccagttgcggagatgcagtgagtaatcacaccagtgcgtagatcgcatcttatggtaatgaagctatagctcctccccagggtggagactttagcatggtaatgaggaaatttcacacagactcgtctatgagttgctggggtctgtcagaagcttgccctaaccaacaaggtgacagcattacacaccaggcttgggaaaaaaacaagtgatagggcaggaggctgtaaaacaggctgatggttcaactttattaaatgttataatccctggagacccccctgcctgcttacagaactatcacattcagggcatcataagatacaacaatgtaacagcactcagaggcgcttcatcttaatcctctgttttaatttcttctatgtttttcaagtgtatttgccttcttcatttcatggaaatttcttgaaagttgaagtactctatgtattttgcatttttctactatgcctcctgggatacttactagaataataaaattgagctggaatgtgacagatgaaattgctagcaaatatgtcaaaccaagtagtattggctttgattattcataaattttgttatttacctataaaatggtatcatgagtataatcacattttatacacttctattaaatttacagattatagctatatttcaatttataatcattttagtctctagccttacaaaatagtatggaagttttagtatagatactacattctacaggtataaaagtagtgttcaaataatcttaaaaattgcaaaataactgagaccaaaaaaattagactctagaatatagcaaaatattaaaataacatatgaacaatctcccccattcctcacaaaaagaaaataaaagaaatttaaaaagagaagttaaaagacattaatcccaagtattatatattttgttttaaaaaggcctgattttatataattactaacacatagaaaggtccacatagaaatgtttatttgctaaagctgatatttgaaataatcacacacatgcacataaaagctaagatatgtttatgtccgttttcaatttcagagcagcctatggtcatgaagtggggaagcgtccttggattacaggagatgagagtattgtaggccttatgaaggacattgtaggtaagtacaaaacactgaagtttttccaaatgaattgtaaagatgttatcatttagttataaacacaggctcataaagtcaaaatcttattgaagaacatagtgattttctattttaatctataatagtaaaaaggaagtacactttcaacttaaatttgttaactcaaagattgctatggtgagcataacaaggttatttatataaaaataaaatatatgttatttttttctgtcatactttaaatgtaatatttatcacacatgaaaaacacatacattgtattaatttataattgaatacatttcataaaaatcaactgaaatgaattttctataatttaactatttgatataatgaacattttcacatgctaaaggtgtaaaacaccaatcatgtttttgctcatttcaatttaatctttggtgatctatttaaattttagcttcatgttactgaaaatgacatagctgatgctgtttttagtctaaaatgtgctatcctaaagagagttatatatactatcggtggtatttaagatagttttagatggtaaatgtgttaacattttgaaaaaatttatttaattggcttaaatattcagcattgtttaaaatttaaggtactgaacaaaaaaattaatgatattttggtaattggagtggtgctatttggaactattttaaggacttagggaaaactcaagttttcaaatcctttttgaaagcttattctcttataagcaaacataaaaatatctttattgcttcattccatttgaatcttgaccagtaattagagagaaaatcaacgtggctggaagggaaatggagtggggaaagctggacttatgcatagaaaaaactatggcaactggcaaatcattaaaatctggagactatcttgtttatttaaaaagtaattattgattttttgctatatgtcatgacttgtgggagctctgaggacataaaagtgaataagggctgggcatagtgacacacacctataatcccagcactttgacagtctgaggtgggtggattgcttgagctcaggagttcgagaccagcctggccaacatggtgagatcccatctctacaaaaaaattttaaaaattagccaagcatgctggcacacccgtagtcccagatacttgagaggctgaggtgggaggttagcttgagcctgggaggttgaggctgcagtgagcccaaatcgtgccactgttgttcagcctggacgacagggtgacaccctgtctcaaaaaaaaaaaaaaaaaacaaaaaacgaacaacactcaccttccttatcctcatagactgccagtaaaggaagatgcaaataaatccaaaattaatgtacatacataagtaaaatacaaagaaatataaaattaatcacactaccaaagaggcataattttccagttgatttaggactgaacacatgcatgtaactactcttttttctaaaacctcaccaaagaattctgaatggaatagaaaaaaaaattacaaagtctaaactgcagaggacaaaatagaatgccaaaggagatgataataatatctggggagttggctcgctgatagacaagtggtaattgcctttctcaaaaaaaaaaaaaaaaaaaaaaaagtaaaccaaatcctaatctcccaatggcaaaaaaataaaaagccagctgctttaccctgctaatcacctgaccatgaaaagagccaaattctgtaaaatatttgaagagtaaatttttctgtaaaatattctgagccaaatatgagtggtcatgacccaaggcacagtctcaagaggtcctaagaacatgtgcccaaggtggttgggttgacaaaagacatcaatctacacatgtgaagtatccataggtttgggggagaggaggggacaggcgcacaggtgggaagtgtagtagtttataggtcataggattatagatggagtcaaagattttctgattggcaatttattgaaagagttaagttattatctaaaaacctggaatcaatagaaaggagtgtctggaggaagataaggggtgatgaaaaccaaggttcttattatgtagataaagtctcataggtggctgcccttacagacaatagatggcaattgtttcccattcatacctgtaaagggttctagtctctcagttcatctcttcaggattggaagggactgaaaagggaaagatttggttatattcttcatattcttgacagatgtaaattttccctcacaacagaaggctttgtagggccactcaaagtatgtcaaagagacatattttggggtaaaatattttgattttcttctttatctgtcatttgatgttacgccagagtaaggttggaaagtaagcttgtcatataggataaaataaaacccatctggtgagattttatggtttgtaggatgttattccccaggcctcttaggaatttgggcaagacagaaaaaaggtcagagtttagtcctcacacctccagaaggtagtgatgaaaatatgaatttttaaaaaagaagatttgttgaaattctgtttaaaatacaattagaatatcagatccccttgccaacttgatgctgcaggtgaatactcccacaccccatttcaggagatgactagaggattaatttccagaaaagggaggagaaagggtctccagactgccatgacaaacaccacagactgggtggcttaaacaatataagtttattttttcgcagtactggaggctagaaattcatgatcaaggtgcaaagtgctgtcagggttggtttctagtaagggttctcctcctggcttctcctcttggctgccttttcactatgtcctcacatggcctttcttttgtgtactggaggaaacagttctctggtgtctctcacacgtcttataaggacacctaaggataccagctctaccatatcaagccctcacccttatgactgcacttaaccttaattactaatttgtaggcctatccccaaatacactcacattggagattagggctttaacatatgaatttggggccaccaactcaattaataatatataccatagttgtaaggtttctgtatcggtttgaaccccgagagcacgtcaatagacaacacgaggtggtgtggagcaacatgctgttttaatgagcgcctgggtgcaggcgggctgaggcctaaaatggcatcagcaccaagtgaggacaagacaaaggttttatagtctcctgtaaacaggaagtgttctagtctgacataactgctgcgttgtacctggatggcctctttctcgatcttcagggttacgtgtcttccggccagggtagctgtctttcggtcggctctcttcctgcttctgatatcttgctggcgcacgccgctgacgtaagtagccttgcgccttcgtactgggcctgagaaggaaggagttattcatctccttaagctttcaggcctcagggagaatcgtacattcccgtctatttggttgtagataaaagggataaggggcctctttctcaataactacttcacgtgtgatatagggggtggtgtgggcaccttggaaaaacaaaaccttaattttttgggtattcttgagagacgggttggtatccacattgtccttgtagtaggagcatcatctgtattgtctggaaacgcgtctgtgcctgcaagacagttatgttgagaggacaaggaggtgtcaacagggagaggtatagcctcatttgctgcttcacgaatgaaagactgtgtctggattaaggaggggaggtaatttctgagtgggttagagtttggtaagggtggaggccctaagataaaagttcggccatacatgattttaaagggactataaaaagaggctgcttttggtgttgtgtggagtctcatgagggcaaaagggagattttttgtccacgactggtgggtttttagagccagcttcgtgagttgcgctttaagtacagatttagttttttcaactttgcctgaagattgaggcctgtagggtgtgtggggaacctacttcatatttagagatgtagagacaccttgaataatttggctgatgaaggccggcctgttattgggctggatggatgttcagagtacgaaatggggaattatatgcatgatgagagtttgtgtgacgacatttgcaccttctgaagttgttgggaacatttttacttacctggagaaagtatggacaaagactagaagatagcagagcggcatgtgagtgaggtttacttgccattcttgccttggtacctggccccaggcttggtcggtaggaaaaggtagcggccagagggagccttggggtgacactgagtggcagatagagccagactgggtaatttctcagacatggctggaaaggtgaggacaagtgagaatagggtggaaaagttgcaagagaggtttgtaaccgacatggaaagagttgtggagtctttggaggtgaggaagattttgagagtgaggaagaacaaagcacctttccttgacataccatggtccttgcttttgaaggttttgggctcagaagtcctgcttttcttctgaggagtaaagaggagagaacaaggacagggagagaaactggccttgcacggatcatagggctatttgtttcactacctgatctgttagcgcatttccagccgatatgtgattgtctggggtttggtggcccctgcaatgaatgatggcaactttctgcaggagcctgatagcttgaaggagtttgttgatgagagagccatttatgacaggagtgttttttgcagctaggaaaccccgttttttccaggtagacgagtgtgactgtactatatggaacgtataatgaatgacaaattgaatatatgttaatttgttgtccggctgtcagtgtgagagcttgagtgagggcaatgagttcagcttttgggaggtagtgcctaggggcagtggattggcttcaatagtatgtgggggcggggggcgggggacactatagcatagccagcatgccggcgtccttgctgtaagaaggagctgccgtctacaaaccaagtaaagaaggggttcatctgttagatttggaaaaggtataagaaaggtttgaacagtgttcacacagaagtgtttagggtctttggcggttgtagcttcaggtaagagcatggctgggtttagatgggagctggttagcatagtgatttggggggtttctatgaatagagcatacagttggaggagtcatggggcagagatgagactagtacactgcagtgagttggcatgtctttgatgttatgggttgaataaactgttaggttggcatggagagatagttttaggcttttaagggttaggacagcagctgccgccaatggtcggaggcaggcaggccatccaagaactgaggctttaagctgtttagagaggtaggcaataacctgaagggtgggtcctttagactgggttagaacacctagtgtaactctatgctgttggtcagtatagagggagaaaggtttggtgaggtctgggagagtgaggacagggctgaggtgagagccttccagagtagacggaaaggttgggtaataggctgtgcagatttttaaggctcatggagtggggctttagcagcttggtataatggtttggcaagtagagcgaaggagggaacctagagcctaaaacatcccactaatcctagaaaagagagagaattttttgcttagtttgcagaggcaggagggattggaggagagatatgcagtcagctgtgagcccttgggttcacggggtaagagctagccctagataggtgactaagggggtgcataattgtgctttcttagaggagacctaataccctcgttttgtcaagaagtttaaaagagagagatagtgtgggtgttgcagtgtttttgagaggggctacacaggagcagattattaacacattgaaggagagtggatggttttagggatagggtactgaggtcaagagcaagggcctgtccaaaaagatgggggctgtctctgaaaccttgaggtagtatgcaccaggtgagctgatgtgaaagtttggagttggggttttcccatgtaaaggcaaagaggttttgggaatcaaggtgtaaaggaattgtggggaaaaaaaagcatcttttaggtttagaacagaaaaatgggtggtattagacagaattacggaaagtaaagtatatgggttaggaactactagacatactgggagtacagcttggttaatgagcctgaggtcctggattaagcgataagtttcatctggctttttgacaggtagaactggtttgttaaaaggggagtttgttgggtggagtaggcgactggtgaggaggcgaaaatgataggctttaggcctatgcgagttgcttgggagatgggatactgcttctgtgataggaactgggtgggctttttaagggcaatgtggatgggggtgtggtgttttgtgactgagggtgtggaagtgtcctaaacagaggggttaactacggatgggggataaggaaaagttgcatgttttaaggtggcaggttggaggagtagaagaaagttagaagccccagaggggtctgggttggtgcgttgggtactatggggaacatggaagtgaagagtagtgtggagctttgaaaggagtggagtttggcatgagggtaggactaagaaagtgagtgaaggaaaaggtgtatagggagcagaaaagtggaggggtggcttggggtttggagacttgtctattaatttctacaatagagacttgggagaactcagtgggtcctgaaaaattaggtaaagcagtgtaggttgccctggtattaattaaaaaacatactggcctacctgccaccatcagggttacccttggctcggatgaagagatggtagttgccagggtgtccatttcagggcaccgtcactcttcagtggcaaggccgatgagatcctaataggaggttttggccagcttcggaagggatgggggcggtccttgtggggtccgctgacagtccaacctccggtggggtcctccgcaaagggggcatggcctggtgggcttacctgggtttgggcattgtctggaccagtagccttcattgccacacttgaaacaggcgccaggtggaggtggattgctaggaggcttccctgttgagctgcagccctgcgggcctggtggaggtaagcatttgagactacctgtgttttgcctttcattttcctcatcacgattgttaaagactttgaaggctaaattaagaaggtctccatgtggggtttgagggccgtcatcaagcttctgaagtttgcgtggaatattgggggtggactgggaggtgaaccaaaggtttaagatagtggttccttttcagctggctgagtttaggttggtgtattttcttatgacttcagttaaacaagagagaaaaagggctggttttcgtcaggaccctgggtgatttctgaaagtttttcatagtttactactctatgggcaccctttttgagtcctgcaaggagacacacaatcatgtggtcttgatggtggcatccagaggccccatcttgataataccagtgggggtcctgattgggaactgcctctgcgccagtaggctgggcaggagtttggtgatgaattgtatcagcctgcgcctgagctagggtccagatatggtcttagtcttctggggtgagggtggaagagaataatgtagaggtcatgccaggttagtttataagactgggtaaggtactgaaactccctaatataagaggtggggtcttctggaaatgaaccgagtcttttgttaatttgagacagatcagtgagggagaagggaacatgaactctagtaataccttcagttcctgctacttcctgaagtaagggtgggtcataggctaaagatggcatctgaaggagtatgggccggagggaaggaaaaagccggaagtggttcctgctgagggtatgaagggggaagggagttgagttgataagcagtggaggatacatacgggcgtaaggtggcaggatgggtttataggcttcaggagagggcgatgaggaaggagaatgagtacaggcaatgctagaattgtcctgatgggacggtgtaggaaaagaagtggatacagctgactgggaaggtggtggctgagaagatgatgactgagaagacaacgaacgggttaaagaaggcgattgagagaaagaggtagtggctgggaggcatggacagcagtctgctggattgaatgaggaaaaagaggtagggttgggaggagaaaggtgatctggatagcaagaatggaagagaaggatttgaacaggtaaacaagaattgtagaggtcgggctgtgatctgagtgcaaaaaacgcctggacatacagaatttctccccatttctccagtcattggcaataattgcttaagttcgttaaaattataaagtcaaatgttttatttgagggccatttagatgcattgtttaatttgtactgcatccaggctatattgtaaaaaaagacggggcacttagggtggatatcttgtctgaggcctaaggtttgcagggttcttttatgaggcagcctagagggctgttttttggaatagaggaccaagaatttcccataacggagggtaggcatgggagaacagagaaaaaggagaccgtcctggacagctggagggagacgataaaaggagtgatcgtcactgctgcctttttcgttcccggaatgggatcagttggcttagaggtgtcccctaagaacagatgatcagcaactgcctggcacacaccagagccttcttggaccaacgctggatttttggaccggagaaaccaagagaggccatgtagatttttccctgttgacagagctcccaggaaacttactggtaggtgagatcagtgactaatgtgcatgcagaggggtgactggaggctgaggagtttcctttgtctggctgctgtggcctactctctggggtggaggggtaggcccaaggaggacgcagacttgagcccctcccaggttttggcaccagaacgtaaaatttttgtattggtttgaaacccaagagcgcaacagacaagatgaggtggtgtggagcaacatgctgttttaatgagcgcctgggtgcaggtgggctgaggctgaaaatggcatcagcaccaagtgaggacgggataaaggttttatagtctcctgtaaacaggaagtgttctagtctgtcgtaactgctatgttgtacctggatggcctctttctcgatcttcaggagtatgtgtcttccaaccagggtagctatcttctggccagctctcttcctgcttctgctattttgctggtgtaccctgctgatatatgtggccttgcaccttggtactgggcctgagaagggaggagttactcatcttaaactttcaggccccaggaagaatcttacaatagtgaaaaaaaaagcattaaataaatgtttatccacttgcactcttatttagctaccagtccccacacaggaggctggacaagtctactctgttatctgcacaacctaaagagtctgacatgagggcatttcccagcacgatgggcaaatgggatcaccttacaacaaaccccatcacgtgcagaacacactgttaaaaaaaaaaatcatgagccaaactaaatttaacggagtttaattgagcaaagaacaaatcatgagtcaggcagcctctcaagccagagtaggttcacagactccagcacaggcatgtggttggaagatttgtggacagagaaagtaaagtgatgtacagaaaatggaagtgaggtacagaaacagcctgattgggtacagcccagcatttaccttaatttaacatggtttgaacagttggtctcctttgattggccaaaatgtggtgattagcacaagagtaggttacagtctgcttatgcctccatttaggtaacagttcatgattttcagagaaagctttaggctggacttaaaatatgtaaggaggcaagtttaggctaaagttaatttaacaatctccctttttggtcatcttctcaattttgagagattgaccaaaactttagtcattgatgtaactatcaccatcataaatgtccttatttggtttcaaaacccaccggaaaatagcataatagtggattttgtaagataggaacaaggacttcggtaatttttttttacgggttagagtagagggtacctcctcatgctggaatatcctgtttacaggagaaaaacaaaacctagtctgttctaggatatatctgtttccttgaagtcttattttttattatgtcacatttatcataagtgactgctttttggtttggtctggtctgtggggtcctagtgcatgagctcactccaaaacagtatcctcccataattttgtttaaatctgttaaaagaaaatccttaaccaaattaaatttatccgagtataattgagcaaagaacgattgacaaattgggctgcctcccaagccataatagactcagagatactccaccgcagccacgtggtggaagaagatttatggacagaaaaaggaaagtgacatacagagaagggaagtgaggtacagaaacagccaggttgtttacagctcagcatttgccttatttgagcagggtttgaacagtttctcttctttggccaaaatgcggtgattagcactggagcaggttacagtttgtttacatctccatttaggttatagttcactatgcacagagaaacctttaagccaaacttgaaatatgtaagtagatagctttaggctaaacttgattcaacaacactcatgtttattatacccaaattacaaaacttttcatgaaaatctatttttatacatccatgttgtgtggaaaattttttaaaaaaagaaaaaagaaatctgtttttagtttatgaccatatgaatatgttaacctattaaattttttttaataactttatagggggccaggcatagtggctcacacctgtagttccaacactgagaggccaaagcgagaggatcacttaagcccaggagttcaagaccagttgaggcaaaatagtgagaccccgtctctacaaaataaataaataaataaataagtaaaataaataagagaagaaagaaaaattagtggggtgtgggtggctcatacctgtagtttgagctactttttaggctgaggcaggagctcaggaggtggaggctgcaatgagccatgattgcaccattgtactccagcctgggtgacagactaagaccctgtctcaaacaaaacaaaacaaaacaaacccctcaaacctcaatagaagagttgtaaacaaaagcaaactcaagttcctaccaattattattaatcattacattatacaaatttctattggttttgtgcgactatgttgtagatcagaatatcaacttctagtttaagataacagattgagtctgagagtggtggctcatgcctgtaatcccagcactttgggaggctgaagcgggcagatcacaaggtcaggagttcgagaccagccttaccaacatggtgaaacgctgtctctactaaaaatacaaaaattagccgggcattgtggcacgtgtctgaaatcccagctactcaggaggctgaggcaggagaatcgcttgaacctgggaggtggaggttgcagtgagctgagattgtgccactgcactccagcctggtgacagagcgagactccatctcacaaaaaaaaaaaaaaaaaaaagaaaaaagaaaaagaaaagataacagattgagtacagaccgaaaattctccgttctatgacaaataccgaggagtgactgaaaaaaaaattaacaaacatatagcaacagttaaaaataagtaaatagaaatctgcatagaccagaaatttacaactattattgaagaaaagaacagtaagaaaccagaaagtagtattttgggggcagctcacgtggagtcaggctcagtgtaggacttgagtgaaagactttcccaagaagccccagggctaatctgggcagccctggatgcttaggtctggaacccagggccagaatctttgacagccagatccagtaaaggccaaaaccaagaatctcctcccacaccagtggattctcaaaacacagtgcacttgatcaggctgtcagaattacctagagcagtgcatattctgatggagagaattctctgaacaatcctgaattgcatttaaaagtgtgcgaaatatttgtgtaataaatccttcgtttgtgttcatttgttagaagccaattctaaacattcaaatattctaatatgtaaacaaaaaaactggaaaaagaatttgcatttaatttgaccggagaatatgtgcttctcttagctgtgaattttttttcactttattcagtttgctttcagaacataaactgcattctaatcctgttattttgttcttaatatttatcatcctctaaagagaagttagaatgtttatatagaagccagggaagtggtaaagtgatattattcagtgagatttatttatgaagccaataaatcctgcaaaaagatgtcctttgaccatttaaaagtttacagctctattgcaacttattaaatgtccaagagccttgttgacacataaatacatgtatgacacataaagatcactgaaatttcaaacctgtcacctttcattattgttactaaggaaaaacaaaaaataagagaaagactataaatattcagtcttgtttagaaaactaaagggattaagcttattttaaatttttaaaagaaaatttgtcaaccatagctgtaggggttttctgcctgtctttgaaaaaccacacagtaatataatttatattctggcccacaagactgccgccacttcagatgccagtcaaaaatcctagaaaccacccttactttagacgcaccagctgtaaattcagggatttccacagtgccctttgcaggctccataatttgctagagcaatttcagaactttactttcactttactttatgtttgccagtttactataaagatacaactcagaaacagccaatggaagagatgcatagggcatggaaatgagggagcttccatgccttctctgagcctgccactctcttggtacttaaatgtgttcatcagcccagaacctctctgagtcttactgtttttataaagctcaatcccagccctcctctccctctgggaggtcagtgggtagagctaaaagtttcacctctactccctctgatcacttggtctttttgatgggcagccccccatagtgagatgtctctcagggccccaacttaagtcactttattagcatcaactctcctgtgatctaagggagcttgttatgaataacaaaaaatacttttaccacttggaatatccaagggttttagcagccctgtaccctgaactgagaacaaaaaccaaatatttcttgttataacacacctatgggacaaaattcatttagttttctacatttttgtctttgaatgctgcattagttaaattagatgtgtttggtcccaaaatataatgtgggatatagaagataacaattatttcttaaaatgggcaaagtgagttttgtagacctgaaacttcgtaaagaaaatatttataactttcccaaagcctcaaaccttatatgacaaatgcattgtcacattttatttgaagtcttttcagtggtctgggttgtaaatcagagttaggaagggtgtgatagctcctatggttagggagtttagagccacaggaatttaagagatttgccatgctgaatgggccctgaacccacgacctgacccgtaggtaatttagtttcctaaaccattggatccatctttatcgataaaggagcatctgtttcggtctttcagatcatactattagctccaaaattttttaacttccaaaattaaatacatattagtcagagaaatggtccttacttaagtcaaattgaaaaaatgaataaacgaggcacagtggctcacgcctgtaatcccaacactttgggaaggtaaggaaggagaatttcttgagcccaggagttcaagaccagtctgggcaacatggtgaaactccgcctctgcaagaaatacagatatacaaaaattacccaggcatggtggtacattcctgtagtcccagctattcgaaaggctgaggtgagagagttgctggaacctgggagtttgaggctacagtgagccatgatcatgctgctgcactacatcctgggtgacagaaaaaaaaaaaaaagaaaaaaaaaaaagaaaaatgtgtaacttcactcaaatagactcttttagaatgtgtttttttgtgtgtgttcattttgtttgcaaaccccatgcagcttcccgttttgccttggttactaagaagttctgagaaaaatttgatcaagtttgaagtaacaaaaatatttaataaattctaatttgtttctcatctgcatttattgtgttgctactttctatcattcttcctcaaatagttttgtattacaatttatctgaaaccctctttggaagtaagtgtggtttaaatgatgaaataattaaaataattttgtagtaactgcagtaaagagtagcaaaggccaaatttattttttctacttgctagggttactagcagcaaatccatatgggtctgcagcaacctcggtttttgcctctttagaagaaataattcaactgaggggcgtaaggcaggagagatcaaggcaaattttagagcaggagtgaaagtttattaaaaagttttagagcaggaatgaaaagaagtaaagtatacttgaaagggccaagtgggcaacttgagagatcaagtgcatggtttgacctttgactttgggttttgtattttggcatgcttctggaggcttgtgtcccttctcccctgattcttcccttgggatgggctgtcctcatgcacattggcctggtagcacttgggaggggctgcatgtgcagtgtgtttactggagatatgtgcatactcacttgaggcattcttcccttaccagctgaatgtccctagaaggtcacataagagacattaaaaattggccattttgcctcttaatgtacatgcttgagcccactcacccaaatcctgagatattgggaaactgctgatcacgagtttcaggtttttttctatcttttgggagactgtctttccctggcactggctgcaaccaattattattttagagagacagttaacaactgcctgaccatcacctgacattcctggtgatgggaaggagatgcctgccctgctcatgtctgcctgactacctactgtaacaccaggttgtctaaatgtgccatgagcaaacagacaagttgtatattttgggtcgtgattgagtcttccaggttcttaaaaccacagcctttaatttaccataaaaaattttaaaaagaagttaccaggaggataataaaaattattatgtgtacaaattgatagtgtggatagagaagagaaagaaataataaccatatttattcatagaagtagaaaaaattcaatttcagatgagaagaaaaactgttaatgaaacattttatagagagccaataattcttcaaaacatggaataactttcccttataattaatgtcatattatcaagatggtagaaataaaattgctgaagaatattattaatattattattaagcttacttctccctggatagataaaaatcacacagcgttagctacatgcattcaaggttataaaaatggtgtaatgtgaacataaatttgctttatgaaatccgtggctgaccctcagagaagcaataatccctggaagctatccccccacagctgcagaccctcagtcatgtaccagccacctctaaaggctgctgaaatttgttacttgaaaaatggaatgtaaagttcttggacttagcctaattacaaaccttacagccaaatccacaataacatttgcatctgcttaataaaatatacagaacattgtatggcagttatgagacccgtaatgaaccctcttatccaatggtaaacagcttggggccttgtcatccccactttgcaagagatttgaaattatgttaggattaaaaagacacagagggaagttggttaagatcctcagtctcaagtcaaatacacagagtattttctgtaaacaatgctttaaccctgaaagaacattcttattttatttttcttctacaagacttttggtcagttagttcatctctttgcacatcagtttcctcgttatgaaatgaagagaattagagtaggtaccttattgagttgctatgcatgctgaaataatacaagtcacataattagaagtgctgaaatacttaatggatccataaacattagcttgccagtctttgagaccagaatgcagttgcttgcatttaactaagttttatcttctggtaaagcaaaaatatgatgttcaataaataaataaacaaggaataaataagcagagaagcactctttggattagagcactggctcacactcatctcagaagtgatttaaatcttgacatttattgcagtgagtcatagatgatctgataaagtaaagatcctttcaaaacctgctaagctctccagaagcattttaaaaattttgccccaacataactggagctcttgatgtttccacattaattcaaaataattaggaaaaagtaaaggaatgaagaaaaacaacttgaataaactttggttaacttttaaaaaaaaaagattgttagtgaaatgatgatattgaaacatcttaggacaatattggtttcagaaatctaatttgaaccaaaaaagataggccaattaggtaaataatcttttgaaaatacagacatacctcaaagatattgtggcttggttccaggttgctgcagtaatgcaaatattgtaatcaagtgaatcacacacatttttggttaaacagtacatacaaaagttatgtttacactatactgtagtctattaagtatgcaatagcattgcatctaaaaagcaatgtggataccttaattaaaaaaatactttattgctaaataatgctaacaatcatctgaaccttcagtgagctgtaatctttttgctgatgtgggttgtcttgcctctatattaatggctgctgaccaattgggatggtgttacctgaatgctggagtggctgtggcaatttcttaaaataagatagcaatcacgtttgccatgttaattgagtcttcctttcatggaagaaatctctgtagcttgtgatgctatttgatagtattttactcacagtagaactttcaaaatttgaagcaatcctctgaaatcctgccactgctttatcaattaagttaatgaaacattttaatcctttgttgtcatttcaacaatgttcacagcatcttcaccatcttcaaaatcttaaccatttttctttgcactttcgtaagaggcaacccctcatctgttgaagttttattatgagattgcaacaattcagtcacatcttcaggctccacttctaattctagttctcttgctattccactacatctgcaattatttcctccacctgaagccttgagcctatcagtcatccatgagggttggaataaacttccccagttcctgttcatgttgatattttgacctcctcccaataatcatgaatgttcttagtggcatctagaatggtagatcctttccagaaggttttcaactgactttgcagagatccatcagagggatcactatctgtggcaacaatatcctcacaaaatgctttttttaattgtatttaatttttttttttttggaaaagcagtctctatcgctcaggctggagtgccgtggcacaatctcggctcactgcaacctctgcctcccaggttcaagtgattctcctgactcaaactcccaagtagctgggattacaggcatgcaccaccatccctggctaatttttataattttagtagaggtggggtttcaccatgttgaccaggctggtcccgaactcctgaccttgggtgatccacccactttggcctcccaaagtgctaggattacaggcataagccaccccacacctggccttttttccaaatttttaactttaatttttgtattttgttttttatttttattttttatttttgagacagagtcttgctctgtcacacaggctggaatacagtggtgcaatcagctcactacagccttgatttcctgggctctggcaattctctggcctcagcttcccccgagtacctgggaccacaggtacaagcgaccatgcctggctactttttgtatcattggtaaaaatggggtttcaccattttgctcaggctggtctcaaactcctgagctcatccaatccacatgcctaggcctcccaaagtgctgggattaccctgcccggctgccaaattttattcttaaagaatactacttgaaagtcaaaattactccatgatccatggactgcagaatggatattgtgttagcaaacttgaaaagtttaatatccttgtacatctccatcagagctcttgggcgactatgtgcattgtcaataagcactaaatgttttgaaaatatttctttttctgagcattaggtctcaacagtgagcttaacatagtcagcaaaccatgctgtaaataggtgggctgttgtccaggctttgtcgtttcacttataaagcacaggaagagtagattaagcataattcttaagagccctattattttttgaatggtaaataaatattggcctaaacttaaagtcattagctatgttaatcctgaataagattctgcctgtcccttgaaggtttgtagctgagacctcctttctagccataaagtcctagatagcatcttcttccaatagaggactcattcatctacactgaaaatccgttgtttagtgaagcctgcatcaatgatcttagcttgattttctgggtaacttgctgcagattctccatcagcacttaactgtttcaccttgtactttttgtatttcaaatagccaacttgagacaagtttattagtaatttcatggtacccttttgtgggctgattctcacctcacccttccccaagcaactcctgtgactaatgtcaaacaatatgtccttttgttgcttttttcagccacccttacagacccccaacacaatcaacctggaaatgacctcagtatgtgtaatcttaagtcatcttgctaacgcagacacctctgaggttcccaagaaaacttcagtggagttctctaaactgaaaccttgagagaggaagattttcaagtaggaaccagacaaattcacttaaaactcaccactacacacctgtgtcatagaagcattccattttttctattgcagatgggatttcctcttcaagcttactgtactgtgtctttttaaaaaatagttgaagacatcggaataaaagctaatgtcccaaacagcgcttccctggatattgctgtttctttaaaagcctttttcccagctcttctgagatggtccatgacattgcctttcttgctcattaccttgatcccttgaatgggcccaaaactttggaatgcaaaaacattcattccattgacttggttgagaaagatgataggtcaggttttttttcatctaaagattatcctgggcatacttcatttgggcccaaatgagggattattccaaagaagattgaagaagcaattactccttcccctagtaatatactctttggcaatgattacagtttgcatttctgctgataatgctgtgtgctataattatatgtaagtttataagaaacctggggtaaaaccgtggactttctcccttttgctggcatcatctacagaaataccatgggcatcatgaaaggcagtatagctataggctgaaaaaagcagggttcagtttgctgctgtcatgatgccctgttgagagactgctcttcaaagtttcttgtatcattgggtcctccaagtcaggcctgggtgcctctttatttacaaagagtagttgcctctattttctcaattgaaatgaccagatttttaagatctaataattgtgtccaccgaagaaatcatcaataaaaggatctgcatttcatgatacacaagtgcacctggaccctatgcagggagtggcactgctgcaccctggtcactgcctggctcctatgctatgtactcctcttcctgggacctatgtccaccttgaacttctaagtttctttccttaaaccttatgagccaacctgtgctagtttcacacttttcttttacatcttcctcacctctgtcaggcttcaaagaattgaagagaattggggccttgctctggtttaggctttggcttaatggaatgttggggctggtttgatcatctgaccagatcactcaaactttctccatatcagcaataaagcttgtattagtctgtttttagccactgatgaagacatacccaagactgggcaatttacaaaggaaagaagtttaatggagaactcatagttgcacatagctggggaagcctcatgacagtggcagaaggtaaggaggagagagtcacatcttatgtggatggcgacaggcaaagagatagcttgtgtagggaaactccccttttttaaaccatcagatctcatgagacttatttactatcaggaggacagcacaggaaagacctgccctcttgattcaattacttcccaccaggtccctcccacaacatgtgggaattcaagatgagattcgggtggggacacaaccaaaccatatcattccacctttggcccctcccaaatctcatgtcctcacatttcaaaaccagtcatgcctttccaacagtcccccaaagtcttaactcattccagcattaactcaaaagtccacagtccaaagtctcatctgagacaaggaaggtcccttctgcctatgatcctgtaagataaatggcaagttaattattccttaaatacaatggaggtacaggcactgggtaaatacagctgttcaaaatgggagaaattggccaaaacaaaggggctacaggccccatgcaagtccaaaatccagtggggcagtcaaatcttaaagctctgaaatgatctttgattccatgtctcgcatctgggtcatgctatgcaagaggtgggttcccatgtggtcttgggcagctccacccctgtggctttgcagggtacagcctcactcccagctgccttcatgggctggtgttgagtatctgtggcttttctgggcgcatggtgcaagctgtcagtggatctaccactctggggactggaggacagtggccctcttctcacagctccactaggtggtgtcccagtaggtacactgtgtgggggctgccaccccacatttcccttctgcactgccctagcagaggttctccatgaggatcccacctctacagcaaacttctgcctggacatccaggcatttccatacatcttctgaaatctaggcagaggtgcccaaaccttgacttctgtgcactcacaagctcaacaccatgtggaagctgccaaggcttgaggcttgcaccctttgaagccacagactgagctgtaccttggcccctttcatccatggctggagtggctgggactcagggcaccaagtccctagtctgcacactgcaggtgggctctgggtcccacccatgaaaccactttttcctcctagccctctgggcttgtgatgggaggagctgccatgaagacctctgacatgccctggagacattttccccattgtcttggggattaacattctgctcctcgttacttatgcaaatttctgcagctaccttgaatttcttctcagaaatttggattttcttttcatcgtgttgtcaggctgcaaattttccacactcttatgctctgtttctcttttcaaatggaatgcctttaacagtacccaagtcacatcttgaatgctttgctgcttagaagtttcttctgccagataccctaaataatccctctcaagttcaaagttccataaatttctagggcaggggcagaatgtcgccagtctctttgctaaaacataacaagagtcacctttgctccagttcccaacaagttcctcatctccatctgagactacctcagcctggatttcattgtccatatcattatcagcattttggtcaaagccatttgacaagtttctaggaagttccaaactttcccacattttcctgtcttgttgtgaaccctccaaaccattccaacctctgcatgttacccagttccaaagttgcttccacatttttggatatcttttcagcaatgtcccattctgctggtactaatttactgtattagtctgttttcatgctgctgataaagacatacctgagactgggcaaattacaaatgaaagaggtttaccagagaactcacagttccacctggctggggaagcctcacaatcatggcagaaggcaaggaggagcaaatcacatcttacatggatggcaggaggcaaggagagagcttgtgtagggaaactcccatttttaaaaccatcagatctcatgagacttattcactatcaggaggacagcacaggaaaaacctgcccccatgattacgtcccgccaggtccctcccacaatacatgggaattcaagatgagatttgagtggggacacagccaaaccatatgaaggctgttggtctttcttattgttgtgttcactgaagtagcaattttaacttctttcaagaacattttctttatatttacaacttggctgtttggcacaagagacctagctttcagcctacctcagcttttgacatgtctgcctcactaagcttaatcatgtccagcttttgatttaaagtgacaggcatatgacacttcctttcacttgaacacctaaaggccattgtagggttattgattggcttattttcaatgttgagtctcagggaacagggaggctggagaagtgggagagaaatgggggaagggctgatcagtggagcagtcagaacacacaacatttattgattaagttctctgtcttatatgaatgtggtttgtagcatgccaaaataattacagtattaacatcaaagatcattgatcacggaaataataataaagtttgaaatattgcaagaattatcaaaatgtgatacagagacatgaggtgagcacattcttttggaaaaatggcactgataagatcagttgatggagggttgccacagacctacagtttgtttaacaaacaaacaaacaaacaaaaggccaggtgtggtggcctatgcctgtaatcccttcagcactttgggaggccaaggcaggaagatagcctaagctcaggagtttgagaccagcctggacatggtaaaaccctgtctctaccaaaaatacaaaaaattagctggatgtcatgtaacagaggtagaaggattgtttgaccttgggaggcagagtttgcagtgagctgtgatcatgcctctgtactccaacctgagtgacaaaataagacaaaaaacaatgaagtgaagagcaatgaaacaaagtatgcctgtacactaaaaatcagtctgttgtagctatttgatgttaagaacactaaattctttagtgcctttaggtcatatttgtagtaaacacttctgttaatgttttgaaactttactatttgcaccacccccagttataagtgtacacattcttgcatgttggactaaccctgtccttggacaaaggtcagtagcagatgaagattgcattttgtgatgtgctcagttaagtttaatttaaagtggtccattgtacaataatgtttgtatatgtgtacagaaaaattgttcaaatcaggaagggattatttacaaagaattggcccaagtgtgaggaggccattgaaagtgaaatgagggaagctctataccaagtgtaagtgtagtttaattctgcccagcacatctggaggggaacatgtgtgtaggtgcatcacattcccaagccagaaaaattttaggtgattcaaaatgaacactgtattgtttggagaaccaaaatgtccaggaatctgtatcgtgttttgtttgtttgttttgttttttgagacagaatctccctctgtcaccctggctggagtgcactgctacctctcctgacccgccaccttccccaggctcaagcgattctccaactcagccttccaagtagctgggaacacaggcatgcaccaccacatccagctgttttttgtatttttagtagagacagggtctcaccatgttgcccaggctggtcttgaactcctgagctcaaaccatccacctatcttggcctctcaaagtgttgggattagagatataaaaccatcatgcccagcctatatccaaattttctttttatttgtttttgtttgtttgtttgttttcttatttctttctttgtttttgtttttgcttttttttagatgcaggttccactctgtcacccaggctagagtgtggagtgcactggtgcaatttatagttcactggaacctcaagcactcttcctgtctcagcctccagagtagctggaactataggagcatgccactacacctgactaatttttaaaaactgtttgcagagacagaatctcactatgttgcccaggcccatcttgaacacttgggttcaagcattcctcctgcctcagcctaccattatatccattttaatcagaatataatatttaagcaaaaatggaatgtctgagcttctacagaaagcctcctttttcctgcctcttccatttcttgattttatttgtgataattattttttcttttattttctcctcactttattctttaaaatgcttctctttccactaattctgtatttttcttcatattactttttctttcctccttccactcaccctgccattttttttaaataaatggttttccaaatagatgtgtgcaaataacagggagtcaagagtaagatcaagttactttagatagtgtttgttttagaaatagcagtaaaaattcactctataattgttctgtggtcgacaggtttatgcaaacctatcccccaaaccggaggaagctgaaaggcccaagtaagagactgataaatccagtttctcagaaagaaacatttaatagggagtgagaaacagaagtcatgatgtcctggcaattgacaacaacaagattagatagtgaatccccccgtaccattacccaccgcgtatgacttatatgtaaaacatagggaaggattatgtggaacaattgaagtcaacctctcagggaacggcaagaatgctatgtgaatctgcctaagggcaggatttatggtagcagcagttaaaatagaaatcttaaaggcattcccagaataagggttacccagaagtcaacatggcagattaacacccaatatagagttgctttagcctccacaataatgtagggaaataaatataatgaagatggcagtattttttaaaccatatttcaaagaaatcttctctttgaaacatggagaagaaggcatatgtcactatatgcaacataagcttatattcatatctatttagtatatccaggacaaattttatttagttctaggaatatacagtgagatttttcttactgccccttgacgttagatattattcaccttacagtgatcagagatacgtcttttagcatccaccacttgttcatcaaccttgtctgtcaaatggagaaatctatgtggcaaatgcaacaagaagttttccttgacccaataaagatacaggtccttccttaaatggctatgttgaaatataaattcttaaattatatacttatttacatggcttctcccctctagtgaacttatcctggaatctgtcaattagatttattctatgtactgtctattcttttaaaatgggactctctcagaaatatccctctggataaggtacacatctcatttttctcagtgacagtaaaggggcgtaatttctattacacaggtctaattgccttgaagaaacatcataaggactcaaaacatggaaggtattattattgttgtgattatgctttgaattcttaagtaaccaatgtattctctgtctctggatctgtttctagtgtcaaaacccttgttagcaggaattagatcagattatattaataattatgtagtggatatcttacttttgcatattttctcatcagacaatacacgtctatattatcttttatctcagtgtgtatgaataaatgtcagagctatttgggtcataatttgctatgcggctgttttgtcttgttatatatttcactgtaataacagtgagttatgattcacaaagtttgcctccttttataaaaggtgtattttaatttgatgttagaaacaacgaactttaaaaatgtaattggccttaatatctttttagattcctttgaagatatacttagcacaaaaatatgctccttgggaatttgacaattgagctgataataggatatatcatttttagtttacaggcaaaagcaaatgcttcattattttgttgttatttactacatcataaaagaaatttaattttagctagctgtgtgcatctaagtccagatatcatttgataaaatgagtcaagtgggaaaacttccatttctttgtgatgacacatcaaatatgcccttatctctaaagacattaagaatgattgagtgaagtcttcctactttgttttttcagtatctttagacatagtacaaacatctaaattacgatatgtttattttacaggagccaatgagaaagaaatagccctaatgaatgctttgactgtaaatttacatcttctaatggtaagttttctttcccactaatgtttagaacacattcatttacagaatctgatgtttttctatctttaattcatgagcttctgggggtttacttatttaaaaataaattgtgaggttattttcatttttactaggaaatgctggaccatgatataatagcttcttcctaatcatggaagagttgactcttgagaagagctttagaataatgaacagttcttgtctgggaaaataaagaataagagccataatgggtaaataggcaaactacatgcaagcctacaaaacagtgatgtacaatgctagcaaagcactgacctttttggaaagacaattttctaatggcttcagcagagtgagttagtggatcagtatacttttgtatattaatataggttaaaaaagacttggagtattaaatttttaaaaagaggtctagtaccttaaatgagttaatgtgtttaaagtacttcttacatcttactcaataaacagttttaccttaaagtgtcaaatctattatctattagggatattgtgttaatggtgactgcccaatgctttaaagaatcttgacttcattttttcaagtatgttttggaaacatgtctacaagttcagatatccctggatttgactcccagctaaattacataatgcttatttgaggttgaaaaaggcttttggcatctctaagtcttagtattttcctttgtaaaaatgagaaacataatatctacctcaaagatctgcatgagaattaaatgtaataatatgtgaaaattgctttagtaccctggccagtgatcaacactcagttaacagtagctatcatcttcgttgttattgttgtcaatatcactctctaggaactgtgtggagaaatgaaagagcttcactgaacaaatgagctactatcaatacaaataagacatacatagaccataatatttcagtgtcatgccatcaaaattaccatgaaatgctttgggaagataatttgtcaattaacagctttttttgttgttaatcatcagactttaagtttcatcaattaatatataagtaaagtttgaggattcgttatcacattcacattttcccccgagtttgctgtttcattgataagcaaattgagccaatatcttctttctctttgagattcactggaaacatggctaattgaaaaggtagtcctgacaaacacttaagatgttgagttaattaatgtctttaaaatactggagattataaaatgatagtgtgacataaaatgaacaaatgtataaattgtgtattaatgctttctcaataaatccattttattgcagttatcattttttaagcctacgccaaaacgatataaaattcttctagaagccaaagccttcccttctgatcatgtaaggacttcttcaaattgtatttatgttctttctactcttcctagagcagtgtatcatttgcctgacttgaatgtttactcactaggcttttccaagcaatcttacaataaaaagatctgtcaaatgcttttgattaaattttttaatagattatagctttatttcttttgttaaagtaaaacacgtgttaagggaagagaagatggaataggaacattgatttattagtctttttaaagacattgagcaaaccactgctctaaatcaagtgcagttataaatgttttattaattcttattgctcttttattttatgaaatcaaatcaatacaaaccccagtgcttaaccctttagctaaatagaataggaatataaacttttatttgtccagtgtgttttcatagcatgctagcataaatgttggcccattattatcaaaatattatttattagagattaaaaatatttcttgtgatttactaaaaaaagtcacattactttacttgatgatgagttgtttattcttacttgataagaaatgtaatggtttcagacacaaacacaaataaaagtacaatgtaagtctgggcacagtggctcactcctgctatctcaacacttcaggaaaccaaggcaggaggaacacttgagcccaggagtctgagaacagcctgggcaatatagtgagacctcgtctctataaagtaaataataaataaataaattaattaattttaaaagtacattttatattttagttttggtgttagagaaactttatttctctatattattgctgtcttttactctagcccttgtaattttagggcaagtaattatgtcaaatggaataaaaccctaatatcttactaaaatggatcaaaatcctaatatctacaaaagattccaggtcggtgtgggggcttatccacatgcatatctggtactcttaatgaagtaaacttcttaatgccttttttttagctaacttactcttcctagggtaagccatttctatatcctatgttcaaggatgacaagtccctactattcattttgcttattttgcaaattctggttttgacttagattagatgatttaatttcttattctaaaatctcttataattccttaagtcaaggagatccctctgttttcatctatctcaaagaatgttcagaattctatatgtgaattttattaagtggttcttctctgttgtgtattttgtttaggtgttttaaccttcaccttggatttaatataataatatgcccttatttttactttattatttgttatttcaatgtacttctgtgctctcagcttgatttgataaatacatcatctttcctttttagtatgctattgagtcacaactacaacttcacggacttaacattgaagaaagtatgcggatgataaagccaagagaggtatatgagaaagaaagaaatatttgtcatgctttgtttagtattgatttttttcttcattttcctcaaaagtttattaaaatcttcattactttaatggaactttcaagaaagcatgaaggacctatacttctgttactattagatcattttgcttaaaatagagaataactcagatgtgtatttattttcatttttcaagggctagccatatggcaagcaaactatttttctgttaataccactggattctgccatattcttcaatgggatgggaaaagggtgacaaatttagtatatcattttcaattccaaatgtcatgcccatgggtgccattaaaatcatgctaaagaccagaattatttgttaaaatggaatcgtgactatatttcatgtcccctcttactctaagtatcaaacattttctttgtgtttagactaggatagtggagaaagggatgtggtataatgggaagagctttggctttacagtctggctaatatttccagtgaaatctcagactctccagtttactgggtatgtgactttgggaaagttactttattctctgagactcctttatatttaaacagataacaaaagcatgtgtctaatcaggcttgacctaagatctaaatgtgtactttacattaatagagataaaaggctcacagactttgacatttaaaccctgcagcttgtgtaatttgtcactagtcgaatcatacagaataaattttaggtttcacataagatgctcccagaccgctagtcattgtttggacaattacttctttcaacccagaattactttgaataaattaaagatgtactctattcacttccatttgccaacatacaataaattaatggaataaaaagttctcacatgagaggatataaattgagaggatataaattgttaatttctagcaaaaatgaacatagctgctaataatcacataagtgaccaatattgtggagtttcatgagttactcataatcttgggaccactgttgagcattacctagaacaagtcaacatgagagagggccgtatcctgtcgttgaaaaatgtatttcttatgtgcttaatactgattttttaagatataaattaagtattagtatctataatattttccttaccactttattggaaattatggtgggtaaaccttattagattgttttaagaataaagagttttggattgccaagttatcaattttacttacaattaatgacattcttttctttatataaagtatacttcacttaataattcagatattttaataacaatcccattaatattgggatgccaatttttattgatgcccattttgtaaacaaattcctggtttcttctagtagagagtttatttcacacccacacacatacacactcacacacacacacacgtactctcttaacatggagcagagtaattggcaaataccaagataattaaaaattaaaagtaaactataggataatatcttaatgagcttcccccaaatattaacgtaattaatgatgcattgacctcaaaatcatgtcagacagcactggagaaaattcatggctgggtgcagtggctcacgcctgtaatcccagcactttgagagtttgagacaggcagatcacgtgaggccgggagttcaagaccagcctgaccaacatggagaaaccccatctctattaaaaatacaaaattagccagatgtggtggcacatgcctgtaatcccagctactcaggaggctgaggcaggagaatcacttgaacctgggaggtggaggttgtggtgagccaagatcgcaccattgcactccagcctgggcaacaagagtgaagctccgtctcaaaaaaaaaaaaaaattatgaaaacttcagaattgctaggatacaggatacacataggtactttgtatttaactaatttttttcagctcaagttgtttgcaagaccaaatctaaattcattcacaacctttagtaagtaatcaattattagttgtagtggcaagatataaggaaaaaaccctctattatagtcagttttattgatatttttcttcttgtttgggtcttgagctttagattagtttggaggagattttaatcttaatctaatagaagatattggctaggtaaaactcagataaaagatgtgtaagtgttatgttttctttggtttagtttaatttagtttagtttttttctgagacagagttgctctgtcacccaggctggagtgcagtggcactattctcgtgcttccgccacccaagtagctgggattacgggcatgcaccaccacacctagctaatttttgtatttttaataaagactgagtttcaccatgttggccaagctggtctcaaactccttacctcaagtgatctgcccaccttggcatcccaaagtgccaggattacaggcgtgagccacacacccggcatgttttctttttttggaaacaataacaggatatcagattgataaatgcaataccaatttctgataatttatcttgctatataatacttcatggacttcttgcactttgtggtgttttattagtcaggaataaggagaaaacaacttatagctgtggaaagagtacaaattaatttttaaaaactggagaataaatcaagcaattcggcttttgaagactttcacttgaaaaaacactttttactttttaattatcatttcttaataataaaaattatgctcaaatgctgctcttatgccagatttttaaagaaccttaatctgaaaaaaaaaactattttataatgcaaaagggctcacggtgaaatttagatcggcaatatgaaattacaaatttattattatcgatatgacctaacttgtgcctaacttgatttagggggaagaaaccttaagaatagaggatatccttgaagtaattgagaaggaaggagactcaattgcagtgatcctgttcagtggggtgcatttttacactggacagcactttaatattcctgccatcacaaaagctggacaagcgaaggtatgcacgccatttacttcttcccaccttactccaaacatcactctacttaagagtgttctaattgcatgacttgtgaagtactttagcttgtgtctgagtaaaactatttcaaaagttaaaaaaaaaaagagtaaaccttgggccaggcacggtggctcacgcctgtaatcccagcacttgggaggctggagcagggggatcacgaggtcaggagtttgagaccagcctgacaaaaatggcgaaaccccatctctactgaaaatacaaaaattagctgggcatggtggtgggcacctgtaatcccagctattcgggaggctgaggcagaagagtcacttgaactcgggcggtggagattgcagtgagccaagatcgtgcccctgcactccagcctgggcaacagagcaagactccatctcaaaaaaaaaaaagcgagtaaatcttacatttttaaaagaaaatctgtaatcttttttgcttcaggcatctctatttaaactgcttttttttttttttttttttttttgccacttctgtggtctcacctccttagtagcagctgctctgtgcatttgcctctagtcagcaggccaggcaagctgtaggtgatgccattggtactcagctggtcagtcaccaggaagcagacaaaatacttaagataggaagtacatgctaggtctattaaaaattcaactcatactttgtcatactataaatcactctataaatgagttttcacttaatgctgagtatctaaagatgaagaaatgcagaattcaattttatcagtagatcaaattttatacaagttactttaaggaggccattttattcctaagactcttgaaaattttttatactgcctgtaatgagagctttttttcctacccactactaaatcacagttaaattgttttgaagtcatgtctctttgtatgtaagtgtttgtaaaaagtgtttttagtatttatttgaaaaaaaagggcaacattcaacagtcacaatttgtgtttaaaatctttaaatagcacttctatttcattcagcaatcaagccatgtatttaaaaatgtgacaattgaattttattctgaacattaataagttatgggattaatatacatgtgagatctagttaatatattcagttattgaagctaatgaatggaactaattaaaatatatttagcactgttatcagcagtctctaggaatttctaacaacgacttccaactgctttgacggataactctgaaagtggtgcattacaaaagatataaagataatgtcttcttaatttagatgttaaatgttaagcaccaaaataaagggaggccaataaaaaatcatattttaaaatgttatgcaagtaatcagcagtccctgcttccttagtatacacgtatgtctcattaaccttcctagacatgagacagcaagatacagaagaaagaccatgggtttccatcacacaatctgaggttcaaatcttggctaggtcatttaattgttacacaatcttgagcaagttacttgacatctcgctttaaaagtgctaatttaacataacagcacccaccttacaggttcagtgtgagaatgatgaatataaaacaccaaatggattggcacacattctgctattaaatgatggtttccttacctttctactcttctcaattaatatgatattataaagtggttgagagacactttcttttgtttcccattgaaacacaaaataaatttgtttactttaggttttataagtaaatctcatacttaagtactttgattgctaaagccatttgttaaatgttttgcaggttttctttaacttaaaaaatatagtaaatgcctaccaagttagtctcatagaactctcagtcaaataaatgaaggtaggaatgagcagctttaagtgtaactatgaagaagcaatcaatactatgggaatcaaatggggatatagcagatgtagatttatccattatcaagattattctaacaaatttttaccctcttgctgtagttcctcctattatcaaccaaggtgaggcaaagttctttgaaatgtagacttcgataggtctctctggtggtctggtcatctgtgaataaaactgaagagagaggcagagaagaaattaaaggtgtcaatcaagaaagagataggaaattctaagaacaaagggcatgacacagtcactggtagatttggacatgtgaggcaaaaaaacgttttcagaaataaagcatggtgggaatacaaaatgatggtgggatggagcaatgagagtcaatcaggaggttctgaggtaaaatcttcatagtcatgtgataaggaagaagaaacagaaattgtgaaaaatattttaatttaagaaatgtatgtataccaaaaacagcatgaatcataagcaaatagcttcatgagttattttgaggccttataaccatcaccccatcaagaaaaaaaaagtatttccaatactcagaatcctcaatcgtgtcttcttccaaatactacctgttaccttctgtctctgtccacttgggctgctataacaaaataccttaaactgggtaatttaaaaacaacataaatatattgctcacagttctggaggctgggaagtgcaagatcaagatgccagcagacttggtgtctgcttagggctgctgtttgtttcacagatgacgccttgttgctttgcccttcctcacatggcagaagggctaagggagctttctagagcctctaatacaaagggacaaattccattcatgaggaatcacttaatcatgacttaatcatttccaaagccctgacctcctaatactgtcacattgggtataaggttgtgacatataaaattggggtctggggagaccaacatttagaccgtagcatccccctttcaaatttataattcccctaacttctaaccacatagtcagctttgtccattttgaactttatataaatgcattattttgtctagttttgaactttatatgaaggtatacacaggttgaatattccttacctgaaatacttgggaccagaagtattttggatatttttggattttggaatatttgcattatacttactgcttgaacacaccaaatctggaaatctcaagtgctccaatgaaatttttattctttgagcattctgtcagtgttcaaaaagttttggattttggagcctttcagatttctgaatttgggattttagatgctcatcttttataaagtttttttttgtgtttggcttatttgctacttttatatgtgtgagattcattcatgcagtacctagcagtacttttgtttgttttttttttctatttcagtgtatttttacatagtatgaaatagatcacaggttttttccgttttatttagggtagatatttggattttattttcatttgagaactactaatataataatacatgctactctaaatattcacataaattttggggggtatacattcatatacatttctgttaagtatatacctagaattagaattcctgaaccataaggtatttgtatatttatttctaatcaataatgccaatcctccaaaaaagttgttcttctaccagcatatattagactttctgtttctctacagcttcaccaatagttactgttttcagtctttataattttagctgttctaagtagtttgcagtggtaatgcgtggcagttttattttgcagttccctgattattgataagattgagaatcttccaaatacttgttgattttctatatatcttttatgaaatgcttgttcaagtgtcttgcccatatttctatatggttagctttcttttcctggtttgattgtaggtggtatagaaattgattttgaaggagagagaaaatacaagatttcaagtggtcatcaaagaagaaaactaattaataaaaagaacaattgataatatgactttgattcacacaatagatttaagatactgaggcttttcttaactgaggaggcctgagattgtagcaagtgggggaggccaaggaaaacaggttagagagctcaataacaagggaaggccagcatgtggcaagagacatcagtttgaagatgcttcttcaagatgaagatgtgccaacccatctttttggagctctgtcttacttccatgtttctatatttttcatattctgttacttgtttctactaggaacttctttcctacacccactaattgtagatgtttctgattgtcccctgcattgtatctctagtgatttttaaccactgccataattcagctaccactgtcaagtgcagactccaggctactcatacaataggaaatagcctgcatcttcccactacatccggatgtcctatatgtaccttgggatcaatatgctccaaagagatttgtgtcatccacaagatgtctctactgtatcatcatgtcaccatctttctggaccagtacactcagcttttctgttcttgacctttttaacctatctcttattaatttcatcctttcagggtctgtctttcttttaatatttctgaatcaaagatgaatgttttcagctacaagaaacaaatgttaaccttgggtgaaaaatgcagatttctttttctcaccacgaaagacttgaggcaaggggctgctggggtccactcagcaactcaattatgtctgagtgccatctcccaagtttccttagagttttctcagactttttccatcacagtcacaagatatttgtctcaaatccagaaatctcatttctatttaaggcagagagaaggaagaagggagaagcagcagggcagcttcatctgtttctttcatcctaagtgctaaatctttcccagaaaaaaacctagcagattcctgctaatgactcactgcttcctgaaatggcagctaagaaagagcatgagtaaggaaatatttcacatctatggccctaaagtagagagagactaagaggaaggggttgggaatgggcttcgggttggctaaatataatatttcttatgttcctcaattataccctcataggatctcattgttcctaacccattttcctctttcctctttcattgctcctttttcctttttttctatccctttattcttccccctcgctctcctttctttttgttctctcccttgctctctctctttcttttttcttttatcgtctcatttcacaaagcatttgaaacaattcatggaaaattgacaaggtgaaaataagatataaagcaagaggaatcaagactgtatgcctaaatcatcttgaggtatgaatagactttcccacaaatttagattataataagaaataggaaataaataatgaaaaatattttaataagaactcttgatgtgttaggtagaatagttattggttataaataaatacagtcacaaatgtcttcacagtgatagatgtttatattttactcatgcatcgggcaggaattaactttctctccatccattaattcaggtttccaaaagattcatggttgtgtcctttggcttttgtgtccacagcctctgtctggattcagtcaaaggaatgcacactaacttctttaaagtcttagcttagaaatggcaacatttacttccacttatattccattgactaacactcagtccatgaccttttctgggaaatgaagtatcactgcatgctcaagaacagctgttagttttgctacacctggaactagttattgtgtgttcctgatggaataggatacttattctaagatgcagtatggcattttcattaacagaatgtgtagatcaggaagacacagtcagacctggacttgactctaggtctctacattacttttcagcatagttttaattcatttactaatgtgagttattttgtccatttaacaaattaggaaaataatcgtgccaacttcacaggtttgttctaaagagaatgaaaaggtatacattttaaaaatacttagtgcttagcagatggtaagcactcaataaatgttagcagttgtcaacatgttaagaaaaaaaattggactatccaggcttgttggaaaaagaaataatgaagaaatgagattttttaggcagaaagtgaaatatccagaattttttattaaagactgtcactgaatagttccacactagaattaaaaaaaaaaagaaaagaataatctaagcagtttggccaggactcaagagactaaactgaagttttaaaaagttaagagatggaacttacaaaaattttaatagtcttatttttaaaaaactcagcacaaactctttgtactcctccatccctttctaatttcatctaaagtggcttaaagcacatggaaacttaaatgggacctagttgttaggaagagccaaataagtatttgttgaatgaatgaatgaatgaatgaatgattcccttaatttctcacatcttttacacattttagtgtacctaatggatgctggcatatttgttttttttcagcttactaaaagttgaatgcaaatggtggttaaaaagaagaccaaattctgcaaactccaacattgttttattagcttctacttctttgtgtgccatatgatgctttgtttgggtgcaaacgtctcacatctcttagactcaatcataagctgtttaaattattaaaaaataataatcacaatgatagcccaggcagtttgaataaaaatgaattacttctggatccagaataatttaaggcaaaaatcagaaatacgaataaagacatcattaataaaatcatttagtaaaatcacaggtacccaaaccacatttaaatatgaatatccacctcagtgaaccttctatttatcttcagatagtcctaattattttttaaaaacaattttgagtttattttagaacacaccattgagtgatcaagcctcaaatttctacagaaagcttggccgtgatgcttttagtcctgaaaattggaaatcaactgtcgtaatattataatagaataatatctctgtaatatctctattacagtagaatgatatcaataatacatgggatatcagaacttgagcaattaattagctagaataaatgagtactaaacacttttgtgtacaaatataaattagcataatgtatgaaatttttatccataaaaattaacctctttcataaaagtttaatactggaatgttaaataagtcatctttaccagaaattgttgacattagagacattttgctattgtcactggccattcaccgaataggatcttagtgtataagaagaatcctgtcgctattgtttctatagtagaaccatagaatagcatgcatttggatcttttatcagtacatatttggtcagtaaattataataaaggagttgcaaatagaaacacctaacttaacctggattgtcagggtgagaccttcttaaagaagatgagatctgagccaattatagaatatgggtagaagttatcaggtaaaatcccttctagaaagttaaaaatattggtaggattgcagggaagcaagtatttcagtgtaatttgtgtaattttagaaaagggaggacaagtctataaagcagaccaaaggccaactaaagaaggtcccactaagccatttagctttgccctgaagacccatggaaagccattgaaaggttttagccattcaaagagccatatttatattaattttacaaagaaatatcctgcatatggtgatgagaatagattggaatgaaatacaggtggacgaaaagaggcaattgcagtatctttgcaagaatttgaaaactctctgttgcgtgggcgccgtagctcacgcctgtagtcccagcactttggaagcctgaagcaagtggattgcgtgagcctaggagttcgagaccagcctgagcaacatgttgaaacatcgcctatataaaaaattaaaatatagctgggtgtgattgtgtgtgcctgtagtcccagctactcaggaggctgaggtgggagtatcacttgagctcaggaggtggaggctgcaatgaaccaagatcacaccattgcactccagcctgctggacagagtgagactctgtctctaaataaataaataaataaataaatatgctctgtcattatgatacagttcaaaagatgaaggtatgaaaggacagatccatttcatgcacacaattttttttatctcaggggaaatcatttttattcatcctcattccctcagtgacaataaaaacaggttacgtataagcatcagaaataaagtatctgtactgaactcctgtagtttaactcacctttggttctattcacagaattcaagaaaaagacatgttaaatacacacaaacacacacatatatatatttgtaaatatttttgggtatgcttatatacgtgtatatgtacgtgtatatatatacttgacacattttcagggtgatagaagatatactatatctgcttatgaaaaatgttgattaaggaatttacacctgtattttgatgtaggggaaaatgacataaagcttagatgcaatgttccattagctaattggtctttactcttcactttggaaatagtggaagattgttttgttcagacagatagtgaacaatctgtagtcttaaatccatgcaggtggaagcctaaaatatgtcaaataagtcaaaatatgttggtgaggatcagtgcccaagaatctgaaaattttgagctgtttctaagaagtcttcatcaggtgtttaatttaagcttttgattaaatagaccatttgagaaataatgattaattctcaatggaaatgaagcctggcctccagatgttgttataggattacagatctgggaaaagcaagcctcctggttgtcaatcaggatctctgcttctgcagccacccttatcaaagccatgagggatatctatttctcctgaattagcctcattcattggcataacagctaaacctagggcctcccgaaggaagtgttacacttaagttttttgtagatgatagatgtttcataaaatacttaagttgcctaaagcccagagtatattcttgaatattccatttttcatgcctcttgactaaccaaggaaggcagatttaagtctttgttaaactgaaaaatgaaagtgttccaatgtgaaatgtacacatcagttctaatttattctaccctccataaaagtggaaaaggaaggctatgtctcatggcaataaaaatggaattccaaaagatctttgggcagaaaaaaaattcccaataaaatatgagagatttcttccacaccattctctgaaattcacttctttcatcagttaaattatttatacaaacaagattagggatgtcaacatgaaaggttagtcgatttgaagagaaaatattttcgcagcagataatctatcttatggaggagggtggtgagcaaagaagataatcatcatattgtctataaaacctggcatcaaaggaagcaatttagaagcagtgtcttcgagaattgtcccatagtgtctatgcaatattatcaaattcagtatgtaaataaatattttaaaataaagtaaatttggttgaggaataggccattcatgttgacacagtaatcagcagaaaaataccttatgggagactgttcctttattttatatctaaatggggctatctccagatataactgtcactagtacgtgatggataaattaaatacttgcttcaaatccactttataataagactagtaggtaaattgatgaataaaggttaaaagtcaccatgtgtctgaaaagtcagttggactttgttgggacagttgtgattggcaccatgttttgcctacttgaatttcctgcatcgtgtttctcccacaggatgaccattgttcctttactgattgtggaatagaatgcaaataacttcagctctttatgattttgcatatgctgaattatcagtatcatattttccactgttctccttcacataacatatatcagctaagccaaaagttgtatatattccctgtctcaatgtcctactttgtgcctccttgtcttcctttttagctttccctccacctacatattcccacaagtgaagattctcctttcctctattcccagtcaaccattacttgcttcacaggttacaacttgtcctagaggtttgctttgtgtaggccctcattgtattagcaaacatggtgtatttttaaaatgtagtcatatgccaacaataggaaatcatgagatttcatataaagactcctggtttcaaatatcttccaaaaaattagaagtttgacaacaatggaccttcattcctataggtggcaacactgggtagcagctctgtcccttagatggggcttaagctcttcgacacaacatccatgtttacccactgagcccaccattgaagccaagtcatcgctggtgaatatatctatatgaataccacaacattatgtgtgtgtgtgtgtgtgtgtgtgtattcatgcttatgatattcttacaatgaagtgtaaaataaagtatttcttgcaggcccaactcgtacattgcttgactgactcttgtagaaacctgcaaatgaaatccttgacttttattggcaacattttctcacttttctgtatcaggatatatctgtcttcctgctatacttccacaccatgatgaaaaatgtatcattggccaccgtttgcactgtcttataattacttctatgcctattttaactctcaaatttaggaagctatgtcagtagagtgttcaatgactgattgagggtagaccttgcaaatttcacagattcatgtgctttgcacatagtctttcatcattaaatacatacctgctagacaagtgaatgtataaatgtgtgtacatcagcagtcaagtggaccaggttgatttgatggaacagtactgcataaaaagcacaactgtattcctgcttaaaaagaatcagaagcttctacagaataacttataatggttaattagtctaaaaaatcaagatgctttttgtaagttttgagttctttttcaaattccacttctattctttgacacacttaggacgtgcagactgctccgttaagtcattaaatattaaatgaactaaattaagcttgaaaaactaccttaagctatttttcccatcttgagtctcagaaataaatcaaacaaactacattttgtgtgaggtccttgctagccagagaaagactgtagaagagaacagcatgactgaatttatttaatttttcttggttttcatacttacttttgacagtaagtaaagacaattatttttttctggtaaaaagaaacagctgaaatttgctctttcaagcatatactttatttaaagtggcgtgattattgtacctgcaaattatacaatggtttaggggctcaggattggtttgcttttcctttcttccaaaccctttactcttatccatccagctgtcagttctctctaataccttctcaattcacacctttcccttaaatttcattagcaaaatgctcattttcttccctcctcttatctctcatctctggatttgacaatcttgccaatgtctactttaagcaagcagagatgaaacagtgaatctagtctctgaaataatgcttcgtaaaaatgtgaatgataatagctacagttgatggcctactgtgtttctggtacttgacatgtatttccaattttcctagcaaccctaacagtaagttttcaccactgctcatttgaggagagtgaatctgagagagtttaagcacttcctcaaggcaatttagctggcaagtaaaggctagaatttgtgtctagctatagctgataccaaagctctctttccacagtattgtcttgtctatatatatatatgaatttgccatttatagtcaattatgtagactacagagacagaggccatatatatatatatatatatatagagagagagagagagagagagagagactgactacagagatgaggtctctctctacatatatatgtatgaatttgccatacatagccaattatgtagactatagagacagaggtctcagattaccaagaaaagaaaggaccaagaaaaagattgtatctttgatgtttgtaatgctgacaccaatttgccattacatgattagtgtatatatatacacacacacacacacaaatcatatatacatctaatatatatttatatataaactaatctcatatatacacattatatatattttgtatgtatatataaactaatcatataatggcaaattggtgtcagcatttagaaacatcaaagaaaaaatatataatctttttcttggtcctttattttcttggtaatctgagacctctgtctctgtagtctacgtaattgtctctcttgagaatattgaaaactcacaagttttactttgctcctaaatgtcaagaaggcatagcctaaatgtcaataagcatcaaaagtctttctgaatgagatagtgccagcattcatcactgttccttctcagaacctcaagcctactctttccaattaccctcatatagggaagccccaatacactggcccctccataccccttttatctccttctggcaggtctcttaggcagttgctccattggcaacagctcccagcaatgatggctgcattactactcccatcctcataccttcagtgacctttggggtgtttgcagcagctttccctctaattaagagcttgcaagcctccgtgtgcttgggaaacacagctgcaaaccactggagagaattccagcaggaagtactcatccctcgctcccattgtctaataccagctgaggtgtacattacactcaagaaattttattctttcagatgtataatgacctctcattttacgtcaggctctgggtttaaaaagagacagacagaaaatagagaataaaagaaaaaaatcccaccatctctgtctttaaagagatcagaatcagatgtgacatagaaatatgtaaagagaatattgctttagactgtgttaagtgcttgacaacgggagacaatagattcactaaggtgtcttagaaaaaacaccctcgacatgttctaacaccacccaaagtatacttatgtatgctccaattcgtttagctttaaagttgcccaaaaccacaaactgaataacctcaaggagagcattcagatagttcagagcattcattcccatagtcaaccaaaaagtatctgagacaagtctcactcagtttagaagtctattattccaaggataagtacatgcccagaagaaataaaaacggaatcacagaaactgtggtctgtgcctttctacaaagataattttgagggcctcagtaaagggaaaagtgggctggaggggaaagaggaagggtatggtaacccacatggtgcaagagagaaggagcaggtaagggaataatcaattatgtattcctctcatgctcagtaaatcagcactttacataaaataaggtgaacgtagagtaggatttaaccttttatctgtagctatctgcttaagaaaaacaggaaaggcagcttctagtatgactcagctttcagctttttccttttggcctagtaaattgaggtcccagtttttattttcctttcacaccactgaagttgagaagctgtcatttccccctgccatctatttgcataactagagggcataacaatggtgccagattctttgccagtttcccccaaggagtaactgactagctatgtaaatcacattgctggaagccttctggaacttaaacaaagagtaacttgagttacatattaattttaaaaaatgtaaaggctctccttcttgtgaaataaacatagctcaagaaggcctatacaaattgtgatagcttggccatcttcagcatcttcaccatcgctgttcaggaatccagggtttttattgaaagacaagcatcagcttgcttctgtccagcctcttctctccaactacccattctgtgactcttttcccacaggacattcccttcatattttcctttagagtagcaatagttataagctactacacttttttaaaatattagggtatggcttgaaatcagtgggtaataaaattctaatgataaagtcaggagccacggaaatactggtagaagaggcacttccccagcagaggcctcaccctcaagcctggagaccatggccctaaatgagaacagttatccctgttttcctgcctaaatgttgttttttccaaaaccaccctggctcaccatgactgctccccccaccaaatcctgtacccataaaaaccccaaactcctctggcagaggagcagagtggcatggcagaaaaggagagaagaagcatctgaacatcaaagaggcagctggacagtcagagaggatttcagctgggacagccaagctccaggggaaaattagctacctactccatcccctttccagttcctcatcccactgagatcccacctccatcactcaattcaccatcctttaagtccctgtgacctcattcttcctgtatgccagacaaggacctcctaggtgccaagagggcaagttgtaaaagactgtcacctgactccacactgagcttgttaacatttggccatccatggaaggcaactgctgaaagagcactaattgtaacatacccctagatgctaccatgggtctggagcccaaaagcattcaccctggccccagcacacactcgcctgcatgctccccctcccacaagcagctgagtaagtgaagcacacccaggtcgcaaatcctctgaaggggtccagggagctctcccatctccctaattctgtgttagcctaatttgcacaagttgataaataaatgaatatatcttgatgaattcatttcactgtttagcttatccttggatccataccagagtttttaaatcactacgtaaacatgtttactctaatttcattctgattccaagttaaagatactcatttttaattcaatgagttccttgattgttgtgcacacttttctcatgatacccattttttgattcagaacactcccttattggatttcttatcttcaaaattaatgtcacaggtgcgactagctggggctcgtcatgggtggtaaaggaatttaccacgacagtcataggtgaagaaaggcagatttattagagaaggtatgaagataccttgcaagaaagcaatgggcattacaacagagaagaggctgtctgcagagaggcaaggggtggagggaagttttatggggttgtgctggagggggccacatgctgaccgaagccatgctgctggggctatgtgtggaaggaggtcactgtgtccacaggttacttgtgattaacatttctcagaacaattattcattattcttccccacctggggccctttctttgttgttgcttacttatcaaggctccacatttaacctttctggaatctcccaagtatattcatggcatccagttctctagcattagcccacctgagtggcatggagaagtgttgtctctaccagggcctgttgtctcctctgtttgtatatattgacacaaatacagtcattcagtagctctaggacaacggggtttttccaagttatttgttgtgtaaaggttttttgtaatgatcgccttctctatgcacttacattttaaaatatttggtaaaagatatatttgaaatctatcattaggtaaattaccttaattttaggtaatttatcagaaggttgtgaactcaaaagtatctgagacaggtcccagtcaatttagaaagtttatcttgccaaggttaagaacatacccatgacacagcctcaggagctcctgatgacatgtgcccaaggtggtcagggtacagcttgcttttatacattttagggagacataatacatcagtaaatacataccagatttacattggtttaatctggaagggaaagacaactcgaagctgaaagcctggggaggagagggctgggcttccaggtcataggtagatttgaaaatatttttggtaactggttgaaagagttattatcaatagaaaggaatggctgggttccagtaaggggctgtggacaccaaggttttatcacgcagatgaagcctccaagtagcaggcttcagagggaatagaatgtaaatatttcttatcagacttatggtctgtgttgatgttaatgttggaaagcataatgaagtatgtccatcccctcttccatcatggcttgaactagcttctcaggttaactctggaatgcccttggccaagaggaggggtccattcagatggggccttagaattttagctgtggtttacaaaattgaggctcaaatattttctaccatctgaatttttctcgtttctgttcctgtttggtgctcaactaaaatgtgagcatttagaattgattttcaggtggctagcttcctggatggaattttgtgtggatatatatatatatgaataatcatattcattttttgatatcttatattaactataagagccataggattaaaataagttggaacagtattctggttttgtcctgcagaaaacgtaagctttggttctggttgccgtgtgacatgatttctactaaatttcactgaagctccacttgaagattgtgtctttttcctttttatttgtgttgattttcattttctattgtttcatgttttaatagtgaggagttgctattctcattgaactatactatactgatataaataaatgaagcttaatacattgcataaaatagtagatagctatattaaataatttttggaaaggaattgtgacctgtagaacttactgactttaagtacagcatgaacataatatgcaaataatgcttagttcctactcataaccagagagttgggaggaaaggaaaaataaagagtgagaaggatttttgaaggccgtggcaaatttagtctgcatgaaaagcagaactttcagaatagaaattcactctgaaaagaggcatttacagagatagtggaggcccctcttatagaaatatttactgttgtttttaacttagcacctaagtatgcttttgaatcataacacttgaatgagttctggaaagttaaatgctccaagactgtggcaaaaaaacctaccagctttcatcttcctcctttccattcccaactttctctagtactattcaaaaactccctaattaggaattcctttgggaaattccaatatcagagttaactagccaacctattattgctaatcatttattcctaccctctatataaagatgaccagcatgtgtgcacacacacacacccagacacacatctccctataccgttttctttttttcgttcattttctttaaatttcccattatactttttaaaaagtaatattgtccaaatttatagcactgtagttcttggattgtttcttattacttttgcatcaagcaagaaatgatattcagaacacttaaagttctgattggtatggtatagaagctgcatttcccacagtcacaaagaaggtcatactccatgttaataccaggtagtatccatcattagcctattagaaggtactgatagtcacctggaattcacctaccataatgatagtggcactggcaaaggcattgtctcatccactggagtctgggccagtccctagcagtgaacattcacaggctgatattcgcagacacctctcatgaactcaagggctgcaaccatggttggttagtcaggtggcttaggacaaagactttttatgtaccttaactattttattattttaataattaataagagcgtatcaatgcataccatctatatatcagccccgggtatagtgacaaatatcttatcttgtataagtactatttttcataccaaatttgctaattattaagagtcttcacagttcacaggatttaatcttggtgaaaaaggaataaactaaataataacaataataatagtccaaaatcaatttgataccaaatcaatcaataaagtgatcagagctttaatgctactaggaaaatacttcagctttaccattttatgtttcatttcaataggcaattaatcaaagttaggaaagagtgagctagcttttctcctggaaatttcagcacaggccctatgtatcatattatttcactaattagaaaaaattttagttttgtgttagtgaagatggcaaagacaaaacacacacgatatttcttgttaattgagaatgattttgaacatattctcaactactattttgcccaagatacttcattctaaaagatgtcatttctgaataaagagcacatgcaataaaattgcatcagaaacagaatccctcacataatattcttacaaatttaacatcactttagagaatagctattgacttttgtaagactttattatttgttcattcatttatttttttattcaacaattatttgggttcatactgtgtgagagaagacagtaagattagaaaattgttacaagagagatatacaaacagggcagtagaataagagagaagagaaagatggttaaagaatcttcactcaaagttatctggtgatcaaaatctgagcttgctaggcaaatggaggagagaaagcacatccccaggaaagggaaaagtttatgtaaatagagagaagtctatatggggtatctgaacaaggggcactaacagatcatacagatctttagtcatacccaggagggctgggtatggtggtttatacctgcaataccagcacgctgggaggccgaggcataaggatggcttgagcccaggagttcaagaccagcctgagcaacgtagtgagaactcatctacaaaaacttaaaaaataaaaaataaatagctatgtcaccagaaaagggctcccaatccaagagaccccaagagagggttcttggatctctcacaagaaaggattcaaggtgagtccataaagtaaagtgaaagcaagtttattaagaaagtaaaagaataaaagaatgtctactccataggcagagcagccccgaggactgctggttgcccatttttatggttattatatttcttgttatatactaaacaaggtgtggattattcatgatttttctgggacggggttgggcaattcccagaaccgagggttcctcccctttttagaccatatagggtaacttcctgatgttttcatggcatttgtaaactgtcctagcactggtgggagtgtcttttagcatgctaatgtattagcttataattagcttataatgctaataattagcttataatgagcttataatgctaataattagcttataatgagcagtgaggatgaccagaggtcactcttgtcatcatcttggttttggtgggatttggccagctttactcaaccagttttatcagcaaggtctttatgacctgtatcttgtgctgacctcctatctcatcctgtgacttagaatgcctaacttactaggaatgcagcccagcaggtctcagccttattttacccaggccctactcaagatggagttgctctgattcaaacacctctgataaccataccaaggactatgagttgcattctgaaattaatgggggctctgtgaacaaaggcagtgagtcttataatcaaatgtatgatttataatgtttctgggaggaaggcaggctggaaataatcagaatggcctgaaaatgattgcaagttttggattgactataaagtaaggtggcatggtggctgaacaatgctgtgctggttgtgtcaatatgagtgtgagctgtgtcagtatgagtgtgattgtatcaacatgagtgtgagcacctgtgggtaattttaaataaaatgtgttgaaaaatacttgatttttattgaaaaattgcataaagtagctactcaagtatagagtgtttgctttcacatatgcatatcatgttacctacatgaggcaaaacaatgaaaataactggatggctgtagaaaggttttggagaaccattagatttttttaatgtttaagatgctgccatctagtgacacttttgtgaaatcactttgcagtgatattcatgtttgtatcttccagttcttttctcaatacattttatattttaataatttatattgtctaccaaccaatggggaaataattacaaatgcattaaacatagtgtagaagtcatacttgatttttcaacgtggtaccacaaatgtggccagaaggattttcataatgggatattgtacataaaggtttgtggtttcttcagtgtgccattctttataagtaattgataatgaaagtgctgctttttctatttcttgagttttcttagaaaaattgagttgtaaaaacaaatctgtgaaaatctgagctgtaaaaattgcttcataaaagttgctttaattggaaatgttgaagagaagaaaagagagtttcaaatttagaataattaacttttttccccatatggaatttcagtattataagtatatcttaaaatataaacaaataaatgtgtgtggaggggtgtgtgtgtgtctgttaaagctaaacattagtctccaaacctaggttgtgatgacctgatgacttctaagttttgatgaagattaattatattcatgtcctattactccttaaacttatattacaatggagcacttgtcttattttcatggtacgtattgctcattttctttggtgaggaacaaagaataaattaatctcccttcctccctcaaaatacagttatattgtgctgatatattgtccttttgtgagatactaactccagtcatactatagtgaatgaggttttaattaattaacttttcagtatattgaggtttctttatgcaaaccaatcctatagggtagaggtaagcacatctttccgtaaagaaccaagtagcaaatattttaggctttgtgggccatatggtccctgttgcaacaactcatttctgctgctgtagcgtaaaagcagccatggacaatatttaaacaaatgagactggccgtgatccaaaattaaatttacagaaacagactatagtttgcatgtctcttctctagggaaaacacctgtatttgtaatttggggttctttttttcttaggaagtgttagaacacttctaaaatttatttaagtatttacttcaaaaactttaattccattgagagttgtgtgccttcagtgttccaaaaaatctagtttggagcaggtatgtgcacttggtaaactaatcgtacacatagtaaactacacttggtaaaccagtcatacacaaacccagaggtaaaatgttttgcaaagttctatcacctgcatttagccagtttttaaattcatgttcatgtacaaagttgtcttaatgtggaatgaatctttatattttctcagtaaacattgcaacattttgatatgcagtaagttaaatgactttgatcatcagcaaataaattagaaacttcctacttgggtacaatttggataatatgtattcattgttccagtttgtgcttctgggaatttagtggaaacagagacttgcttttttaacattgtgaattccactaggcagacacacaaaacacttaaaacctcatgacaagtaaataactaaaacagaatggagtcagatcagaagagactcttagggtacaaagtcaatgtgtatgaaggagacagtagagttaatattaaactttgaaattctctcccaaacaacttcattcttcctctttatttttggataagaatactttttaaaaattaagcaccatataaaacagctggctcacattgaggatctgtactgtatcaaagtatgcatattttgcttaccaaatagtattaagcaaggattgttactcttattctaacatgagaactagaagaactcacgcagtaactgatccaagcctccatcttgtgatcctttggtatcttgtactctttaagaggaatggcaggggtaattcctaagaccaagtaaaggatgtcttggtttttgggagctgagtatatcaattcactcttcccttaaaatgctgtgtaacaaatcatcttgaaacttgttgtcttaaaacaataaccattgattttatggatcaccttggcatcagagcatcaaggtaggacttggctggaggggttctgcaagtctcagctgagctcattcatgtttctgtggcaaactgcaaggggtgaggagggcatggaggagcagctgatccagattgagttcaggtgaggatgattatgctccacatttcttttatcttccatctgggccagcagtttggcccaagcaagtccttctcatagagatggcagagagcaagagggagcaagcttagtcactcaagtacttttctgagactatttttattacatgtgctaacattctgttggtctaaacaagtcacatggctgatcccagtggctgaaacttacaccttacccacagtggaggaactagaacttacatggcaaataacatgggcgcaagagagggcagagaagcagaaccattgatagaatttataacagtgtatatacttgaactgattaaatatgcacatgatgtgggattaaatgctaaacaagaaaactattgactctttcatattactaggatacacttaagcagcagttcagaaactttttagaaaaggaaaccttttacactcttaaaaaccactgagggtcttaggagatttgacattggctctatatctgtatttactgtatttgcaattaaaacaaaattttaaaatgtatttatttgttttagaataacaacaaatgcattacatattaacataagcaaaatattgttatacaaactatgttttctttaaaaaacagtagcattgtttatatatggcaaatcgtattagcacctgacttaataaaagacagctggttttttatacctgcattcaatctctttttttctctttttgaatcttacaaagaaaataggcactcatgaagatatgtaatcagaaaaggcaggagtagttgaatagcctttccgtcaattttgtgtattctttgatactgcatcagaatttgacaagtgagaactttttaggagttctggtatggaatttgaagctgaatcactgaactttctgtactttattatattaaaattcattgactgaacttgcattttgaatagatcctttatcaatgcacaatatgtaacatcgagcattggccattcagaaaatattggttcattgaattatgtgtattttccaaatattgacatatttaatcatataataattagaaattatgtattactactatattcatcagaattatctcaataatgggagctagtcatactcatggaagtggatacaagtttttcaatattctaatttcccctggaaactctaattttatcattggcagcaaatattataagttgttttattgaagtgacactccattttcaaaagaatatctgttaaatacatcacacatgtgaatcgtcattgtttgtcagttgctctttcatgcagaaatggttgtccatgatataaaagtggcaggttcagcttgccactcaaataattgcataaatacattgctttaagatagccatcctacatcagaatgtggtcaagggttttatgtgtacttcccacactcaacattaaaaatatagaattaagatattgagatttaatgaaaattgatcatttttacagttttcacaaggatattttcacatgaaactttcccatgcccccaggtgaaaggctggaaccaatgtaatgactactagtacagttcggtaccgctgccttggctcctgctaaggtggcagctgttttacccatcactgcttttgcattatcaatgcaagtgtcaattcagcaaaaaaggcaaagaatgtcttagcatgatgacaattgctttgatctggtgggccttctgaaagggtcctgggaattatggatcatactttgtgaaccattgcatcaaagagcaaaccataatttatggtacagaagtttgtcaaatgttttcttaaaaatatttgtacttattatttctaatcatgaagcaaacttaaagcttattattgtgttcttccctagggttgttatgttggctttgatctagcacatgcagttggaaatgttgaactctacttacatgactggggagttgattttgcctgctggtgttcctacaaggtacaaacgagttaatacatttacatccctttatttcacattgactttaatctgaaggagaaactgggtctgtgggccaattttaaagatttgagttactttccctatttcttttattgtattttctgctttttgttaatcgagttatatgatggaatagtatgataattaatataattctagtatttctatcaatatagagaaattaattcttcaattccttggctgctatgaaaaagtcaggaggttctgtagaaaaatccctacacttaattcaaattgatcatctttttagtttttttattgataagttgtgaaatttctgcatatataaagataatatttagagaatcaacttagaattcatatttgaaaacagttgacagggagcatgaaaataaaaccaattacaatttacttgctttaaaaatatatttttattattattacaatattttaggacaaaataatttaaatgtatgaatttcaaagccagatctcattaaaactgctttctaccagctggagcaaaattgccccgtaaaagtaatagccatttattctcaacctaataatactattttttatttgtttttctttgaggaaggtgacctaagcttctgttttatcataaatacacaaataatcacacattttgaactgatcaaatgttgtggtttcaattaaaaaattcaaatgactacattgtttagttttgtcatatatttaagtaaacccacataatttaatttattttcaatctagtatttaaatgcaggagcaggaggaattgctggtgccttcattcatgaaaagcatgcccatacgattaaacctgcgtgagtaccatcttcagctaattctttggtgatgaacaaattaatttgcattaataatatgttaaatttacatgagttccttaagatgctatccaataggaattaggattggattataattattttcctactctgctaacaacaatatacttcatttgaaatacatgctttccaaagaattcaattggttgaacaagaaatttaatcaaaaagggaagcttcagtgctaaaaacaagtcactgcaatcatgtaaagcggatggtttaatgcaaagagaccacttgaatattttttttcaaaaattagactttagaaaatttcagattcctcacgttgatgaataaatcaaaggcaaccagagctgtgcctaatagagccttaaatgtggcatgttattattaaaattacatctacctttaaagctgtaaatgttacatgatagcttgtagggaatatcttctgtcctaaaagactttataatccatgaaacccgaagaagctgaacactgaacaacagactgactacataaaaagtaatacttttctgttttatagaactcttcatattttagagcaagtataaatgcaaatataatacaccaacaaacttacacatttttatttgactggggaattcataagtgttccttttacttttttctggtatggaaataaagaaataatatgctgggaagaaaaaaaaaaacccttttcatagttgttgtattggagtatgtgtggtgaggagactgtctagactcctaatagataatgtaataatgtttgattagttttctgaatttcctcagccactgactgagtggtaaaatctttacaagaattgaagctgaattagtaataggctttggagcacctcacatttctgaagttctgtgcatataaatcctaggaatttaagatgattttctatagtttctttaattgtgtctaaatttttttcaaggttttaaggttttaaacttaagacaacatttgtcttaagtttaaatatctttggacagatatttagtcaaccagacatcttacttgaatatcattatcagtacattagatttccctccatgtatgtcccaacatctctgagaagattaaaaagcaaatattataagaataccatgttttccacatagacagtatgtaagatattgcttgcttttgtatgatgactcacaaccctggccatttctcagtctccatttatttaaattgaaatagaggatctcatgtattatatcaacccaaagggtgagccagtgcccggatagaaggaggtggggtgggggggaagaagtaatatacataaattctagagaatgtcagtgttcggagttaagctttgacctcctagcacacacaggtcttgtacttgagatttctctcagcatggacaaggaacaaggacaaagggattgtattgtgctcacatatgcctcattttgtggaatttcaaaatcttctagacaatgtttaaatctatgttaagtctaagctcccaagagaaagaccatctaggcagaccaggttcacagttcagcttggtctttcaggggtctgtcacctggagaatcttctatgattgttcagtattctggtctctgagctgaggtagtaccagcccctactcataagcagttattgtgagaataaaatgagatgatgtatgtaaaacactaagtgtatcacttgaacatttaatatggtttggatttgtgtccccacccaaatctcatgtagaattgtaatccccagtgttggagcaggggcctggtgggaggtgatgggacaatggggcctttccctttgctattctcatgatggtgagttcttaatgaaatatagttgtttaaaagtgtgtagcaccttctccttctctctcttcctcctgctctggccatgaaagatgttcctgcctcccccttcaccctctgccatggttgtaagtttcctgaggccttcccagtcatgcttcctgcacagcctgcaaaaccatgaacaaattaaacctcttttctttataaattacccagtctcaggcagttgtttgtagcagtgagagaatggactaatacagcattatatgtgatcaataggtatggggttatatgaaaaaaaaaatccaaaatttacaatatacaggaaaaagatgggtgacattctgtaacaccctagcccaagtattgtttggtaattatttagtactgacccctaagtacttcgttgactcactgagaatgtgcatagtaacatgtagactttgcccagtggagatcatttctcttaagcagaaaatataacctcaaagtttatggtttgtgactttgtaggacattagtttgtaactatcaccaagtttattttagcagacctttgatgagctgactgtagaatataatctccattccttggagatataatctctcttatatgctataagaaagaattctggccttcctaccatcttactgattccgccactatttagtgggttgaatgagatctttcatggctgtttattttgtgtgtgtatgagaaccttgcttttaagttttttggaaaattatatgttattagctgttgttgcattttaacaatttagccatggaaatttatgggacttaaattaggcttgactcatgaaggccacgttaaggaaaaccttggttgtttttctgtttattgttttctcacactcctaagcttctttttaagtgatgtcagtgactgatctcagtgctgtcaacttctagccttggctctctattctgtaccaagtatcttatattgtacttcatttgcattaggagatcggagttctttaattaggaatggaatgcaacagatttggacaagtcaaggacaaggtattttccagtcatcacttcattgtccctgataggaaaagaaatgttttgctgaaacttaactttgtgtcccttagtgtgttttacttttttattcacctgaaaatcaaataccacctgtgagaagagtgataaacaaagaaaagacccaaaagcctacaatatcacgctgctcaaataagtgtaattgttcagatgttacgacaatgttccatacataaaatattgtgaagatggggagaggaagttttcttgtgaataatatttatagttccacggtcaaatccaatttaaactttgagtaaactttagagtctgtatgactactgactctatttgccaattaataattatatttcagttgttagcattccacgattagctggtttaactatgtttaataagccttctgtcatcttacttttctgttctcttagagctttagagagaccaaagagtttttcactgttaaagtgtccagtatgtagccgagaaccatatggagaacatcaaatacagtggaacaaatgtaactgctattgatgtcacactttgtgaagtagtctttgttgcttaaaaagggtgacatctagtggctaaacatgttatttcaaataaataatatcgaaataa

SEQ ID NO: 906 - DNA, 752944 bp, Homo sapiens
ataaaatttgtaactcctttttttttaatttcacaaaagttttcacaaggacaacgttatagaagaaaacccccagcagtggctaggtcatgcagaaccattaattgtcataccttggcccattctattcatccttgttgcactttagagagagaagtaagctatgtgagttttacaatgcttttaaactgtcatatttcctgttgagcactttaactggcacattcttatagttataaatgttctgagggcgtaactttataacctcctttgcaaagaatgcatgaagagctcttcatgatccaatactaggggatacatatatatagttatatatatagttatatatatataattatatagttatatatatataattatatatagtttatataaagagatagttatacataatataaatcaatatatagagggacaaaaataatttgaaaaaattcttccactcatagggcttgataatttacatgtatacaattattccccaccacaatactggtttgaatactacgctgcccctgtctttggtgtgggggagggtggaggttctgactgagcctcaccatttgtcagtaaaagtgcttgtcaattcacacagcaagcaaatatccaaaactatcatgcttgaggggacgggggatccaaaatctaaatccaaaacattcaccataaaaacacctttttagagatggtacagctgtgacatgttttcctcctcccttttacccctattctattcgatggaattctttgaagtaaaacttttcaaatatgtatataccagcctagtccatccataagggaaattggttatggtgaattggccagtttttaagaaataccgcactgcctaaagcatgatttgcatgcacaaagcatctgacaactatatgttgaaaaaagggtatttttctacctctcctctcatgcttactaagtgttaaaaaagaaagaaaacaaaagaagaaaaaaataactataccaaaatgtgtttggctcactgttgcactcttcttatcccacgtctcataatgacaaggagcagctctctattgccgtcattaccctgcctaaattggctacattaaagaaagtgatgatgaggaattccttcccaccagctttctgcattgggacagccagcaccgcacagctgtgccaacagttgaaggtggtggctggcttttgtctttgttgagtcaactgtggctgatcctcctacattctaatttatttagcatgtcggctcctagaaaagcatgatctgcagctgggtttgtcttcctctcactctaccattgccccagcccttcctcctacctggcattggggccctaactaatcaaacaaaggggagtaaaaagatcccctgagaatgcatggaaaaatacttgctctttcctgagcattatttattctgtacataaggtaagtaattcaccttttaaaagatgtaaaagtcccaggaaggcagtttttaatgacttacatctgatatttatgatacatatggcttttcatcccaaatgtcaaaagtgaaagaaaaaaaatagctattcatatggcaacataaggagacagaataacaatttaatatgcaatcaaacctcttttcacttaaactaaatgactagaatttgatacatccatgattggaatactattctctcctccatattaaggtgagaaatgttcataagaactcccagagggaactggctctgggacaaaaggccttggtgagtaactaaaaaaatcactgatgttctcttgcaacaagcaggtccttcataatcatctacacaaatcgtgaaagcttttcaaatgcttcgcaatacttcggcccagagactggaaacaatcaatatgttttcattgctgtttggttgcttgtttcaaataaacatgtgctaacttattgtgtgtataaaaaaagaaagaaaggaaaacaacaacaacaacaaaatcaaaacccaaagcaccctgataatcctgataaatcagaatcaacttttcttttacattaaataaacttgctctgcctaactgacgttgatcacaagtgctcccttctaatctgtgaactcgttcctgcagtgagctatttatgtctggagcatgcctttgggttatttttcccccagaatcataaataacttttggtccgtctgcttatttgctgttgtgctcaagggttttatggtggtgaaataaaaatgacaaccacatgcacactatcatacatatgcaaatatgtgtaaaaaaaaagggggggactacaggggaaaacagggaaagttactttgttggaaacaccaactggggaaatgagtggcagatacagtttcacacagtggcggtggatacacatatcaaagccgctcttcctgcacgtacttctgtttgtcccgggactccctggacttgggccggttctgtcggtttgctgtggatgggatggagtgaacagaggagctcttcttgctggaggactgcgacgagtgggaggaatgggacaggctggcccgggactggccggcattgtggtcaaactgcattaagcagaagatcaggtccgtcggcacgagctcaaactcatagggcgggttggtgatgacatacctggacagggaaagcagagatgtcacctcctgagagtaactgagtaaagaattcaactctctctgaaccaaaagcaatggcctggttactcaggactttcagaggatctggaagatgcactcctagctggtctgaggccttaaacattctttttcttgttaaatggaaacttcctctgtttaactcaataaaggaggccagccaggagcccaggcagagatgtggaattagagccagtaatggaagaaccaaacttcgcttctcgtggtctacatgtacctttctatacaaggtcaaagtcactttcaagtagcccaaccgcaagaggtttcatgaagtgtgatgcaactttcatttcataattttcggacaatcccagatatacatcacaagatctttgtttaccatgacagagtgtctccttagactattctcgctctttaccttttaaaatctactttggtgagagaatttggaatttggaattcaccacatggaagaatctaagaaacctgcctacttatcagcactactttgttgttcttcacaattagttggagctttctttggtcaacagcagatgtgactaagaaaatcacgctgtttcacttagagcagtggtcaccaagtgtggtccttaggccacacaggtcagcatcacctaggaactaggaaatgcaagttcttaagcaatcccacccagacctactgaattggaagtgctgaggatggggtccagcaatctgtggttgaacaagctctgcaggtgagtctcatgatggctaaattttgagaacccactggtctatagcaattgttctcaattctggctatacactataatccctggttattatatataaaatgtttacataatttaaaatatatatatgatgttttcttccttccagaccagttaagttagagtaatcagaatattttttaaaagctccccaggtgattctactatgcaagcagggatgagaaacgcttgtctctgcagcactgttgcctagggtatattatgcaaactcactgatcttggtaattctaggatgtacttttaatttttgcctgctatgaatttattttaatgcatatgagaaaaatataattggcacatctaaactgttatttctctgcttaaggtgataatatataattgtctcaaaaataaatatataaaagttaaaaagcgagtcaatttaaaatatgtgaagtaaaaatatgggattctgagatatggcagaagaaccacttatcttagggcggggtgtggtggctcacacctgtaagcccagcactttgggaggccgaggtgggtggatcacttgaggtcaggagttcgagaccagcctggccaacaagccttctctctactaaaaacacaaaaattggctgggtgtggtggtgtgtgcctataatcccagctactcaggaggctaaggcaagagaatcactggaacccaggaggcagaggttgcagtgagccaagattgtgccactgcactccagcctgggcaacagagcaacactccatctcaaaaaacaaacaaacaaaaaacaaaaaaacaaaaaaacttatcttaaacactagcaatgtaaaatatctctatattaggtaccaacagatgttatcctagtagctagagtttgggagagatgtttgtgtattcagacttttgtaattaggtgatggaattattctattaatacaaaacttgaattcttaccaaaatgtctttacatctactattagtaattatagaaaaatgcttcccatcacctccaaactcagtgttggatttaatatgggcagagtaatttgcatgttgaggagatgtatacagacctttgcctttacagtaggggacaggaaaggatattaatatttctgtgattaggtgggagggcagagttgaaaccaatactcacctctttgtgcactgactgggggtgctgaggtgagcatctctcagccggtaaattccaaaacaaagcatattatatgttttcagagctttgcagaacagatcaccataacaaccaccatcctgggagacagcaaaagaacagagagaaacatcctttttatttgcctgaaaatcaagggacagcagggaaacgggtcttttcatcaaagcttgttttggtgtctcccaagttggagggtccatgtgccaagggacggcagtggaagaagtcaacatgtttaacagactacacccaatatgtgtgatttttagggatcaggtaacaatggggttttcctctggtgtctctccagttttccacctgtcgcagtggggtttgaaagctctaaggagattatgcttctccctcactttaagtcaaagtgtaaagcttgatggtctcagatgtatgctcagctgaggagatgaacccttctctgcaaaatggtgattatgttcagtcccagctcagctgtaaccgctgtgataggctcgtgttgtcaaaactgtctgagtgataatgaaaaccaccgcaaggaggaggaccccaccaggtcctatggtgacagactctttcaggaggtaaggaccctgtgaaaagcacaatttacagacctcagagatggcaagggtgcaagagaatgtgtttccctaggagccaggggtctgcaggctgaataactaggattcgcagttctgatcagttcacagccaccttcccggggtctggggcctgatgcagaaagtgaaagcaaatgcatccacttggaaatgctggcttcagcggccaggtggcttcaggtagatgttacctgtattatatgaagggcactgggcactgcgggatggcttcactgggtataaaatgactgtctttgtccttccaatcattggaattctcatattggtctcataccaaagaacactgatgggaccaaatcttaccattatctaaagtctttatcctaatcaagtgcatcaataagtaaatgataggtataaagagccactagctatgaaaattccctttcaaaaaaagcctagtctaacataggtcccagtccatgatcaaactaaaatatggggaaagtatgcagcactgtttcagaaaaaacagagacagaccctttccttggctccttttccactatttagtctttctgggcgacaccattgtttgtgtaacaggtttatcagtttctgtgacttatggctgcatctcttaaatgcatctgtggggttgggctgggaataagggcaaagacagcacacttctgtcacagtgcctacactaggcagatacatggaatcagaagggagacgctggccacttccgtcacagggaggacatgagggaacgtgactgggtccactctcagaaattacaaggtctaggttttgatttacaggcattaaaggatccacataagattcggtttgtttggccggtggttctggatacatctgactactgactaccctggtgctttgaaaaccaccagtgcctgggtcctattcacatataaaaactaagaaacctgcaggctgaggctggccacctccatgtgctattaatgtatagttgggttgagtatccctaagctacgctaagagcctgtggaaatatttcccaaccttggctgcatgctggcatcacctgctgcttctcaccttgtgcagaggatacgtgaagagaacaccaaggagggagaaagcccactggctctgaagccaggatgccttggtgcaaattcccaataggtctagtgctcattctctctgggcctcagttgacttagaaggtgtgatactagaacttatatcaaagggttgctatgaagattaaaatgaatgactatgcatagagcaaagtgtctgatccagagtaaactataaataaatatcacctcttacagttatctacaataggaaggagaaaagccagatgcctagcttgtcacatctgataccacgttcttcaggatcaagcttttcccaaacagcaagctcaggtgacctcggtgctgtggactcacccctaagtccgcaaatggcccatcgagcagagctaactgggccacgcggcagcggtccctattggccagtgtctgcggggtgctgtagccacctctaagggcgttttcctcagcaatcagagcctccagctccggcgtggctcctccggtcaccagggtccgtatcagggtgaggatattgtcattgaagtacgtctggggaaggagagaaagtgagggaaaagtcctttaagcaaacaccctaaagtcatgacagccgacatccaaattacaacttttcttggtatctcctgtttaaagttctggcctgtctcttcaaataatttcatgtggggagtgaaaagacagcagcctccaattattccgttattttctctcttgcttggctctgctacgacagcctgacttaaaaaacccagttcaggggattttttagtaaagggctcaaatctgaataattagtgtttgccataattggttttagtagggatacaaatattgcctccccctcctaaagtctacgtgactactatgagattctggacacgtgtaataaaatgcagcctgccccagctactaacccaagcagcattgtctctgaggccctgtcatccatgtgccaggaagcttcctccccacgacaacggcaaaacctttcattaatgccacacgcttaacgatttaccacatgcgttgataactgtctaactcagaaatctcgatcaattaaatatgccggataaatttatgaaaaggtgaatgtcctggtaagtgtactttggcttttgttttctaaaataacctcagtagtctgaggcaaatatcacttattaaagaagtttccctctaagtgtacatttgtgtcacatctgaaacataacagatctgtcaggaacaaaagaatgggagtttaaaaaaaattaataggatgtcaaataaaggagctttaaaaggtatttgtcaccagcctaatttgagaaattctcaggtaagggtgtgcattccattttcctatgtaagtagaaatcaagcaggctaaaaaactcaaatcaaagtttgcctgtggcttttgaggatgcactttggaaagaggtaaggaaagatgcaattgcacctcagcagcttcttagagagtttagctggcaaggcatagtagggaacaaaccaagtaagggtgagctcaagttcccatcccaggtttgctaactagttctatgtcttggaggttgcctagtcattctggactttgatttttctcgtctgtaaaataacagtggtcattaaaaccaaatttatattcacataattccatgaggacttctgaattaagatgatagttactagcggggctggattcacaatcctcattgaaatacttacaaaaacacccattgtgatacaaaattccaactgcaaaagaatttaggaatgttatccatagcctgccagaccctaaaggaaatttatgctcagagttaagatatgcccttaggcacagaagcagaaaaaggatacttaaagtaggatatgtttctggagaggttatgggatccagggatccagagctgggctgaggggtttaatgctgacttcacctctcagaagctgtgtgaccttggaaagttatttaacatttttgtgcctccgtttcatgatctgtaaaatgtaataatagaaggctgtggggctctatgacctacccatgaagcacttagaaacatgcttggtgcacaggaagcactgataaacattttggcctcatatcagagacatgaggcctttgccaagtagaggaacagtcagctccattctcaactttcctttgaatttttaatcttctttgttttcttggaggcgtggggaactcagggctttaaaaaccaagcaagggattttaaactcgatgtggtagaaaatgggaggtcagccaagcatggtgcacacctgtaatcccagaactttggtaggccaaggtgggaggatcatttgaggtcaggagtgaggtcaggagttgggaccaggctggccaacgtggtgaatcctagtctctactaaaaataaaaaaattagctaggcatggtggcgggcacctgtaatcccagatcctcgggaggctgaggccagagaattacttgaacccgggcggcagatgttgcagtaatctgagatcatgccactgcaccccagcctgggtgacagagtgagattctgtctcagaaaaataatgaataaaatacttagaaataaatatattgaaggaggaacaagactggtatactgcaaactacaaaatattactgaaagaaattaaagaagacctaaataaatggacagacatcccatgttcctggattagaagacttgatttattaagatggaatactaccttaatttccagattttatgtaatacctatcaaaatcacaaagtccatttttttgtaaaaatggaaaaattgactctaaaactgcaacagacccaaaatagccaaagcaatcttatagccttataaaagaaagacgaagttggaagtttcatacttcccagtttcaaaacatactacaagactatagtaatcaagatagtaatggcataggatagacctatagaccaatggaaaataattgaaaatccagaaataaactcattcagttatgatctattaattttcagtgagtgtgccaagaccattcaatggagaagttaatatagtcttttaaacaaatggcatagcaacaactgggtatccacaggcagaagaataaagtgggacctatacctcacactatatgcaaaaattaacacaaaaggggtcaaagatctaaatgtaaaagctaaaactgcaaaatgcttagaagaaaatataggagtaagtctttatgacctttgatttggcaatagtttcttggacatgacacaaaaagcataaactacaagaagaacagattaaattggacttcataaaaatttaaaaaatatttgttctttgaaggacactatccaaaaagtgaaaaaaacaacctacaaaatgagagagcatgtttgcaaatcatatgtctgataagggtctaatattcagtattaaaaagccttttataactcaaccaaaaaagacaacccaattttttaaacgggcagaagacttaaacatttctccaaaaagatataaaagtggttaataaacttatgcaaagaggctcaacagctctagtcatcagagaaatgcaaatcaaaaccacaatgagatattttacacctactagaatagctgtaataaaaaagactgatgataataacaagaattggtaagaataaggagaaactggaactctcacacactgctggtgggaatgtaaagtggtgcagttaagggaggagaccacccctcacattgtgttatgcccaatttctgcctccaaagaaagaaaaagtaaacattaaaaggcagaaatgaaacccacaagcagatagcccggtgccacaccctgggcctggtagttaaagactgacccgcacttaatcggttatgttatctatagattacagacattgtatagaaaagcactgtgaaaatccctatccttttttgttccaatctaattaccggtgcatgccgcccctagtcacgtaccccctgcttgctcaatcgatcacaaccctctcacacgcacccccttagagttgtgagcccttaaaagggacaggaattgctcacttgggatactcggctcttgagacaggagtcttgccaatgccgctggccgaataaacctcttccttctttaactcggtgtctgaggagttttgtctgcagctcgtcctgctacacagtcactttggaaaacagctaggcagttcctcatatgtttgaacattgtgttgctatatgacccagaaattccactcttacagtatatacccaagataaataaaaatatatgtccatatgaaaacgtgtacacagatgtttatagcagcattattggtaatacccaaaaggtgaaaataacccaaatttccattagctaatgaatgcatgcacaaaatgtattatatccgtgcaatgagtattatttggccgtaaaaaagagtgatgcaatgatacatgctacaacatggatgaaccttgaacacattgtactgagagtctatcagacaaaccacctctgataattcaatgtacattcgtttctatttccttaagtgtcggccagtctgagaaataaagggaaagagtacaaaagggagaaattttaaagctgggtgtctgggggagacatcacatgtcggcgggttccatgatgccccctgagccgcaaaaccagcaagtttttattagcaattttcaaaggggagggagtgtatgaatagggtgtgggtcacagagatcacatgcttcaagggcaacaaaaggtcacaaggcaaaaggtcagggcgagatcacaaggtcagggcaaaactagaattattaaggaacttccatgtcctgctgtgcaggcgttgtcattgataatcatcttaacagggttcaagagcagagaaccggtctgactagaatttgccgggctggaatttcctaatcctagcaagcctgggggcgctgcaggaggccagggagtgtttcatcccttatctgcaactccataaggcagacacccccagagcagccattttagaggctcctcctgggaatgcattcttttcccagggttgttaattattaatattccttactggggaaagaattcagcaatatttctcttacctgttttcagtaataagagaaacatggctctgttccacccagcccacaggcagccagactttaaggttatctcccttgttccctgaaaattgctgttatcctgttcttaaggtgcccagatttcatattgttcaaacacacatgctttagaaaaaatttgtgcagttaacggaatcatcacagggtcctgaggcgacatacatcctcagcttacaaagatgatgggattaagagattaaagacagacataggaaattattaagagtactgattggggaagtgataaatgtccatgaaatcttcataatttatgttcttctgccaaggcttcagccagtccctccgtttggggtctctgacttcctgcaacaagagtctatttatataaaatatccagaaaaggcatgtctacagaaataatgagtagatcagtggtggcttagggttggtgggttgatgggtggagttgtaggggagggtaggataactaaaatacaaagtttctttttgatgccatgaacatgttctaaaattgactgtagtgatggctgtacatgtctgtgaatatgctaaaaaaaaaaccactgaatcgtacactttaaatggatgagttgtatagtatgttgtgtctcatttttttaaaataaatagttaaaagacaactaaatttgcactggccaactttttaatctaaggagccatgagtattagaggtgaaaattacacacacacacacacacacacacacacacacacacaattagtgatacggaagtaaaaccaggaagttctaagctaaatagagaaagatatagggatttttgtttgtttgtttaataagagtgctggttgatattgagaaaaagacaacaaaggtcaagtgataaacagtaagtatttacaaatcaaagttgtaaacaaaatgcaagcgtgtaaaacaagcaaacaaacaaataaaaataacctgtcctgagctgggaaatgaatctaggatgcagatcaaaagcattcagcaagttaatgtggccaactcctagacctgtactcggtgaatatttgaattcaaaatattaaatggagaataaaaatgacctaaaacaatgctgtaagaaatacaagtataaaataaggctaggctgaagcttctctagaaaatgtaagaggaatgtcaaaggaattttgacaggacacatttgttccaaaaattctacatatagttaaattgccaataatttgtgaaggcaactgaaatattttttgactctttgcgtacataagcatttattgatttaatttttttaaatacttagaaacaaaaattagcttctttaaagataattttaaacccttagtaactaaaatatgagcaaatttggtttactgttaaaatatatttaaaacagaattgtaaaagattattgtatatattattacaaaatggaatgcaaatgtcaaaactaattattaaaaaaatgacaaaactagctattaatatagtattgctaaaattatgttttaaagttagaaaaatgagatgagatagagatgatgatggaaataaaggcatgaaaattgcctgatcttatacaaggaggaatcaagaactactaaatttttctagacaataatacttagaaaatacatctatagaatggctggtaacaactaactagagttaaaaatagaatggaaagtttacactacagaaaataagcatacaaaatatagtccacataccaaaagatggatcataaaacatataattatgatagaagcatgtaaaaaacataatgcaagactatagcatcttatgttatataactaaacataaatgagctaaatgatcctataaaatggcaaagattttcagacttgttcaaatgccaaaatcaaactctgatatctttaaaagagaaaaagggaagaaaaaaagtatagcttcaaagaaaaattttaaactattatgttagataagttaattttatattcatagttgacacaataaagctataattttttatggacaaatattataactgaaatatagaaagcaaaactaattagaattacactagaataaatctggactaagggtaatacgtgaaatattcccactatcactgtttttagcttttacaggccaaatagatcaaaagataagaaaattgaggatataatcaggttgatttagtgtatttttactaaactttgtaacaacgattacaaaaaaaaaaatcaatggccaaaaccatcaaatctcaatacatataacaaagtataagctgtataacctacattttaaaaattaaatacaatgtaatagaggcaaaagtaaatattccagaacatcaaaaaaattttgttaagtatcctataactactaggtcaagatggaaatcaaacttagaatatgaaatattttaaaattaaagaatatttgagaatgacatataaaaatatcatgtcttgaggccaatgctatagagacaaattcagagcctttaatgctattattaaatacaacagaattataataagtaaaattaagtattaaaagaattctttttttaaaaaaaagcaggatgaaaagtgtcagttaatgaattagcaagaggatatttagtgaattgttaaattcaagaaataattccttgaaaaaataaacttatgacaatataactgaaaaaacacaaataaaattagaaataaggagaataaaatgtcagatacataggagaattaacagtattattccagatactctctttaataccaatcactggacgtgaataagaatcgctactgtttttaggcaaaaagcaaagtagtaatcatctatgaagagacagaggagagtattaggaaaaaaggaaaattccatgttccttaacatgtaaataggccatttaatgtcattttttccagtaaaattgttgtttgacatatgtgtaattgcagatttgaattggactttttaaaacttgataaaattatgctaaatttcccctggaaagagttgtacaaaattgtcctctcatgtagtatagtaaattttaaaggtttcctaaccaaatattgtagacaatgtgaaaaattagaagatcaaccagaatggatttatgagaaccatagcttagtagttataagaccttaatacaaaagttggcaaatctggctcttgggccaaatcttgctctgccatccattacttttttaaaataaggttttgttgggacccagccatgtccatttgtttatgtattgtctggggctgctttggtgctaacaaactcagagttaagtagttgtgacagagactatgtggccctcaaaggctgaaaatatttaccatctggctctttacaagacagtttgctgatccattccttagtataacaaggaaagcattgcataccacagggaagggattttactcaatgaatgatttgggggaaactggctctctgataaaaatttttcaacaatatggtaatgattaaacaatggttctttgacatgactcatattgtacagacatgaatattgtgctttcagataatatttaatggcatggtaataattatataatactaaaatgttttttaaaagtaggatccccaaaacaccatgaatcacaattcatgttaaaaatgcatacctgcaaaactattggctagggaaattaactttttctgtatttaaaatttaattttaagagtacccacttttaaatattgaatctttatggtactgggttttaagttttaatattacttttaattggctttttcatactaatgattccttttaatgttttcaattatcatatgtttataaaatgtagagatcatttttattattaaactttataatgtacactgtttcataatataacaaatcatgcacttattactttttgaattattttttaaatataaatcttcaatgtttaatggaaagttatcagaaaatgatatcctgtttattattatggtcactcatttatttctaccataaagtattacaaaaagtacataatgctctgatttggggacttccagagggaaaaataatgcatacctgaactgatagacgtatttatgtgaaagtaactgtaagtagtacacaaaatttctacttagtagttaattcttggttttagaatttggggtttttttcctataattttattttatatattttctgctgtgaaaatacatttattttaaatttctgtaaaaaagaaagtaaatgttactaaatagttaaaggcaaaaaatgtagccacaaacaacttcacaaaaatatagcaaactgtttaatctcaagatgcttgatagttctcatgttcagcatgcactttttatgcataaaaactgaattcactatataaaatatgtatttacatcattatatacagattaaaaactgatatgcttcaaaactatcataaacacaattaaagggcctcctaggaaaaatgacaatcggcatttgccataatgtatgagatggctcagtatgacgagagtgtggattggtaaaattgtttcttggagatatcatgacaatatgtatcaagaaattttaaaatgtccctatttgttaaaaaaaaaaaaaacccagtacatttgcctcaatataataagttgctacttgttcaaagatttatgtacaataatttttattacaggattaatcattgctataacaaaaattttttaaagctaaatagccaaaaatttagtgataaatcgattctggaacatccacagactggagtctcataaagtcctatggaggctctgcaaatcatgacacctaaggaaataataaaatactctggataaaatattaactgaaaagggaaaaaataaccaacctataaaatgagataattctgtatttatccatccatttagaaggaaagacaccaaaatattaaccatgcttatccttggtgttggaaacataggccatttatattttcttctttatatgttttctttttatttttatatgtttcttctttatatgtcttcttttatatgtttctgtgctttccaaattttcatcaagaagtatgaataactgttctaataaaaacacagtcaattttttttaaacaaagggcactataggttatccattgcaatgataaatctagaaggtcaggctgggaggttattgttttgtcaaatctttgggatttgaccctaacatgttcccacttctgtgttgaaatcagttatacccaaatctttttgatcagtcactgacatttattgagcacctactaatcgttgggccttggtttagcctgaaattgtgtgaaagtcaaagagtgcatgacttttagaattgctcatcaacaggtacaatttcatagtcagtcccagggtttcacaggtgtctgaacaactctgggaccactcatatctctgagcataattgtctgctctctgagctggcactgcatcccagatgatggctctccttgatttttccatgcaggcatccaggagcagagctgtggggcagcagaatctgtgatgacagagaatgatgatgtatttttgccagcagatgcttttgctcctgttttgataccccaatattcggatgcagaaaaggactctgagcattgctgacgggtgtgctctgcacacctatctcttcaggatctgaataatttggtggaaagacaatgccttttctggaaaagggtgtcaggtcagtcatattggaggatgcaaatttccttatgtgatgggagtgagggttggggtagggcacttcacggagcattcagcagtctgcaattaagcatcactccaaggctttctgcataggtgatggctgtttctgcatcatggggcaaaccaggtgctagaacttcaaatgccaattaccaaaggcgcttcctgcggaggaaacctctctacaactcacctgacccagaaggcacacatttttttctgggttaacataaatgctaaaattgaagaaatgaaacattctaaaggcaggatcatgtaggtgagatcctttgcctcctaagcttttgtcctgccagtcttttctgtgccttaccatgatacctgtgctagaagtcttctgggaagctcttgtatagaacctccaactctggcagggttagtcttcagggatgcttcaggcagagaccttctcaatatctatccttgcgtcacatgggcattgagtataagacagctgagttagggtcctgttcagagcctgggatcagggaacccgcatagtctaaggaatacaggagtccctcttcccactgccaaggacaagtttgcaaacctgactagcgaagcccttcttctgattaaggcaacgtggccccctggttatgagtacagatttccaaatccaattagtgtggcttttaatacctgctttgctatccaataggcacaacaatgaaaaagttgcctaacttttctctgccttgaattcctcatccatataacagagatgaaaaaacaaaacaaaacaaaaatttatagattagagttaaatgagaggatttgtgaaacttctgatagacaaagcatactcaaaaaatgggagtttataaaaagaaccatcaactagcaatgcaaccaatttagacaattccctctccgggtgtctcggcgttctgattctaatctctgagagctggctcagaacacaagggtggcccgcttggcctctaaagtttgatgattctcaggtcctgtaaaaggacactgaggaaaccatgaaatgccaggggagggaccaaggcactgtaacagggaaacctgagcccacagcgccatctagcccgcttggcccacgccccgctgtgcctgcaagtgtaacccgcccaagcatcctcctctttttatttttttaaagtataattaccggagcttatgtttcacagttaatgctgtcaagccttttaaactaattggtcttttatagaaaatttaactgaaaattaacacatcttttaataacattgccttaactttaatggctctctgcctttcgtttataattgctctaaaattgtcattttccatgtcatagctgccattttttatatttgctagttttcatggtgtagatttttatttttagtatttttctttcgtgagggatgaaaatgattggatttttttttccctaccccaggcctgcctggcctgatgtgacagcagtggtctgtcctgagtctagcaggacatacctccatgtacccgactgacaccactgctagctcctctgcctcgggacggccatgtgccctctgtctccgtgtgagcagttgaaatggaggctcttgagtggagtgtaagaaatagggttatggagcaataaattgtttatgtaactaaaatcacatggcattaggttagcttggactgatagagaactcaggcctctccataacaccaggttcaagggtttggcccttaatgaaagtacaggaaagacagtaaatcatgtgaacccacattccagacggtcacaccctccagtcttactgatataacttcgtttctggcaaacaggccagctctctgatattaaagatgagaacatggaatcatatcttctgggtaccccaactcatctacccactaagctcccaaatattatctaagatgtgtgttcatgaaagagagaaagagagaggataagtgcacacaaacacataaatatatatacatatatgtacatgcatatataccaaaaaaatctgcttctttgtaattacatgtgatcttaagaaatacgtatctgctctgtgaaagatttttatatgcctttgccattctccaattagcagaaagtcataaggagtaacatcattcccatttaacagtagaaaaaatgtgcaagggctgccggtgagccaggaccagaagctacaagtcctaattcatggcccagtttccctcctccaagtcactgcctttgttctgaaaatatgaatgcactggacatgcaaactcctgccctgggcattgtggtgcagtgggcagagcaaagacacacctgccttaactggctcacattgaaatttctctctagctcctgggggatcctgcgcatgggtctctccataggctggcattcacgcttctcagatgtatcgtacactagcaaaaggggcctctgcttttctctgctctttctcttaacactgttataatatgctttttctttatttttccagattaggtaggccctgcaaacctaaagcttcattaaatcttgttttctaaaaaaaaaacgacaacactcccaacttgtgtgcattggaactcattagctcttgtagtagggttcccctttttctcctcagaaggaggtggctcctcactgctccttcaataacgatggttcagtgtgattggtatctgtttaggaaaggtccaaggctcaaggaaaatggacatcatgtgcacaacctcctaactcagaggacaagcaagtgaccggaaggccaaggatgctgtctgaccacagacattgcaatgcagacacataagattagaagcaaaacgcaggaggctggtaaggccaggacagtgggatgaaccaagcagggaagggacatgaatgaagcaggcctggtgggatacaatagagagtagtgtggactgtggctaaagggagcagctgctcagctcaagccaatagctgctttacgggaatctgggactctgccttctgactctaatttaaagaaggcaggaaccccgattttatataaaatcttattttaaaatattggcaacaaattcaatttaaaaataaaaacttgataaatgcagaagttgtctgtggggtagatgtagactgcaatgtgacatttcgagacttctattacagatcttttattagaaacaagatatcaagccaagtactatgccaatatattgtgctatttcttcttctaaaatgagtgcatgaggatggggtgttggacaaaaaaataatcaagggttgcgcttcaggaatcaactcagtgatgagctcactgtcctagccagcgtatccagaaacagtggcattaggaggaagctggtggctttcagaagaaggaggatcctctcgccaagtctgaagtgtctcattccagacttagaacttggccagatgtggtctattgtactcggaatactcagtgtggccagcggccttgccttcttgattgccttcctgtctaccacattccaaccataatggcctccaactgcttcctccaacaaaccaaacccagcttgtcaccactgtgcagctttggcctttatagtgttctctccctctgtttttttcagtgtcagcttcaatgttacctcctaggataattttactctgaccactgagggtaaaacaggtctccacacccattcaagctatttcatgttcttcaaatcaattatccttatgtgacactattcatttattcacttacctatttactcttaacccactagaatgaaagtttaaataacatgaaggcaaggtcttcatccttcttttttacaactgaatccgcagcatggggaatcatgcctggtgtccagtaagtgcccaataaatgtattgattaaaaacactagcaacaataaatacatacagagcttgtcaagtgctaagcaccgctctaatcgctttacaacctttacccatttactcatctctgcaaccctgtgacataggtactattactatcttcattttaaagatgagaaaactgaggcacagggaggttaaggttacccagccagtaaacagcagttctggaatccagatctaagccatctggcgcttgagtccatgtccagtattcacttttcagggtccaagtggagcttaagttggggctggggttgggagaaagtgatagctggatgaaaaagaaatctgaatactcatatgtgagtctcatccctaaaaacagagaggattcctttcacctggtgcgactgtgtgcatcaagatggtatcattctgaaaaatacatttctaagttgtgatcttcttagagacatatatccaaaaacctaattattccctctcatcctgtgtttctgctgttgatttgtgagataaagccacagggccatgtctgtaacatcctgatctgttccaggaatgcctgtgatgaatcaaaatattattcttttaacaaatgaagcagtaagcagcaggagttgggttatgaaggacaatattcagagaatgtttagacacatgattaaatgacaatttggggaggagcgctagaataaggagactgtcaacagctgaagagatttgtgtgtggatgttgtgatgttgcttatgagtgaatgcctgcaatgaaagtttacctctgtctcctgctgtttggaggagtctcactttctcaatttatattcatgacagccctttttgttccttctagttactgccttggcacttgactaatctgttttttcatacattaaggttggggtagaatgcaaagaaatcacaggtaacattttaccaaaacgtctggatccaactagatttgtggactcagaccctactcaagacctcattatgaagcttgttcatcctagacaatgaaaacaagacctggaataatttgataggcattttgattaatgatttgaaaagttaccatcaatgacttacttaaatatgtcttgcttcaacacttaaaccaagagtattcacattattgtccaaaagattcgatagtgtagctaaagtgcctcgcacagttctgggcccttagtaaatgatgctcctgatgataaatacaatgacagttaccagattcctgatacccttttatcctaggctagaatgcagaagacatgctgctcccatactattgcatccaaacatgccttagtcacactatcccaaacatttttgtgtgcatttcaaaggagatgagagatggcttgtttaaaaatttcaaatcaattcactttgaattctcatttgaatttccaagaactgactacctactgatgatatagatgcttgtgcaactcaaatccagatgggcccccacctccaccctgtggctaccatatgcccctttggctgtgttgaaaagaagttctccagtgctcaaaccgattttattccttggaaccagggctggtttcatgggtgttcagcctatgtggttgcacagggctgtactcagacacatctctgttgttttattttattttattttattttttgagacagggtctcattctgtcacccaggctggagtgcagtggcgctatatcatctcacagcaacctccacctcccaggctcaagcgattctcaggcctcagcctcccaagtagctgggattacaggtgcacaccaccacacccagctaatttttttatatttttagtagagacagggttttgccatgttgcccaggctggtctcaaactcctgggctcaagtgatctgcccacctcggccttctaaagtgctgggttacaagcggtagccaccgcacccagccccaagtctcttttgttttaatactctgctgtcaccattttgaaattcttaataattcatgaaaagtgaccttgcaaattatgtagccagtcctgctagaaacatactaaatatctgatatgtagaaacataaacaattttataaatttggaattttaaaaatgttatcagagtattttgtagttctgaaaaaaaaattctactgtaaatagtttaaccagctcttagaacagtcttctgagatctctgtaattaggatcagaactaaaataaaaatttctaatgagatgaattaccaaaatccatttgaaactggatttgcagaatatgaggcctatgactgagaatatggtcttcttaggaacacatcttgaggcttctatcattccttctggcttgctcaaggagtttgcccaaactgagcccaacatcactagcaggtagaaaggttagccttggtatcatcaggccataagaaagatcatgagccccaggaaaccaagggagcccttttccaaggaccattttatctccttgttggcttggaaagccatggcatggcatgaagcccagttaaccttaattcagacgaatgtcatttcacagtcatttttaaatccaaaattctgatttttaaataagatatgcttgcagttggacaatgttcaggcatacagaataacccaaattagtcttaaaaagctttatgttttttctttcctcaaatagaggtccttctgggattagcattatttaatgaatagatgagaccagtacataattagcatatcagttgtttagcacattcaggagaataactttcagcactttaagaaatatacgtgtgtaaaaactctgagttctgtttatggttttaatgtgttcagaaaagctctttatcatggattctccaaaggtcaagtttttgttcagcctatgtctgcattttcacaaattgagaatttgagaactccaaaatgaagaagattttctacataataaataaagatgctcagtgggaagacttcataatacccaggttatgactcattctaaatgcctacttttgccttttgcagtgaaagatggctccataatgttgggacccattttttaatcgttatttgtttttcggttgcaaaagtgaaaaaacaaatgcctgattgctagatgcacatcaagttataaaagaaaccaaagctgtgtttgatccctgggccagcccactgtcctctctctgccactaactcctccctccttccagccaggccttgcctccatgcctggttctctcccaaggacttcagtctcagtgacaggcctggcagtcatctttgacccactgtcctctccaccttctgctcatgctcaatcttttcccaagtcctattaattgtactgcccaataccactgagctccatccacctccctcgatcccaacaccagctctatcctagtccaagccatgacagcctcttactcagacctcctgccgccatcttgtacctctgaatcatcctccctacaacagccaaggcaatccccttaaagcatgaacctgattatgtcactctccaactaaaatccttcagtgcctcttcattattcttaagaaaaagtccaaaaccatgaaaatgtgtttcaaggttctgcaggtctaaccttggccatcctcctgcacccttgtctccccatggtccagcctcacagggtttctttgccttctttgagagcctcaggtcccccccaacaccaggttttgcatttgctttctttcttcttcagagaatgctcttcccccaagatctcccctctttatggctcaaattttagcataaaatgtacaactcccttggggaatttttctgggatccccaaaaccaggtcaagccctcacctatatttccttctagcctgccttgccttccttgcacttgaggaatttataatcaaacatttacttgtgtgatggttttataatgtgggtctccccttctaaggtgtgagcttctaggagtcttgctctccactgtggccccagtgcagcccagggcctcaaaggttggaggtgctctattggcacatcctccacccttgagtgaggaggagggaacaggataactcaccgcgctcatgagtgagtccaggacactgacggcaaatgctgtcccacaggcaaagggctgcgtgaggtacagttctgtatcagggtcatcatcatcgtcttggtccaaaaactgaacattagtatcgttcactagaaaaagcataaaataagaattagctctgaagaccacacacaggcattgaagccagagggagaccaggctactggtttagaaatactgaagtcattgagaaggaaacaaaagcatggaataagctgtagatggatctttgggtaaggggggcagtgggactcaatggactgttcctgtgtcactgtttaagtgtctgagacctggagagcaataagttcaagcaggcttgctccacggcaggccactggaggaccaatagactgtgctggccagtcctttggcatagctttaggatcatgacctaaaaacactttccagtgttttttggtaaccaagtcctttgagagatggacatatttcaatgatgagcagccatgctgggatagtcattttagccacaatgaaaagaaagcagcttattgggagtaaagagcgctggaaggggagcacagcaaaggcagatagcaaggaattcagccacaggcataacccgcagcctacccactgggattggcctgggtagttcccggggtcccaggccctaaatctaggtccacacccaataggccctgtttaatacacaggaaaccccaggtgggatggatgcctggctgtctcctgctgcttgctgacaaggacttgctctgaattttgagttgcatggggacgcccacgttctccctttcccatcctaaacagctcaatcttttatatgcttgcattcaagcagatgcagcattggatgctgtatttcatttccatctgaggattcctcaaggactcctcccgcatgtacgtgcaggctgattagttgtgtcactcagatgtctttaacttattaaaaattaaatgacaaattaatttccattcccatcttggctttggaaattatcagttttgcagagcaagtaataggggaaaagtcggtggggggatgggagaagggggcactcaaaatttctgaaataattattgtgattttaggaagagaacagatgaggtttcctttccctgattcctttctaaatgtatcaacagctaattcttttttctagagtgattgttttaatttttaagcaactttcttgataactcttcttttttaaaaaaaaaaaacttttgtttactgtatgaagcagaataaatgatactagcatgaaaggctaggcatggaattagtattttaaaatgacatcatcttgtttccccagagaaaaattctaatggggaaaatctttgctctgttcttccaaaattggtcacatttgggtccccattgtttaagcagcaattgaattgcaggctagtggtgaaagtccaaaatccaggctctgacaactgggcttcagtccagcctgtgctgccaacttccttgggcaaagcatttcatcattctataccttagtttgtttctgtaaaatgggggagttacagcagctctctcatgaggctgtcaggaggctcatacgaatgggatggtgcccagtaagcctggcccagcatctggatcatgccatgacttgataaataccagctgctgtcatgatctcccttctgacattaaatacctgtccacccattatagcatgaaaatacccagcttccctctgcctctcttggaaacactgaaggtcttgctcaggggtctttcaagaggtagcttttcctcacctcccttcacttgtccaaagggatgttgtaggccactgtttagtctttctgttttgtgaatcagaaaatgtaaactggagaccacatatggaagaatgcagttttagttacttgtaatagccaccaatggtgtgtgtggcaatgctccgaaaagcacagcatctgttacctcttatcaggaagatggggaagggttggtaccagatatggaggtgaagtgactccaagtagggggaggggactcccgattgccagtgagctagacatctggggtcataggaaaagcgctccaagagaccagccagggtccagtgaataccttgtataccgttctgaaatacccagtctcagaaggagagcaagcaatgctactcaaggcctatttcacagaacagtaattatgtgggtgctaagaggtacccacgtaatcaccccaaagcatatgtggtcaaatacaattggaatagtcaggtgaaacagctgtaacacagtcctttcttgtgagactctgaggagcctttgccatgctaacatcaattgagagtctccaagtagatgaaaagtggaatgtgctacacagctttgaaagcttgtgtggccttggtgccctctgtgtctcttaaaattcattatactggcctggcataatgcagaacacatctcagaacatgtagataaataagaagtatttgtgggggatgtgggaggtgaaatggtctgaggagggtggtatagtggctagagaaataggtttcaaggcagaagacaagggtggtgtgagcacctgaaagattctctgaacacaaggaagaaatctggtgtgggacaaaggcttcaggagagtcaatgatgctaatcaaataccagaattgttgccttaggtttggggcaccaagcttttccttttctcgtctactaatgacaaattaagatatcctagttagtcagcggcacgtgaattccaaatagaaaatgaaattcccggcagtgaggattctgaaatgctgctgtaggtttgtgagatggagatgtttggattaattttccaaccagaggcgtggaccacatgagccctgggtctcttattgccctccagttctgaggagagcaatccagaaacctagggcttttaaacaactacactaaacatgaaaaagatacccctcctatggttggaaacagaaaatagtgtgatactccctgacctgagtgaatttgtcctgataaatagctatacctacaataatgcactgctgagtggtggacaatttattccttggtttctagacatctcgcaagcaagattactgtgttgaaagcctgctcccttattttgaaatatatttttgggccaagaaaatggggtgttcatttcatttgtgagtcatgtgaaggcaggtgctcccacctctctatccacccctctgctgagcagcacttttgctgtctctatttagaagatcaatccccagttctgagacttgctgctgatgggtgcccttcatggagttattaaccaagtcacggggaagtggggaagaacctaacaaatgcagtcacgactggaggcctttatcgtccacctgagtccattgtgaatctcccagagaggattctgggctgggattgggggccagagtgcagggctgcacgtgggtggctgctaaccttatcctccgcacccttcttgaaatctgcctttagtaaaaaaagttctcctagggaccaggtgtttttatggcttcagaaccagagcttctgagaaatgccctagtaggggggaaaaaaaaaaaaggcaaataaagtcagaataaagaaaaataaacagctggagggaaagtgccatcttaggtttcttatcttaaaattttgatattctcctttgacttcctctaagagctgtgaagacatgtcattcaaactgacagtatgttggaagaggagtagaagggagaaggcgggagagcggggtgacaaaaaaaagtggggaaaaaaggctcaggccagagaaaatgaattagagcaaatatgctttggaaacaactgccaggtcagatgggtgtgatcaaaggtttactgatgctgtgtggggaaaaaatcattaagaaaggccagaacaagacagtcgattccaaccagagccacaaataaaacacattcaaagcagtgccatggggtagcctttctgttacagccggtgaaataaaaacaagctgatgatagttggaaacaccaacaacagaacaaaaggagatactgatgtgaaggaaaacagtgcttcttacccagttcagttatcattagaatgtgcgtcccactgtttttttcctgattgactgataccaaaggcaacttgcccggtttagctaattggatacagcatttaagggttggggaaagggagtggaggaaagtacagaaaaagaagagagtgagggaataacagaggaaacattctcaagtaaagggaccccggaccacaggtagtttgcatttgtcttgggggaagaggccactctacagttttgcacactcactaatggtaacagggagtgccatggccaggttagaagttagattctattgtccaaccaacatggccctcaaaaccccatcattttgggggccagaatggcatttgctgaaaatggcttttggctgagatattcaactacgatacgttaaatgtcaagttattacacattagcccagggcttctaccttgttcccaaaatgggtttggcttagatccgaggctttgtatatcagtggaggactcagattgtaggagctgtccagacagaatgctcaaaagaggttcttacagtaaaaatcaccagaaagaatccgtgaactaagcctttcctcctttcctctccattcccaattgaatgccccaatcgcaaatccatcatctcatgctcctttgaaaacagtgaccagcatgaaggaaactgtctattcatctcagaagaaagatagatcagttttcccttccggtaatctgccatatttctccccataccttcctcccagccccctcaaaacaaaccccatagcagctacaaagttgaaagggctaagaaataaaccaacctcctcatatcctgtatggtttgaaagacagaacaaaaactccccccaaagctgacattgacccctacctagttcagtgatgatggggatgttgaccccagttgtgatggatggttgacgtaacatcccgtgcactgggctgttatctggagaggatctatccattcctggaggtgtgaaccctagtgggaaggaaacagaggaggaagaaaaatcagagaagtagaaaatttggaaataatcagagtacactatatacatacaaccccaaaaatgtagcttatgcattattcacaggtcaacaattagtattcccgggataaactctgatgattaattctttagaaggacagggtaggaaaccattataaataatcgtaactcacttcatagttccctaaaaaatccagacttcataccaattatttattctgctcatagatcttggctcccatctctttccagggacacaggagaattatcccctgtgcccccttgaagttaggtatggccatgtgacacatgaaatgctctggcccatgaaaagtgagcagagcagtgcatatcactgctggttcaggtattggacagccatctctctcttcccaggccatggcaactgtgagaatacaggttactatggagatgaaggctagacaacagccctggacagttacccagacccacaaagcatactgagtgagtcaagaataaagctgtgttgctttaagccgctgagatttgtttgtttgtttgtttgttgttgttgttaccacaacataacctaacctggcctgactgttaccgtaaaccaatcaattgcttatcctcttgctggtgagtgacttaggcctcagttttcacagagttctggccaatgggaggtgtcaggaaatcttcctggggctttcaggaagtgtttccttgctcttaaaaagaaacacataggaagagattctcttttaatttactgagcacggttttatgtgcctgtagtgccaggaactgaggcaccagctgagggcataactaacttagtgatattggctcaagtgaatgacaggaagagctgtcctggagttcctggggcaagcagcctggagccatcccacctcaggatttctccctatgtgagattttatacacataaacacacacacacacacacacacacacacatacacaaatgtatttatacatatacatacacacaatataataagatgttcacatttttttctttctgtttaagctaaatggagaaggagtttacttgcatctaaatcctcctgactaatgtatatgccacctgcttatggctgatcccttgaacttcccagtgtgccaaacacagaccacataaggtatatgtggacacaggaaaattggaaagcagcctgcttggtctctgattttgcagtttgggcttctttgggtcccaggtccaagccaagtacatacctggatgaggttggaacaactgtaactttcagtttagtgagagtgagaaatatcccggctaggcagaatgtctgcctcgttaaggttttgcatggacacatatcaatattagaaacctatttacttcctacattcatctggtaaaaattaatttttctaacgaagcatacggcagctccacgcaagtggcaagacccagtgcaattacatttagatgataggcaagcattcacactcacttcggtttctccttttttccttcagcggaatgctacatgggcttaccaatgaattagggacttttaggaacaaagtcacttgctaaatttccaaggataaaactccaaatagattattatgtgaccagatatctgactcactttccagcaatgtgacaagattgtgttgagtctggcattttggctaggtgtgagtcaggaatgaaatacgggagctcaataattgcctgttgttttggaggtgcataatgcataaaatgccagagaaatataaaagggttttcttactttctgctctcccgtgtatacatttcttatcactgagtgccatactttcaaaaagaaagacaaagttttacttaatatccattccctgactgcacttaaattgattctttacattaatacactatgaaaagggtaagtcattttgattgacattgtagtgtccatcttttcaaactttcgaatatatgtttttcagccaaccacataaccaaaaacacgcatttttaaatgctagctgttttcttcttctaggatggtgaaggggaaaactaaactgttttcattagaagtttcattcaaaaacatgaaaaactggaagtgacagctgtgcagattcagtggatgtgacgtttttgaatttcttcaacttgacaagtaaacaccttaaatcggtaatgctatatgcataatacatggcctgtattttgacatccatcatcaaatgctgacttgagaaaatacgggtttgtacgtcaaggaatagcacccataaagcagggagaaatgcaggtcacacggtattaggaaaactgtatttcattacagaactcgcaacaagccacggcatccttttattttatcttatttaaagattccattttcagctgtgaaaagactcaattcctttgcatgaaaccttcatttggaaatgacatgcttgcttcataggcttctttcattttgctttcatattccattttccccttcagtcaccaggcctggttccattagcatctgcaactgacaaactatggtaggtgtccaaagacatctctctgttgaaggcccaactctcccctatgcatgactccccaaaaaagtgtgcttttattgctaagaaaacttcatgcctctttttgtttccctacttttctagtcacacatttttaaaagcaaaaggcaacaataacagcaaagttggcttcttctttttccctggtgtagagttatgttaaaggtgaacataatttattagcattgtttctttcttaggggtactgatatgggaaaattatggtcagaaacggcaggattgccccagattccttaaatggctttggagagaagagaaattcaagcaccttccataaaggaatgaggcaatccggcctttgatgccataggatggtgtccaccgcattcctcatagctgcatttgataaaggggcaggtctaaattgtggcccaatctctgaccatcttgctctccttcccattattgcttgcagccatgactatatcatgggtagcacctgaagtctctctacattaaacaacgccctagttctgcatgtgaacacactggcacatggaatatactccagagatctacagctagagaacagtgaaactgggaaacactcccttcattagttaaactaacacttgggaagttaattttagaaacaaccacttattttgccagaaaagatgactaagaatatcaccattagagacatggaatgagaagtcctcaatcaggaaaagactgaagtttaaatcatccacagccaaagctatcaccagatgggctcctgattctttagccatgtacccatagcactttgttgatcatggccatgggaggcaagttttgtgctaaaaatgacttccatatgtttgttggccatttgtatataacatcactaagtatcaggaaaatgcaaatcaaaacacaatgtgataccaccttattcctgcaagaacggccataatcaaaatatcaagaaacagtagatgttggcatggatgcggtgaacagagaacacctctacactgctggcggcaatgtaaactactacagccactatggaaaacagtgtggagattcctcaaagaactaaaagtagatctaccattttatccagcaatcccaccactggttatctacccagaggaaaagaagtcattattcgaaaaagatacttgcacacgaatgtttatagcagcacaattcacaattgcaaaaccatggaactaacccaaatgcccattaatcaatgagaggataaagaaactgtgagatatatatatatatacacacacacatatatatatcacatcacacacacacacacacacacacacacacatatatatgtgagtgaatactacacagccatacaaaggaattaattaacagcatttgcagtgacctggatgagactggagactattattctaagtgatgtaactcaggaatggaaaaccaaacatcatatgttctcactggtatgtgggagctatgctatggagatgcaaaggcataagaatgatacaacagacttcagggacttaggggttaagagtgggagggagacgagggataaaagactacaaatatggggcagtgtatactgcttgggtgaaggatgcaccaaaatctcacagatcaccactaaagaacttactcatgcaaccaaacaccacctgtaccccaataccccaataacttctggaaacaataaaaataaaataaataacttccaaagaccacctgaactccttacactgtaagttttctccccactccaatcttcagtggctggtgtggcaggtttttgttacctattttattcattcagcatgagacataagtgcttgaccaactttatcctatgacagatattctcattctatatactgtataagaactttaggtcagagactggattttcatttctttgaacttcccagattatctacaaaatgcccagcacatagaaaagaaatagaatgaaattgttaacagcatgggctgtaaagtcaggtgtcctggattcaaattctggcacctccacctataagccatggcactataagcattgtgcagactctctcctagtctgcttcttcatcgataaaccacaaatacctcccacataggacaattgtaaggataaaataaaataatgtatttaaaacatttagtacaatatctggtatgaggcaagtgctaaaaaatgctggctaccaatattaatattttattaggtatacaataagtattcgtggatcacttccccttccctatggataaagaactgaagaagtatttagtagattcttaaaaaagatttttcacacacagaaaatcctagaatactaatgagaaggcaatgagcattgtgtgtgtgtgtgtgtgtgtgtgtgtgtgtgtgtgtgtatatatatatatatatatatatatatatatacacacaatattccttatgtgatcataaggaaagaaggactatggctcagacaagatatacacaagtaatggctggaaaagggttccaggacactgtaaacccaagtgcattggaaaatgagaaaggctcaatggcattgtttttatgagactcaaagcaaaggcaagaatactctagacctaaactggttaataattgagaatgaagaagagagggggaaggctgaactagaacccaaagaaaaaaaatagccaacacttactgagtgcttactatgtactgaattttgctcacgtaataacttcggttctcagaaccatcctatgtatatactactatttttcagaggaggaaactgaagcacagagaaggtaagcaacttgccccaggacatacatctaggaattagcagatctcagagtggaacccagataaacaagtcccagtgtctcctctaagccaccacgccatattgcttcttatgtgccaggctgggctaagggttttttcatgggccaccttgtttattcctcataacagtccctgtgtgtttagggactgttgatatttgcattttgtagaagaggaaaataagattcagagcagtggcataactggctcaagcatacccaattggtaagtgtccctgggagccgcagccaggcagtctgacctcagactcctgacacctgcaggctgtgccgcatccctgacttgggtgctggccttctccttctaggtactgtccctggcaggcaagtctgaggcctgagccagtcttactttttattgttttcacttttaaacaatagcagataacaactgggacccattgtagttatgcttaacttgctttggtatggcagcatgcacaactcagtacatataataaatgctttattacagtacttttccatgggggaaacacaaagtactttctaaatcttccctagttaaatccctgagcctttccagggagagagggagatggaaattcttatcaatcatctcccctagaatagatggagaaatgaaggtaagtgcttctcccaccccgatagacttaacataaaggaattggttcaaatggtgggccaaattatcttttattgtgtgcatataaatgatggttagaaatccatatgctacgttaaactagggaaataaattaggccgagtcatctaggtttgctgagacaggtattcaatatgaagttgtaaaagggaaagatcacctttaaaaatgatctataaagacatgttaaaatcaagagaaacatctcatattacatcatctatgagatgaattaaatttcctgttaatgccagggaaaaaaacctcaaaggcaaatgtcagatgaagtgcagatcaataaaaatattttgataagtaaatgcaacaatgctatttaacacatgattggcaactgctgaaacataaattatccaaatttcccattgctgcttatgggaaaattatgcagattagaacttgattaggcttatatcatgagactcaatttggacttttaatctattaagctccaataaatgaggcatctgaatagctcccctgagcaactacggtaatagccacagcagtcatttttgcagtatgtattccaacgaatgcttcagcagctgaagtaaagaaaattccatgtatagaagcacaattgctttctaacttgtaggggaagaaaatccacacacaccaggttgatttgggaaacaggtttttggaaatgactgcaagaaaaatccagccaaaggaaaaacctcagtttaaccttgtaatattttttcacagtagttttcagtggcttcctatgaagctagaatccagagtcaggaaggccaggcagctgaccatgtttactcaataaaaaaaagattatttaccaaggcagcagcttctcctgaaactccccaaaggccaccccaacagggtagaggtagcccccaacaaggtgctggaggtcagtgtcaaggagggaagcggggaaatgcccctgccaatttgtgactcccccgcacaaagcctaatgacagtgcttggaaactgtataaacagataattctgtgactcctgagccaaaccataaggtgtcttttgcctcttcagcaatcattctatgctagaaacacgagagttttcaaaatcctctaatcaattcctccattcttcaaatgaagaaactgaggcttagaatggagaagttattatatccaaggtcacagaaccagttagcagcagaaccaggatagttgatatctgctgttttctgttcctttttaactccttctatgcataagaaacccattccacagtgtttgttgggggtgcagggaagaaactccgcccccaccctggaaacagaagtggcaacatgaagccaggcatcctgacttcacagggccgctgatggtcctgcataatcctggccacatcatcagtttagagatgagtctgtcctcctcaatctagggcctgtccgtattctccccaggacattatgtaaaagatggtaaaggttctgtggttgcaaagtcaggagtctgcaggtgtggggctactggcaagcagttagcccaccatggggtgaatgaaaacagggcaaatgaaccaagaggtggagagaatgagatagagctctgtcattgttcaagttcctgcacacaaatgtgcctaaaaccagagacattccagttatatgtctctgtttttacttaagcctttttgcattggatttcacttgtgccaaaatgtcccaactagtacaacaactgagaaaaatctccattctcttcgcggtgaaatgattcatgctggcctgattttctactgaaacaaatgactgcatcttcatttaaggtttcctgcttgtctccagtgaccagggacaagacctggcttaatactctccttgtttctttctatttacagtaactaacagtgacatttttagcggtacatttttttagagactgtctttgattagcacctttgcaagttgactccacccactgaataaagtgccccatcctttttagagtttacattttgggtccaacccaaaccaaagcaaattaaaccaaccaaacaaacaaaacttctctatagttatttgcccattaagattcgtaaaatatattcagctcttagacaagtctcacacacatgaaacaaatatatttacaggacttgtctctccaagcagacagtctctttccttagaattaacttaaagatgtagtcccagctattcgggaggctgaggcaggaaaatggcctgaacccgggaggcagagcttgcagtgagctgagattgcaccactgcactccagcctgggcaacaaagcgagactccgtctcaaaaaaaaaaaaaaaaagaaaaaaagaattcgcttaaagagcttactgtgtaagatgtttctcagaagggttggttaaggggaggaaggaagaaaaagacaaagctagtaacaactcaaacacacctaaaactacagatttggagagaaacctaatattcacccggtctaatgtctccgtttacccaagagctcatggtatcattgctttctccacaacatctcaacttctcagttttaccttatcttaattcatcttacaatttaaagataaggccagatgcagtggctcatgcctgtaatcccagtactttggaggccaatgtgagtggattgcttgagctcaggagttcaagacaagcctgagcaacatggtgaaacctcgtctctactaaaaacaaacaaacaaacaaacaaacacaaaaaaattagctgggcatggtagggtgtgcctgtattcccagctacttgggaggctgacgtgggaggattgcttgagccagggaggcagaggttgcagtgagccaagattgtgccattgtactccagcctgggtgaaaaggtgagaccctgtctcaaaaaataaaatataatgagacatacttgcttggccagtgtggatcaaattacttataattttacctccactttggcctaagcaattgtacttctaaaaatatgtgtacagccataatttccttacattaaaaatttggctgccagggtcttcattcataggtattaagtaacaacattccactgaaaacaacatgaatgtccaattttagggaaattggttaagtatgcatccactaaaaataatgcagaaaaacatttcacgacagaaaaatggtcatgataaaatgtttgtgaaaaaccacaggtaacatactgacatgtatgatccatttttttgagggtaaaagtatttatatctatggaaataagacaaatatgtcaactttcttatgtctgagcagtaaaattacagggaatgtgcattttctttttggtttctataattgctaaattttctaaaataaacacattttatttatgtaatgaaaaaaattttttaaattataaattgatgttaaagaccctgaaatctcgaaacctcatgtgatctctatgggttgagagcagctgatgaacatgatggatggacacagctggttcatctgtaagggtctgacaggtctttgaacatccacttgatttggcagttaaggagactgaagttctgagatggaagtgatcaggccaaggttacaaagcaaaggggctttaaaagaacagggcccagagagagttttcaggcttcctagttctctgttatttcagcctcccaccatcttgtaagagctactcaatctcagagcagaggccatttacataaagcacacatgggcagtgaagagcccaagaaacccacaatgccccatgcacataggggaagggaggagcagtcagagctggtttccaacacagagggaaagtggcacctgctgatgcccatccctgctcccaccagccttacccacttcagaaacgctgttccccctcttccctcccaacccagctcctgtcgtttctttacctcttccaggacgtctgccttgaataacttctcacatttagttactttatgaagatgttttcctctgcctttttttccatcccctttattcgttattttaaaatgtatgaattattactaaatatatacaaattactacatattaatgtttaaatgttgttaagcatctttaattcttctgttttatcttcatatacccactggacttcccaatttcaatatggcacagcttatgctaacctttctttattgtttttatttattcttaattcctgttctgggaccctccctctttgctgccaccacaagaggacaaaggctgttttgccactaacatgggatctcctctttcatgatggatcacatttccagtaaactagaggcttactatgccagggaaaaggcagatatatacattacaagacaatgatatcaaggggatactaataaaacacacagacatcccccctcatgctgccaagactatataccattttgtttccattacatcaatttttttctccccttttgcaagcattaatcaaagaaacgtgaagagctcattaaagtgatagattgactgaaaatgtaaccactttttcattataaacagtttctttatgttcttggtgctatgggctttgtttttcagcatttgtcatgtagttcaaatgtccttttacatttaaaataccaaatgccaaatgggccccagttgtttggtttagtatgaattgatggccagcacagcagaaaccagaactccaaaatcacgagcaaagtataacatccatatcttaagcacacagaaaattaagtagctgtaaaagatgggtttgccaagtgatccaaggccttgccatgaaattcaggaaagcagaatcgcatcaacaactttcagccagctatctctgaatggttctagagacaagacgcctggcccaagatagcaccaaggttccaaacagttgatggttctttaaaagaaagaatctttttttcttaagtgttgaagtgtttcctgtacatacgtttatgctggcagatgaataggaaactgggatcttggatcttggggtcaggcattcccacatacatacacacacgaatcttcactagatgagggtttgatgctggtttgactctgagcatctctctgtacagcgtggtcaataacttttgaccactacctgaaataagccataccatttgtggtctagaacttgaacactgtggctagactgaatgagtttgggtcctgcctctttctgtttctaatttgtgatctggggcaatttatttaaattttgtgtctcagtttcctcatctgcaaattggaagaggaagatgtcatgaagattgaatgagttaataataataatacagggaaactgcttacaacagcacctggcacagagcatgtacttcatcagtactaacttactattatttatcaacaacagggttgtaagctgacagagaaaacaaaacacatgggttttagtcccaggtcaactcctacctctctgtgagaatgtagaaggattcaatgtcttatccaaactcagttctcccatccataaaatgaggttgtagcaatgtcccaaatccctttagattaccgtgcatcatacataatattgaaaccacgataattctgtgttcagctactcaatattcaggaatgtctgtggagtcattcatggggttgttcttttaaggaagtggaacacaggagccctctcttccagaatcctatcacattgtcggtatcaacaaacatatcaacatttcatacaagagatgcgcaccaaatacattaaaccacaacaaccatgtagcttgcacatcacaactccaggtacacatcatatcctctctcaggagtagcccctaaggcatgatcctccctccaggagccctgcatcctttccatttgctaacagtcaaatcattcatttgctgctatgcgatcacagtcgtggcaatggctgtggcccttggtgtcttcatctgtaaaataggaatgactctaaggccctctcagctttgagatttatgtctctttcatgaccccaaattttaaacgtgatctccaacaaaataagctagcaaagggaatccagaggatctccttacagactccttcacaagctctagtgtacatccagatttttttgattcagttttatacctttgcccagaggataaaacttcacttctcaaaccaaggagaaggaagtactttctccaaagttgctctaatggctgagaaggccataaataaccatttattaaacaaacactatgggctaaaggaagagaaaccaccgcaattaggcccctgaggcctgcaggcacagtacataacgatgggactctcataatccaggcaatatataaccagttgttccattttcttgaagttatcttcataatcaagatgctatctcgggcattgtgggctttaaaactatttttaattttaatttaaagagtaattaaagaaagacaatggatatgcaggataataaagtaagcgattagcagcatgcaaatgacataggcttaatgataatatggttctagtctccaaacagcttgtcgagagaaagccctttctacatgtggttgttcagctaatgtgtctcaacccacaattacaacattgctgacaccattaaccagtgaaacaacaccacttcgcgaaatccttgttgtctcattaaaaaggaaagggtcaggtaatttaccaacgttgtatgtctagttttgttgttggtaattagcaaacattacccagcatagactcccactgggaactggaggaactttgtgaaatattaaagaagaaagcctttatatttcactggaaaattgaaaagaggtgcagtaatattctccctgtcatctttttgcatttaggaaaaggaaaatgcaacttggaactctttaatttcaggagaaatattcaaaatgcattgggaagtcactacccacattaagaccctggatcaccattgtatactggcaaatagaatctgcatccctgtttacaaaagggagttggagatgggaggacgggaaaattgcaaactttatctttattgctcttacttatgttatttgaattaatctccttgaaacagaagaaaggagatataaaattttctttttgaaatgctacgggacttaaataagcaccagaattatttattcagaaaaatacacacacacacacacacacacgaacacgcgcgcgcacacacacacacacacacacgcacatacacacacatatttagacctaaagagagaagaaatatattccagggaagagacttcctgcctccatgcttcctaatagaatcttccccacattggaactcagaccccgcccccaacactggccaatgcttggtgtgttgtcagggagtagaatggtatcttattctttaaatggaacttttggaacataaaacacattccaataaatgtgagcagaaaattatgaattcattaaactactttggtatcttgtgctatatataatatttatattccgactactgtaaaatatgctttaatatctttaggcaactataaggacttaaatatttataaaatggctaaagataaagtatggccctcttattcctacatacagatgatgtaaggcatgcaatcaaagacaataacactctctgcccatttgtcatcttaaaggagccgatcaacgcgccatccctcgtgtgccatctacataagagttgttgccgacacaggcaactccagaggagtttgcgccttaaaaactacctagagtgctatacttcatagaaaacagggctttctgaaaatggagacaaaacaataaatttgcaggcaaaacagctccaagaggggcttcaaagtactgctgtatttatctctgggacatgagggaacaggaagcattttgatttaatatttcataagatagagacaattgcttccttgcatggtatatacttaatgctcacagaaatgagttttttttaaaaaagtttcaatatcttaaatgcaaataaataaataaataaggagacacacctgcataataggaagggcttcctttggaaatatggaatagacccatataatcccaataaagagaaagccaccacgaatttataatcacctaggggcctgttaaaagtagttttatagattaagtgtgaaacctcaaccctgatgttattattatttaccttccttgcttgcctttaggcccatggcctgattgattttcaaaattcttccatttcctatgctgattaggtattcaaagaattgtttgtgcccacctgccttgacctctcaaatggacaccccctggtttattttcccagctcccactagctccctgctgggaaccatgtggaagtttgtgaatttctcatgtatcttgcattttcacaatgcccattatatgctttccaaatctcctagcaatcatgcctaggagaatgatttattctataaataaatttccaagataaatttctatggaaatgtaagctttagtaaatcagctgcctgatacaaggatcagagatggtttccttgagtaagtaaggggctaggctggtgtttctcaacttgggctgcacgttggaatcaccaatgcatgcctgcatcaatgtctaatttaattgctctggagtatggcctgagcatttcaagaatgttaaaagttccccaggtgagtgcaatgtgcagctaaggttgaaaaacagtgggctagttcagaattaaatccacccatttaagggcaactaatctttgacaaggatgtcaagaacacacaataggtaaaggacagtctattcaatgaataatgatgttcagaaaacaatatttacatgcaaaagaataaatctgaacacttctcttacagcatatacaaaaatcaaatggattaaagacttgaatgtaaaatctgaaaccgtaaaactcctaggagaaaaaataggggaaaagctctttgacattggtctgggcgatgatttcttggatatgacaccaaaagcacaggcaacaaaagcaaaaattaaaaagcgggactacatcaaactaaaaatctgcacagcaaagaaaacaatcaacaaagtgagaagccaatctactgaacgggagaaaatattttaaaaccacctagccaataaagggttaatatcccatctatataaagaactcatatactcagtagcaagaaaataaataacctgattaagaaatgggcaaaggaacctaatagacatctttataaagaagatatacaaatggccaacaagtagatatgaaaaggtgctcaatatcactaatcatcagaaaaatgcaaatcacaataagatatcacctcatacctgttaagattgctattattgaaaagacaagtgataacaagtgttggtgaggttggagagaaaagtgaacccttgtacactgctggtgggaatgtaaattggtacagccctatagaagacagtatgaagtttctataaaaaattaaaaatagaaccaccacatgatttagcaatcccacttctgggtatatatccaacagaaatgaaatcagtatctcaaagagacatctgcacctccatgtttattggagcactattcacaatagccaagatatagaaaccactggtgtccattgacagatgagtagataaagaaaatatggtctgtgttgtgtatgtacctgcacatatatataatggaatattattcagccataaaaaagaaagaaattctgtcattcaacaacatagatgaactggagaacatcatgctaagtgaaataagccagttatagaaggacaaatactgtatgatctcacttatacatggaatctaaaaagttgaactcatagaagcagaaagtagaacagtggtggccagggactgtggtgagggtcagggggaatggggagatgttggtcaaaggatacaaacttgccattataggatgaataaattctggggctgtaatgtaaagtgtggtgactatagttgatagtgctgtgtagtacacttgaagtttgcaaaaagaatagatcttaagtgtcctcatgacacacacccgggcacacacacacacaatagtaactatgggagatgatggatgtgtttattaacttgattttggtaataatttcacaatgtatatgtatatcaaatcatcatgttgtaaaccttgaatatatacaacttttacttgtcagttgtatttcaataaacctggaggggaagaaaatcattagggtagacaaaactcttaaatttgtatataaatatttatgtgtctatgaagaggtaggaggagggtcacagagaagattcattattagctatttaaaggggtaggtacaagacccctttcccagttgagaactaatatgctataggttttctggctgagacccaaaattactgttttaagaaaaaaaaaaaaaagaggcaaaggagggaggccaagtgccatctgttgactaggtggagtagcatgggtcctgctctggaagggtgtcacttcaccaacatcagggctcctaccacaaccaaaccccagaggttggaagtgtatgaggttttctgtcagcgagctgtcccaatctctgcttcagagagcagctgcgttgcatggcgccatgctagcctgtctatggaggggaagcgccccatgctcactgttcatctgccctagtccttcctcaactcctctgtaggcttttgttagtctaccttacctggtctgctcaccttccaaaggtgtgttggtttctatcatcatctattttctatgcatatttacagacaaacagatcaacagtaattctggctgctaggtacaagtggataatcctaacttatgatttgttaatctgggagtaggaggggatgaaataaaatagtaaaattgtaataataataacaaaaatagctaacattgcttgatttctcccatcctaggtaggaagtgctttaacagccattcattcagggttgccatgtatggttgtgaaggttgggcactacacagtagctaatctaagtgggtaccactcatatcaataggcattgtatatttgcatatttatgacaatattttttcccagcagatgacagaaaagtgtattgttcaaacatattagtagattatcaccatttttttcagcagatgaaaataaggtgtcttgagaaaagagtgactttttctggcttacttaaaggtactgtatggacaatagaaagtcctgtatctcattgaattctcatagtcatttgataagccaggtgcatttagtattcttagtgagaaaattgagataaaaagaggtaaagtaattttcccaggcctagtaagtggcagatctgggcttcaaacccaagctgtcattccagacccatgtgtgccatgactgaacttgactgcaaagtgctatttctacagcctttgatgtttaataacctttctgcagccattatgtctttgtattcatacactgatccctcggtgttttggggtggggtcatttaatatatagatatatagatgaggaaatgaaatctggaatctttattatgtcaaattgctcatgatggacagaaccaggatttaaaagctgttccttaaccctccatgactgcatcattactctgacagccatgtttgtgattcactatcatgaactagagcaacaaaacacatcttccaagttcctcctgctccagtctaccgctgagaggaatgttcatttctacatggccagggaagctctcaggaagcattcacagctccctggagcagaaagcagagatattttctgccctttgttgaactttggaggtctcagtcctacagccttgggccctgggttggtactgtgtaatagtacattcagcgaggccagtcaaaggttgagggccaggagctattagtaaaggttaagggaatagtacagtttatattagagacaacctggccatctgataaaggctcctccagacaagtgcaacatctttgatctctgtaacccttgtccagtgcccagttgtcaaatgaagggagactaaatcctggagggaaagtgtaggtttttaatacaggtatttggctgctttatctcatttgagggcacgttaagagagaacaggctgcaaacaacagatagcaggattaaatcatgtattcatgtatccatcccctccacaaacctctactgagtgtctactaggtgtgaggtactgtgctaagcatttagaaagatttctggcagttggcgagcatgaagaggtcagcaaaacaatagaacaggctcttctttggaggatctactcaggttaacagtgcacccacctacaagcatttcctttgacatagtgagccctttaagtaccttggttataccattagtacacaaatagccaggtgaccctctgtgaaaaacactcggcctttcctgtttctgtgccttctgttactcagcttcagccctttccacatgcctgtcggaacctttatttatattaatcacacttattttcaaattctggtccctttactctggagtctttcctgactaccacagcccaaagccacctctgccttctcataacacattgtgtggcagcatgcatgggacactgaaaacatctggtagaacatctctcctggagatctgtaacaagatgctcaaggactatcctgcttttctggaattcagaaaataattttcctccagaccattccatgaagtataattgaagcatttaaggactagccatatccttaaatgttcaataaatccagaactaaagtcatttataaatcagttggcttctttgcagtgccactttttctttctttctttctttctttttctttttgcttgtttgtttttggttttgtttttgagatgggatctcactctgttacccaggctggagggcaatggcgcaatctcggctcactgcaacctccacctcctgggttcatgtgattctcctgcctcagcttctggagtagctgggtctacagatgtgagccaccacaccaggcttatttttgtactttaatagagatggggtttcaccatgttagccaggctggtctcaaactcccaacctcaggtgatccacctgcttcggccccccagtgtgctgggattacaggcatgagccactgcatctggcctcagggccatttatttctttatttttttcttgagatggaatttcgctcttgttgcttttaagaaaagaagtaaagtttttaagactgcacatgagctattgcctatagagaataggtgaagacaaaaatgcactgaatagctggctagatttatctgccagcttgaggcatgtgtgctatcttcacagcaggtgtattgaatgaaatggctcacactctgcacaaggaatacactgaaatgttccaagccctgtatccttaagtatgtgtgtcaaagtcattccatacaacttattttatgtttctgtcccttttgcctgtagaccccattacttctatgacagcatagactatggagacaacaggggcactaacctcatgcataggatgcaaaccaaactgacatgcaggataaggtagttgacctatccttatccagaatttcatgaggtgtcttagagggtccatgggattacaagacttcctttacttctctctgattctacagctgtggtttccccactataagacaatttctctggaccattttctgagcctaggctttgggcgctacagtggtctcttcattctcatctgctgtcacggaaacttccgcttgagcatggaaggagtaaataaaacctgaaaatgttatttaagtgtcttcacaaagaaagtaacagctaggtctcaaatattccactctcttccttacagctccgaagtcccatctatattcacaagaaaaacagaaaagaaagactccaacagtcatactgttcacagagacaggctaagcacagtgcttcacattgcccccagatttactcatttgtccagtggtagtagcaagaaagactgaagccaacagaatcctagtatctctcattgttggaacagctagggtcaaggggctcaaaaaatggggattcacagagacaagaaccgttgaaaacaaacttcagccccttaggtgcaaggaccagtttagaagtgaggctggcacaccttgagcactttcatccccttgagtgtttgtcctgggggtgcccccatgacccttgaaagtacatgtatagcttcaggcccattctcatcaggataacacttgccttttaagagacaggctgatgtgccgagaaaagcatagactttgaaatcagatgtttggagatcaactccatgtgcccttgactagctataaggctatgggaaaggtacctaattcccctgaatctctgctttctcaactgtaaaatgaaggtggtaactctccctcagcaggttgtcagggagattaaataagatattacataggaatgtgtctggtgtatggctcacctgaaaaaaaaattacattttcttaaaaaaggcattaaccaggcacacaaattttgaggagtaaactggcatgtgagagccagatgctaaaaccataagttcagtccaaccccaagaccacccaaaatctgctttctgtctctgaagctaagatttcccttcacgacagttgtcacaagccgggcacagcctgagtggggacatgaatctgctctgcatccatttggaaggaaaagatgattctgtctgtttttactttttcttctgcacatccactctccaagaaagtctttcatgcatggagggcataaaaccctccatgagttcaaaaagtagtccaagtttctcagtctcttattatagctgctgctgttgtttttccttgtttctcttgctaggaatacattactagaatagtaaatggcagggttaaagaggatctctcatgtgatgaaatatgctatataggaaaaattctcttaagttgaagtcatttagaaaacagctgcaattgctgctttgctgaaatacatctgcacctgagattcttgtgatgagattcatcttgggatgtccacggaagaaatgtaacagggcaggcccctttctgtacttgagatctgctcagagccctaagccagattttctttattgtttagtaagctcttttaatgaaatgtactactcttattatagaggactcaagataagatctaaatcacaaaccaataaaagaaaattattggggtagatatctaaagttactacctagaggctactccagtgtggtatttataaatctctaaacagttaagtataattgtctttctggtttttgggacggaagccaacagcagtttcagttacaatggaagaaaaatattttagcgctgagctttgttcgtttagtgggtataaagagaaatggcttctcccctatcaccatttcagaattgagagagaatattgtggtaatgaaatgttatatgggagcagctgaaaaaattcttctctgacttcaaggaggggaaatgtgtgtgaggatacatgtataggtgcgtctgcaagaaacagtgagcagcctgggggtcaggaaagccaggcttgtagaagtgggagaaggcagagccctgggaaaaaggcaggtgtggaagggtggtgtggaagttgaagatggggtggtctgtccaattaatggaaaagccagatctgcagctgctcaccccaatgccgtccgctccccatctttgaacacaaagacagtgccgttcaggaaggacatgaatgcttccactaaaagactcatgaccccaatcctgacaaacaccatagctctccctctggagttacaatgcaaatcatataaaacacagatccctatgtaataaaaatcaagaacatgctggatatccttagttataaaggaccacagaactcatctctctaccaatctccctcccatcacaaagagcgtgtcagtaactctcctttagcaaagagacagtcagggataggaggctcgctgcatttgcaggctgtccatgctgttctggaaatatcttccttatgttgggctaaaatcctgttctccttaattattaaccattggccctggtttttgtccaatggagcagaagattaaatggccctttaagcctgctggctttgttctcttaaccacttggcaagtgacatgttgtccaggcactgccccattctggccgtcctctttacaacatttttctgtttgtttgtcaaatttctgcttcaaatcttcacagctcttgacacattccctcctatcccaacaaagatgaaacagtcactgctcaaaagaaatgatgcttttatcaccaaggtttatctagcctgtctttactgatcatttgaaaattaacatgcagaggtcctcaatgcattctgtcctgtggatttcatcccagagttccactttaggaaggcccttttcgttctgctttttgtcatccagtaatttagagatcctaatccacactgtctcacacaaagataaaagagaaatcacattttcttctttggaacagtaaaagacatctcagactttaggatagggaaggtgtaccctatgcccccaattaatgctatctctccaaggactgctgccatacttccaaagaaaaatgtcattccctacttgaggctcttaacctttgttgaaatgtggagaaaggagggtgtccgcttatatgtggatgttcatttagtgtaactatagcttcaggtcaaagagggcgggaggaaagctgtgtgtgtgtgtgcgtatgtgtgtgtgtgtttgtgtgtgtgtgtgtgtctgtgtgtctataaagcataaaatatggaaaaaaggcagtggacatatgtcttgggtttgagatcttggctcctccctcccctgggacattcgggacaggctcagcttttggttctccggcttctaccaaagttttcctctaccctctctttctgagatggtatacttctgtcctgcaattctcttgcctctctccctctctctgaggctctcctttgctcctagagcatgagcaatgggccagattgctagaagcaaacttttcctggattaaggacttcatttccacccttcagcttttcatgcccatctggattttccactaagtccccgtggaaataaaccatgactaaaacccaatcctcccaacactgctttctcctgcagcctgtccctccactctgccatcctctgacccccagaaggaaacacacatccatgcagactgttttgcatgtacagtgactccttctagaacctcccattctttttccagtccaaggtttcaggcttccatctggatagccacagttcctaaccagagtccttgcatcttcttcctttccactccaaacaatgcttcacagggctgccagatccatctccctaaagctcaggtccaatcccatcactctcttgctttgaaaccttctgtagctccccagtgcctagtgaattatttacagcttcctaactcataaacacataaaaaattatttacagcttcctaactcaagaaagaaaagaaattcctcaatgcccaacccacatttcaacttcatctctccctgctgccttatatgtaccctgtattggggccaaattgtacttgtccctgtccctctaacacatccccaggaatctttgccgtcacttccattcgctccgtctcaagccagctcactttgcctccacctgttatctttttcaagcatggaattaattactcttttcctataaatctttgatgactcccccaaatccaaacccttagcaagacaagtctacactctaggactgcaccatccaatatggtagccactggctatggatcactttaaatttttatatttgttaaaattaaattaaaaggaaaaatttaattcctaaatttcaagtgctccatagccacatgcattcaagtcatccacagatgccacctcttcttttttttttttttttttttttttttttgagatggagtcttgctctgtcgcccaggctggagtgcagtggcatgattttggctcaatgcaagctccgcctcctgggttcaaatgattctcctgccttagcctcccaagtagctgggactacaggggcgtgccaccaggccttgctaattttttgtatttttagtacagacggggtttcactgtgttagccaggatggtctcgatctcctgaccttgtgatccacctgccttggcctcccagagtgctgggattacaggcgtaagccaccgtgcctggccgatgccacctcttcttgaaagccttctcaattcctcaaaatacctaaaccaaggatccctttgtgttcctctatttctagcctcgtccttgtttccttggactgtcattgtttatggggatacctcctccactcacctgaatcctgcaagcatagtgagtggctgaatccaagcaacctttggtcacctttgtgttctgggcctttagagtgcctgatgcatggagaacagccatttattcctttttcttttccttaggagttacctttcatggaagggtaagcaggaagcaactacaagatcatcatttcaaaacaatatgaaagcagaatgggaaatgccatggcatgctccctcttttcaggtatgaactgaagcagctcagagagcggacattgcctccctctgctcaccctttcttccaagatcagactcagttctcatctttttgaaccacagggaaacagtctggcaagagccactgttgtaccagctgatttaaattgaaatgttttccccagataaatgcgtgctaaataatacaccagctctccagccaaagggaagtgacaggcactctgtaaataaaggcacttagttgctggtaaagagctgtaaagtggttctgagctgatgtttgctgaccagcaagaagcagcttcatctgctttatataattgtcactgcagttttgcctgctgtatattaaaactgcatctcatagacccaactgtcacatcggatataccatctggcttgggatatgccaccttttctgtaattgtttttgacaacaagccatcacatcttgggtcttttcagaaagtgtctggtccagaatccctaggctgggtcagttctgacaccatgtgggctagaaaagtgacatcaaaagggagtgtgaaaagagaacagaagagaaaaaagaggctttgttagtctaggagccctaataacatgcagtggcagctgtccaatgaaggctctactttctcaatgtgaatgcacatttttcatgctaaattatatcatcttaggacagctttccatagggttgcatgcatattctggcccaagagcatgacatttgtcctgagtccacatttctacccagtgaggttctagagacatggagacagttcttcagacaatgcagagcatgaggttccataaaggaccatagaatacataagagggaaagcaaggtgtcagtggccagaaatctgtgtagttatcactcagaggaagttagatttgttttccaaaatgataagagtaacatgaaatccccagcactttgggaggccaaggtgagtggatcacctgaggccaggagtttgagaccagcctggccaacatagtgaaactctgtctctactaaaaatacaaaaattagccgggtgtggcagcacgcacctgtaatcccagctacttgggaggctgaggcaggagaatcacttgaacccaggaggtggaggttgcagtgagctgatatcacaccattgcattccagcctgggcaacagagagagactctacctcgaaagaaagaaagaaagaaagagagaaagagagaaagaaaggaaggaaggaaggaaggaagaaagaaagaaagaaagaaagaaagaaagaaagagaaagaaagaaagaaaaagaaagaaagaaagagaaagaaagaaagaagggagggagggagggagggaagggaagggaagggaagggaagggaagggaagggagggaagggaaggaaggaaggaaggaagggagggagggagggaaggagggaaagaaaagaaaagaaaaaaaatggagagtaacatgaaatcctttttgttccccataatccctattcccttggagcttgatcatgccaaatgcccagatgaaggatgacaaaagtatctcaggccagtgggcactccagttagtcaaaagggtctcagatatagaaaagcagggaaactcagctcacagagtcagctcacaggctgggaggagcccaaggagtggagtgctgggtctgcagccagaggtgagctctggggaaggagcgatttctctgtgttgatggctcccactggaccactgcctttacaaggttagagtatcaccagagaacagtattcaaaaacaagagaggagcagacagacagacaagaaaacaatgggacataaagtcttggtgggcctagagctttgacactctctcttagggagcagaacagactgctggctagtgagagacagatgctcctctccactgctgaccaggggtctacgagaatcactgctgagcatagaaacacatcctttgccttcttctgtcatttgtgcggtcttagtccatttgggctcctgtaacaaacaccataatctgggtggctgatagacaacagatatttatttcccacagttctggagaacggaaagttcaaggtcaaggcgctggcatgttcagtctctggtgaggactttctcgcagtgtcctcacatgacagaagggacgaggggtctctctcaggcttcttttactttatttatttgtttgttggtttattttattttgttttagacagagtcttgctctgtcacccaggctggaatgcaatggtgccatctcggctcactgtaacctccacctcccgggttcaagtgattctcctgcctcagcctcccgagtagctgggattataggcacccgccaccatgcctggctaacttttttgtatttttagtagagattgggtttcgccatgttggccaagtggtctcaaactcctgacctcaggtgatccacccgccttagcctcccaaggcgtgagccaccatgcctggcctcaggcttcttttataaggacaccagtcccattcatgagggctccaccctcatgacctaaacacctctcaaaggccccaccacctaataccatcgccttgagggttaggatttcaatgtatgtatttggcagggagtaggtggagggtacaaaaacattcagaccataactgtgtgcatgtgtgtatacaaaagaaagagtgccctttttttctttggaggaaaaataagctccctttctctttcctccatatctcctgtcaaaacctatttttcttgcttatcctgtgctataaaagaataaagaaggcttttgggcaccggggagtggaagaattgttaccagtttggcctttatataggatctaagaggctgggatgaggtttaagagaactggaaggaacaactatatcagatgtgtatgtaactaaattatacactgacattctaatctgtggccctggaaaatcatgatcgagtttggaggaaacaggcatgttggggaaagggagtgttttcctgcctcctcctgctggcttctgtctgtacttaaagggagaatcattgctttcactgttttcctttccccttgatggttcactcctccccaggagaggaggagcatctaccaagggttggtcacatcctgttcatgtgaaggtttactgtgctttaaaagggcacatttgagttgcctggggatcttgttggaatgcagattctgacccagcaggtctgggatggcccatgaggttctgtaactctaacagcctcccccaacagacacccatactggggcagggcagagaggacacatattgaaagtcaagggcttaaaggcaggaaccaaatgccggcttgcctctttcaactcctagaaggtcagcttactgtcttctcacatcctttctcgcctgtgctacccgggcaggccgcacaggatgcgggctctacctcttcaggatgcagctgggagtaagctcagagcctctcctaggccttcacatgttgtgctgtcctgcgggcacagctgagcaggtggataccaagatttagatttgggtgtggcagggaggacggtggcatggagaggtcaaaattaggcttcaggctgtatcagggtgatgtcagaaggacagaagccatttcacatgcaccaccaaaggggaaggttctcttaagcttgaccagaagctgctgtgaatctcaagatcctcagagaagccccagcccctctctcagtctgtagcagtgaagacactggctcccagaaagctcatctgatagaagatttgaacctgggtctgccagggtctggctgcagttgcctccaaagaatcaaagcctatctttctcctccactttccaaatctcaccccagtgcccatctcccaccagctgactctagcccagagccatgcagggaagaggattccaggaactattgttcctggcttttctgcaatgctaagcaaatgttagaaggcagtggtggtgatgtcaagttgacaaaaaataatgtagctcacaggtccaggatgcatgattcagctgagcttctagaaagcctggcatgatggggaggaggtcagacacttgccaagctatcaataaggtgatgcttcatatcccagtagccatagctctcatgggctgtgctcctacacccttccatcctggactgatgggattctggtccccatcaggcagccaatgccaccctctggcagctcgtctgtaacaactatcctccaattcatggctagcctacacggaggtgtcactcaatggaaaatgctttgcatcctatcctgccagatcctgattacagaggtcattttttatgaaggttttgctgtgttgcctttctgagacccctagacatctttacttgtaaccacctgcccagggtcccaaagcaaatgacaggaaagactaggggcagagtaggaaggcagacgtgtgtcacttaaggctgctttgcctcctataggaaaatgtgtggtctgacaagtgtcaccatttgctaaatgacttttagtgtccatagagttgccactctccagagattaccatcccttggtcagcagagtcctagaggcggctctaacaatagcaaagcttcattcccatcccagctcaatggcaaaaacatatactggaaggaaacggtcagaattgtgcagccagcttcttttcagtgctctgacatttagctgatgacactggtcatgaagccactccttgggaaagctgagggggtggctatttaaaggcttgtttatcctctggaaaggcaacctagtctgtgtgtgggtgaccaggtctcaagcctgcattctggaatggaaagaagaggcagcagatgcccctttgaaagccatcatggtgaccgcaggtttcactgccaggcaggctgatgtgagcctctttgaattactgagtgaaggatatccctcttgccagcccctgtcccctgcaggcacagcaaagaagtattacaggctgtccttaccttgggaattagcctgcaagactccgatgctgtcatcaaactgcatagatttgatgttgagtgacgccaagatgcattccttgtcctgcagcgaagtatcatcaatattattctgattggctgacaggataacgcacatgtcacagaggttgatgttgacagcccttaaatcagcccgacttaatggcgtaccctttggcatagaggaaagaaaaaaaaacagagatggggggagaaagagacagagagagagagagaggagcaaaagtgagaggagagggaaagaggaaaacaaattaaagattgagtcggagctttgggaaattatttaacaagtatcttttttatgccttgacattaagctggcctaactacattcaagggaataggagctgtgtgctaatctaaagggtagtcggtgctgatggcagcattttaagcttgttctcaatactcaatcaagctattactaacaaacgcgggagaggaataatgccagggttctacatcttcttcctgcctggaaattgtcttgatttaagtaactgtcctgtggcaacctctggctttcagaatgtaacaagggggtgggtttcaaatgcctgtttatttaatagcgggtcacttctgtctcaggcaaaagacagcagttccaatgcagccaaggagaaatggccagtgagcacagagtgatgaggtgggcctggatgtgcggctcaatttggaggctatggatggagtggaattaatgtgtgcaatgcaaaagagatatggaaaggagttaagcttcagatcatataattttattgcatattttcagcaagaaaaaaatacacagggaaatgacctaattgtccaacaacataggaatggagaaatatacttttggacatgcacacagtgaaaatgtatgcaggaggtaaagaggcagagctggctctccatgcaggcattggtttagaagcctaagatagagggggaagtgaaaaaaaaagttctacagcagttaaaaaaaagtatagtttcatttatgtaaaaaaaaaaacccacaaaataaaattacatatatataaatgtatgtaaatttggaaggaaagcacaggaaaaatagccattacactaataatggtaattccctctgggaagggaaataggattcgtgggggtgaggggaaagtttgcttttcactttatatacttctatattgcttgaatattttataacaagaacatatttgtatattacaggtacatttaaaaaataaataagccagtaaacagattttttaacataaaaaataacaacaaaagacagtggaaaaatcccagatccaggaagtaacaacagagtccgggaatgcaagcatagggaaaatagaagggttaggttaggacagggccatggcctccacatgctctgtgtcttcaggtgaagccacagcaaaatcatcaggccaccccatgccatagctccccagtggccacgcggcatcattttggggctcctgtctggccaccagcttcattggtcctctagcttgaatctagcttcctctttgcctgtgtggtgacctgagttaccttcaactcactgattgtgtagaccaagggtttgccaactgtcacatatctgggaatgtcctcctctaatctccctttctggagaactggctttggaaagagacttggctgcagagatggagcctatctaccctcttttatgagtcactggtagtcatgattctattctcaggccctaaaatattgtgcaactatggaggaaggggcatttagcactgtggttgctgctgagacacaactagttccaagctctggagcagcgtctttttgagagaaggagaatgccctcttctcctgtgatctcttggtacaaaacaagtccaaccaacttcctgaatcattttgccagtgcataagcttcaattgcctgcatccatattcttttaattttcatcttgtagggaagccagccgtaattgtgatataagatgatccctgtgcagttgtacacacgtgatttcaaactacaagaaatacaaatgacatacatagaaatcgcttatgtttctctgggctggccctataggcagggtactgtttaaccaataaactctgtgaagacataggtgaaggcccattttgtgaaaatctattgtgcttgagtatgttaaattttggagggtttgaaatgacctgcaaagatgacagctcattcatatacatgaagaaagatgagtgaacgtgtacaagggcacacagagccgggcgcggtggctgatgcctgtaatcccagcactttgggaggccgaggtgggtggatcacctgaggtcaggagtttgcaaccatcctggccaacatggtgaaaccctgtctctactgaaaatacaaaaaaagtagccaggcatggtggtgcatgcctgtaaacccagctactcaggagactgaggcaggagaatcgcttgaacccaggaggtgaaggttgcagtgagccgagatcgtgccattgcactccagcctgggcagcaagagtgaaacttggactcaaaacaaacaaacaaacaaaaacaaacaaacaaaaaaggtcacacaggaggaaacatacacaaacacacaaaacacacacacaaataccaaatatcacacatatacccatctctctccacacacatacacacacagactcatgtatcctggtaaaataataaaccctttacaaagacactttcagaggtcaggggactatgtggaggagcacatgacagaaagataaccatggaatcatataatcaaatcgaccatatttctggaatgagcaaagcatatatatgcttatgctctcctctgtgtatgactgtttgtctataggtgactattttcaactgcctgtgctcactaaggcagtgggtttttggcccagcatccaaaagataactgtccgatctttttctcactcctttaaatatttattgagtccctattgtgtcaggcattatgtaaaggcacatggtggcatctaatgagtaacatgtactgcttgtggatagattcttgtgtgttctttaatgaattatattacttggctctttttccccccatttctgaggttttggaagctgataacagaaataatacattttagctttgtaagtgggggaaaacccagacttcttaacatgtagagaaatccatgttcctcagttgtttcttgttttgtttttgtttttgtttgaggcaggctcttgttctgttgcccaggctggagtgcagtggtgctttcacagcccactgcagcctccacctctcaggctcaagtgatcctcccaactcagcctctcaagtagctggaactacaagcacacgccaccacatcaggctaatttttttaactttttgtagagaagaggtctcaccatgttgcccaggctgctcatgaactcctgagcttaagtggtcctcccgcctcagcatcccaaaatgcagggattacagggattagccactgcacctggcccctgtttctcagtttcagggatgtgaacttacaagaaaaatatttggaggataagtgagatttgcatgaatttgtgatgtggagaattacatcaaatgttgaaatgcataattctctacaatgttttgagagtttgtggactatgcattcattatgattaggaagtagttaattacatgactcctaaatcccatatcctcacactaaattgtggagtcccagactgttttttcagactgaagtcctaatgttttgcagtcaagaatatcatgcacacatgcacacacggacacacacacaaacacaaccatgaacacgttgctggacttctaaatgaacaggggttggggctgagctgcagaaggagttggccttctgtacagcagaaataaagaactctgttatttgcatttatttagttaaaaacagaaggtggcacagatcaatgtttcttcaagcattaaaaatgccataagtataatgctataaatagttctgtaagcaaatccttactataaacatcataatataacaatgctctaggttttgtataggcaggagtgagagtgtttagacgctgatatggttaatatacttgatacaagctaaacttcatccctgatgagggactgaacttggctgcaaattccttttaataaggtctcccagggtttggattttccttgacagagcataggggaagtgctgagtcctcaggcccatacccagatgaagaagcacaggcatgatcaaagctacaactattatatccatccgggattttcttttgtgaatgaaaagaagaaaaggcatcaataatgtgaccttggacttacaggcaatatggacactttggggaagttatgaagcgtctcccattcccgcttgaggtactcaatagagcccacaaacacaatgtgcttgagctcatggtaatgaaagttgctggcacggagcggcatcaccaggttccggaggccgatcagggctgagctgacgtcgccaaagatgcagaccacgacatggccactcaggacggtcatggcagcttcacttcgagtctacaacagggagaagtgggtaagagtcagagagaagactgcatagggctgttgtaaggagtgaaataaatcatttgtgcaaagaatcaagcaaatatttgctgagagcttactatgtgctattatttttatttcatcaatgttatatacatgccatatagagctataatttgagcacgtgtatatgtattatatttttgtaataaatctgtccaaatgtatagccatacacattgctaccttctttgacaaaagatttaagaaaggtatgccataaatatgtgtgagcagaccttcataataattttcaggaggtaaaataaaaaggaaaaggaatatttatgctatttggaaagagaagtcttagtttccatgaaattgttgattaaatgagctgccttttctggcttgcttgctgagatgatgataaaatggtcagatgcctgcactgggctcagtgggagaaatttgactttagaattctagacttatcagtgagatgtccgtgcatcagcaggtggaacatgctacctaaagccaggagtggaaaactacgacccacaggccaaatctggcccactacattcttttgtatgttcagtgagctaaaaattgtttttgtgcttcaaaatggttgaaaaaaaatcaaaagaagacaatgtcataatctgtgaaaattacataaagttcaaattcccataaagttgtattggaatgcagccatgctcatacgtttaggtattgcctatgggtgcttttatgctacaacagcagagctaatcagtagcaacagagatcttataccctgaaaaacctaaatttttcattatatgacttattacagaaaaagtttgctgacccctgtccaatgctgccttggactttccagggacatttctggaggggcctgttttgcttaaatcattcagagaaaagatctccccaaataatcattacaaggggctagagagagattagtaagagcaacaggccagtgtcttcctccaactccaaacctctatctacaaaggagacaaatgaaagaacacagtcactctattagaggagaaccccaacttcccaggaaatacaaatgtttagtcactgctggccctttgattcactgagctagtgaagccaggaggccagccgtggacctttctctgcctctccttctggttcaatgcctcccattcctgtccacccactgcatgcctggatggccccatgtggcttacaatgctttgggggaggcatattaatgtccactgtacatatcaaactctgcttgatttaatctctagaattgaccactgcattgattgtataaatgccaatgttgcaattcacaacaatgtcagggttattacagtaacccccaaggagaggaagaaactagctttcactctctgatcattagaataaagcaggggctgtcaccattattggtttccctctgcaatagtccagggaaaccggagacataagctgtaagaaatgccttagaaactgtgaccaaggaagacccactggggagctcacatcacatatccccacttcctgcagaagacctggagttagttatctgggccgcacggaagtgcaagtgcctgggtgccaccaggagacagccaaccagtctataaagcactgttatgtgatggggctcctaattatttgtaattggccaggtcacctgggaggctagctcccttcaacaagccagaggaatataaactgggcccagggtggaagtgaattctagaatagggaggtggggaaggcacagttagttgagtggccgaggcacagatgctgaccccaggaacttcgatctgggatcaaaacacccatcctcagactggccacagctacatcacccagagaaccttatgaatatcctaattctagagcctcagccccggtgtgtctgattttgccgggtttaaagcacactagagagagaaactgatcatttctctatgtatctggaattcccatgcatccttccaggcccaacccaagcacaacctatgtgtgtatgacgggacttgcctggtcacttaaacacaccctagtccttctcccctacatttcaatagcattttgcacctcttaccacttagctttaaatacactgtttcatgggttacattttatatcttctctctaattaatccaggaaattacaattgggactatctcttatatcttcaaatccccaaagtagttagtttcccgtgcccagtgggtacacaacctcaaagcatcctcatgtagctggccctacctgtcattcttatctctagccgtgttactttagagagggcttcttggatcatactttccagacagcacctcccagtctctttctagcctacaatgctgctttacttttttcaaagcatcctataaatatctgaaatgttattaagtactcatttgtctacctagagataactcctcttcccccagccccaccctgctagaacacaaagagataactcctcttcccccagccccaccctgctagaacacaagctctgtgagagcagtcgttgtcagggattgcatctccagtaactagaatggtgtgtggcacatagtaggcctcctggagatgttttgttaaatgatgttatttttcataggatagaagtagtaactcacctccttaaacttttttatgctggcaggagatgttgattgaatatcagttggcatgcatactacaccaatatccaggcaagtcattaaaaccctaggtcccagatacggcatccagcctgtgacctgccacaagtggtaacatcaggctaaatttaggccaccagggcaaaagtgccatgaatacatcagaatgtacatatatggctgggtgcagtgactcacgcctgtaatcccagcactttgggaggccaaggttggcggatcatgagctcaagaaatcgagaccatcctggccaatatggtgaaaccctgtctctactaaaaatacaaaaaaataactgggtatggtggcgcgaacctatagtcccagctactcgggaggctgaggcaggagaatcgcttgaatctgggaggcagatgtttcagtgagctgatagggctctgcactccagcctggcgacagagcgagactctgtctcaaaaaaacaaaacaaaacaaaaagaatgtacatacgtgaagcagctttgcgagtagaacaatttgcactcctggtcagttggacaacagctgtttgctaagaattctgactttctgtgctcttgcctgcaactttcccacctctgagacagcctccagcttgatactgtattggctgttaatgctcatttataattaagctgagaacacacatacacatagataaagcataggggaaagtccagtgtgttagcatacaaagccattccgaggacccagaacagtccttgtttaggaagggtggtcctgacatcagaaatgataggattttcctggctgacaaaaaggaacagacccataccaatctggggattagaggcccaagggagaaagaacccttccatctgactttcctgattattaatccatttctcatggattagcaagacaataaactgtaggaaagccagtgtaggcattaagacccaaagctgttaatagaacaagggcagagagtagaatggattgttacctatgctgacattcctgggagagactgggtgagcccactgctgctatgaagatgttcacaagccttccacgaaatagggctctgagccccagcctccccaaggggactgtagttcattattgtcatcattatgtcatgcatcatcatgcatttccctgtctacaacatgcactaagaaagctcacagatgcacaaggctattatctataagaatacaaaacattgctataaaccaataacaatacaggcagcattcagctttcctcacagcatttaataatagtaagaataagaggtaactttactgagtcatctgttggattttaatcttcactacagccctatgagttagggtcattctcatctcatctttttacagataagaaaaccgaagtgcaaaaagtcaaatgaattacccaagccatgcagctaataattggtacaggcaggctctgacaccagcgccatggccacaggaattatgttcataccacctcccaccatggctttcccacagcaagtgctcacctactcttatgaggagccaatatattcagagattgaaaaatctgaatattgcttatgttctgatcagaggtctagctgcttcaatctatgctcagaatttcactcatcaaaaataattaggaccagggacagtattatcccactgtccaactagggaaaccccattcctagcaaatgtggtttggggcagaagcgggcaacatcagatgcacagtccctcactcaccaggatgactttctctatctccttgggtgcacaccagtgaaacatcccagtagagtcgtacttcttcacattggagtccatgttgtcaatctgatcattgccaggaattaacaaggggtcatgcctgggaagaaaaggacaggaaaacctaagtggaaaatgtgataaattataaatggaaagtgccccctgaattacatctcagaggatgtgaaagatgcagaggaagtggttgtcactgaaggccattcttctgcttacagaatccatcctttgagagacaactgccccaaaccaccaccccacttctggaagtgcaggtgacctttgtcagggagcatttctgcctttcccccgctcctcttttcctaaatggtcttcctaacattttgtggattcagcctccctttttaaggctacctcactcctcttcctctcattttaccagctattcgatctccccagcgtgcacacacacacacacacacacacatacacacacacagacagacacaccaaagggttgctatgagcctcggcaatgaagaggaaggaataggaatagagcctcatgctgactgactggcatgaggatggaaagccaattactcgctccttctgactacaacttctgacgtgatgctcttcgcagtaaaagctttaacaggctgcactttaaatattttagcaatttgcccaatcagattttgctctccctggctgaagcctttaaagattcagcagcatgtcacttcagagcagactgactaccaaatgcccacatctggaatacatgatttcaatactaaacaacaccctctctccttgccttgacaactgtatatgcactaaccatccaatgatgctccccaccaccttcacctcccaactgctgcatatcttagatgagagcctcaagctcagatgcatcttaataaacttgtttcaaattctcagggcaacattcgccctctattgccttgtctattggtggaaaaggaagatgcttccataaaggcctcccgtctagtgggttggcagagcctcactgacaaccttaagaactgcaatggaatcaggcagttctaacaagcttatagcacaataaataagctcctgcaccttgaatcatagtcaatgtccatgcttttatctctgatagtgattcagcacctcgggtttgggaagtcattgttccttcctgcaaaactggccatataattaggacattgtcccagctatacttaaccactcttgaaatggagctatcttttctgagtaatattgtcaacacaagacagaaaatatacatcgggtcacattccataaattgtaaagtgattttaccttttgaaattctatatttcaacatcagagggtgacttttttcttttttctttttttttttttttagacagagtctcgctctgcagaggctgacttttatttactttttactatttgtccttctgaaatgtctccgatacttcccacttatatgtcaagagtacagagtgggacagcaatctcttccatggcccaaaaacctaggattaagcttttgaataactaccacgaccctccaatatgctccccactcccacataaggtgagaaaactttctcactgcctttatttatgcctgagaatttgcttttagactacaccaaatgacaaatactatgtgaagccaacttgcaaagttatcttcaacgaacatgctagactactataggaatatctgtcatatctgatcttaaaagaagaacaatcccactccgagtagcatctcagtgtctggattgttgagaggtcttgaggtatgtaaaccaccaggccatcttccaaatactgaacttagtcaaagatgttaagataaaaaggctgataagaactatttacagatcagggtgagagcacattttgagggatgtttttgtccttgaagagtctttaacagttgcatagatatctattaatattatctggaataggtaggtagacaaaagccatcatggagaagaggtttgagaaaatgaacaaaattaactctttccagcccatgaagaacatatttcagttgcaagaggatattagcagacttgccctgaagatatagagccaggttcaaattctcttgccctgtttactggttggagagaaagtattacctcaggatgacctgagacctgcccctagtgcatttaggatttaaaagatactcagaactatgttcccataatatcagcaagcaagcaaatgaaacagcaagctgacaaaaaacacttttagaaaatgtgtgccttggggaagaggagatacattttggtttggtatacttgattctttctgggaaggagtcagacgttgttaacagtggcctacaactttcatccagaaaagcaaataagcaagcctgatgatcgatcgcccttcaataaaaagaaaaaagacagctaatgtcaagcttcattaactggggtagtggtttccagaaaccaggcataatttcacactggagctcaagccatggtttgcaatggaacatccagaggcatccaggaagtcttagaggtatgccacactacactctactccccacacatctctcatcctggcctggaccatttaaatataaacaatccaggatttcccccaagagactgacctgaggaacatcaaaaacctcccggaacaaagacattaccctctctgaccagcatggtacctggaattctaactttggtttattgaatcagtaaagcaaccaattgaatcagtaaagcaatcaataagaatcccctattctgagcatggaatggaggctacagtaatgattaagataaagtccctagtcaaagagaggtccacaagatagcaggaaaaaaatatatatacaccaatagttcaatagttacagtaccttgtggcaagtgttacagcaaagtacaaggtgatacaagaataccaagaaaaaagctgttcatatcctggtatttgggtagcattaaggaaggttttgcaaagaaagtagcatttgggccgggcgtggtggctcaggcctgtaatcccagcactttgggaggccaaggtgggcggatcatgaggtcaggagatcgtgtccatcctggctaacacggtgaaaccccatctctattaaaaatacaaaaaaattagccaggcatggtggtgggtgcctgtagtcccagctactctactcgggaggctgaggcaggagaatggggtgaacccaggaggtggagcttgcagtgagccgagatcacgccactacattccagcctgggcaacagagcgagactctgtctcaaaaaaaaaaaaaaaaaaaaaaaaattagcatttgatctgaaccatgagaaatgaagaggaatctcagcatgttgcagtgttgatccactaatagccagtaggacccacccagagaattgaggcccaaatgaaaagggccaaataatggcacctaaaaccatggctgaagatgccccataccataccacctaacctaaggtacagaagactcagaccaggccttccagctgtctccagatgtgcaatgacagtcaagttgaagatggattaaactgattgagtatgactgattgacagcagactaagaatgatccatgagattaagagagaacaaaaatcatggttccaaaacaggaagattgttataaaaattgaaagtaattcaaaaatgaaatgagttgttgcccaagacagtgggttttctatcattgagccattccacaagagcaagggatacagtgagcatatgcatataaaggttgggcgagcctagaagatcctgaaggtttgaagcactgtgctgtcactggagaaagacacagctagaagaattttgaaagtactggaccattgttggatatcagaaggctggagagccctgagtaggtaaagaaaggttgctagagtgaagatgagaggtaagcagcgtgggagagggattaatttatggctccagtaagggccagcactgttacacactcactggatttcacagtctgggagtaagctgggaacacaattcgttccagcaacaatagagtctgtaactgtttctggccagacagtataaatttctttactatggctgttgctgtagtaatttcaagtgccttaggctggcctgtgctgcagagagatctctggaacaggtggagagtgtacagtcagttgtccacagggactaaatcaaagtttctaaagcttctattgctagaagaaagtccaagcatttgccattgagcacaccaatcaacactgctgtgatccagggagacccagaggaattgggccgtttgttgtatggaaaggaggatcatgagaaatctccctgaacaagggatcccaacatcttcagtttgcaaggtgatagagacccacttccaaagcctctcccacaactcctcaaagaccagttagttgaaatcaaggaccaggattagatattgtctttcacatcataatgacattacctaagtcttccactcacaaagtaattttcaatttccctaaaaggcaccataattaattcaaggctcacttgtcacttgcgacttagccaatgtacatgccctattttagggtaatagaaactctatgatgtgagatatatctgctgtttcatttttatgggctgaactgtgttctcccccaaatttttatgtgaagtcttaaccgccggtacctcagaatgtgactgtattttgaaatatggtctttaaagaagtaattaagttaaaattaggtcattggggtgagttctgatccaataggactggtgtccttacaagaagaggaaatttgggccaacttttccacaggagggaaaatcatgtgaagacagagggaaaagacagagatctgcaagccaagaagagaggcctgaaacagatccttccctcagtacccttgggaggaaccaaccctcccagactttcatctcagacttctagccaccagaactgtgagaagctctgttgtttaagacactgggtctgtgatacttgattacagcattcctagaaaattaacacaatagcccaccttgaagaaaaacaggcacaatatatcagatatcccttagctgaaggcccccggctgcccttcttgaatcttaagtttttcttgtccatttaagggggggaaaaaagcatcccgccattatttcaggaatacatagacatatatatgtaatacccagtatctcctctaaaggttttcggccaatatccttcccctctccaaccaccttctctaccccaccaccaacatacaggcatgttagatctgctctgccagagtggtaacttctctccgtctttaacttagacatgcatttgaggatcaatgccaatgaaagcccagcttaaagcaaagaggaagcctgaacactagccagctaatttgagcagtctgacttatagagtccatctccaaatggagtgttcaggggttgataccactaagggcaggaaaccacctatttccttagtgacagtataccatagtggttaagcgccctggctccagagccaaaatgtctgtcttcaaggcttggctcacctattacttgctaagttgtacattgccttagtttcttcatctgtaaaatgggaatgttaatcattagcattattcaatggattccatttgaggattacatgagtaaagatatttcatgccctgaatacagcatctgacctagagcatgtcctcaagaagtgttaactagtcttatggttatcatcctttatactttgcttaggacccactcatgtattactagctctgattatggtgaaaggaggcaggaaagggagagcagttcaataataaagatatagagctactgctattatttctactactgctactattaatactactactattgctgctactagtgctattaccattgttgttactatgatgaatagctgccatgagtccaacacttccaaatgttggtgcactaaaacttttacctacattttatgatttgctactcacaagaacacctgtaggtaatttctgttattatcgggctctgtgtatacatgggaaacaaaatagataagtaacatgctcaggtggcacagccagtgagaggagaggcaaagccttaacaaaaaggtctacttggctgaaggccagtgctgcagggtgcccacctcataccctcccactttaaggaggcagccatatcttgttcattctccatcaaaacaccccaagttgcagtgttctaagcagccaagaaagggaaaccagcatcgcaggcatttacaaaatgcaccacttatgtgaatgattagcagaaattcaccccataacccttgcatctcagctcaccctccagtgtccacagctagaaattcagtgtgcctaaagtctaataaggaacacaggcatggccaagtatggtggctcatgcctgtaatctcagcattttggagggctgaggtgggcagatcacctgagctcaggagtttgagaccggcctaggcaacatggtaaaaccccatctctacaaaaaatataaaaattagccaggcagatggtgcacgcctgcagtcccaggtactcaggaggctgaggcacgagaattacttgaacccaggaggttgaggctgccagtgagccgagatcacactactgcactccagcccagcaacagggccagaccctgtctaaaaaaaaaagaagaagaacataggcatacctcatgttattcaactttgctgtattgcactttgcagatattatggttttgttttttttttttttttttttttttttttacaaattgaaggtttatttttccattgctagagcacaggcagagtagatttcacataattcttaatgcctatgggattttcagaatgttaaatgagctttgacttcaacttaaagtcaccagctgcattagttccaacaagaatcagcctgtcctttgaagctttgaagtcaggcatttacatctgtttacagcatgatctactgaatattttaatcctgctgttgagacctactgctcagagaaaaagatttctttcaagatgttactgctcactgataacgcacccaattattcaagagctctgatggagatgtataagatgaatgttgtttccatacctgctagaacaactaccattctgtagcccatggatcaaggggtaattttgactttcaagacttattacttaagaaatatatttaataagctatcactgccatagtgattcctttgatgaatctgggcaaaataaattgaaaaacttctgaaaaagaatcgccattctagatgctaataagaacattcgtgattcatgggaggaggtgaaaatatcaacaggagtttggaagaagtgaattccaaccctcatggatgactttgagggctttaagacttcagtggaggaagtaacagcagatgtggtggaaaaagtaagagaaatagaattagaagtggagcctgaacatgtgactgaattgctgcaaactcatgatcaaacttgaacatatgaggagttgcttcttacgggttagcaaagaaagtggtctcttgagatggaagctactcctagtgaagattctgtgagcattgttgaaatgacaacaaaggatttagaatagtacataaacttagttgatgaagcagcagcagagtatgaaaggattgactccaattttgaaagaagttctactctgggtaaaatgctatccaacagcatcacatgctacagagaaatcttttgtcaaaggaagagtcagtcgatgcagcaatcttcattgttgtcttattttaagaaattgtcgcagccaccacaatcttcagctaccaccccccgatcagacagcagccaccaacactgaggcaagaccctctaccagaaagaagattaaaactcactgatgactcagatgattactagcatttttaggagtaaattattttaatgaaggtatgtacacacttaatagactacagaagagtgtaaacctaacttttatatgcactagaaaaaaaatgtgtgttacttgctttattgcgatattcactttgttgtggtggtctggaactgagcctgcaatatctctgaggtgtgcctgcaaaagatctttgttttgaggattcgcagagcaagaaatgccacttggcatcaattaatctcaggaagtgaactaaatgccctgctacaacaggaacagaaaaagctcgccttgaagacaacagcctaaagcaaaaccacaaatcccttttctagcaaacctgctgtgaggaagctgatatcatattttaaagtgcacaatttcccttacaggcaaagacagcaaatcccagttccttcggtggcactgggttcaacgctggacttcagaaatttacatgaaagtacaaaaaaccagccaaacacacaaaaatgttatgaaaaaggaaagttacaaaatggctagaaaattgcattcttttctctgcttgattttcgagacctcatgtcttatcacacgataaggccttttctgtcattatgagcatcccatccaaattaagggcatcctacagtggtctccctgggagatgagaggcttgattaaaaggaggtgaatttctcatccctccacagaccttttatccgagctgcaaatactgactttattgagcatctattatgtaaggcaccatgatggggctaacaagacatttctcagacttcacagtttggctcaagtgttcctcataaagccatcatcctgaacagccagagagactgaagttattttcccttcctgggaacttctagagatgctccttcggcaataataatttccatgtctgttttatccattagatggtgaactatttaggggcagggatctattttgctcttccatgtatttccagaatccagcagaggatgcaatcaaactaactaaaggaactgatgaatcatctctagtccccaaacactcttcaagcagtcaacagagactcagcaaacctttcgtggagatccaaaacgtgtgcagtgagaacccatttacctctgatatcttgcaacaatttgtttttgaacaatcagggttcttgcatcatttttcatttacagggactgcgtatgaattaggacacagagcatttgctataaaaagggcattgtgatgtgaaggacaaccctaaattatgtctctaaccagtcaaggctgcctgaagttcgcctggagccagctgctgtaactaatcagcagggaggactcatgtcagtggtcagacagatgttcttaattaagcaactatttggttctccagtgcaaagtctgaacacttcttagagatgggcccccatcacttcaagctcctctcactgttctgattcttcaaaagagtggttctcaaactgtggcccagaccagccgcatcagcatcacctggaagtttaacagaaatgcaaatttccaatccccaggccagatctgctgaattagactgtgtagggctgtggaccagcaagctatatcttaacaaagccctccaggtgattccgacacctgctaaagtataagaaccaccactataaagttttgcccagatggagaatctatatggcttcagtaaatcctacccaagttagcaattgtcaacaacacacagattataaggctgtagttctattcagcaaagccaggactacagctagacaagagggtgcctagggtgcaaaattgaaggaggcgcctcacattctgggtgcctactctgattctctgtgactctgtggaactcgaggcattgtgtcaacacttgattcttgatggggatttactgactagatgctgcactaatgactctctcttgctgacttctcttcccatgagctaatcagcaaataaatttaaacaagcaaattaaatactagtcctcgcaaagtgcaatacttacaattcagtgttctacccttctttaacaacatggtatctagtcactaagaccttgagcacaatgttcaagaatatcaggccacacgggtctgtctgagcctgtatcagacacagaaggctggattaggccttaggtggtctcctcaaaaggaatcatagttgggtgttcagcaccataaatggttccaactggatctgcctcattcttgggtgccttggctcctgggtgattactatttcctgatacttcctgaggctttgcagagcaaatcctggctcctgccttaacacatccttcaacagggcttccactcttctgataatgatcatcacccccgagacaccactgcccaccaccctctccccatctcccacttgacggccatccctggagccacactgacaaaactctcaggccaggctgtagccaccctggcagaactagggtccttttcaatttctctgcatctatctacttgcattattttccctgctgccacctaagatgttatctagtgttaggcagccagcattctcagaagaaggaaatggttgcctttatgtttgggagacagcctgggagaaccaacacgttcatcagtcctacaggaggttgtacaagatgctcttgacacaagagggcaaggtcatgaccatctgctgagcatgaacttgtccagggacctgtgtggtccacccaagcctcagtaccatgacaccaactacttttttcttctccagtcctgggggaggcctgtcatatgctatcagtttgtgcattaagagatgaatttacttagctaagctgtccctgccttccttctttcttttgcccagtggaaggaattgtgagggtgacttggctcagtccattttgccattttctattactaaaatctttcatgctagcaggctctgatgtgagaagtcctaacaaaatgaccccacgaaaggtttgagtcaaaagagaggtgatgagacttaacaagtagatgagtttatttcacttaatgaccaggagatgcccaagaggataatctgttttcctcaaatcatattttgcctcccattcaggaaactaatgtctaatattttctgggtctcctgacatgaaactctcctcaaaatgttcaatttcttttttctgggtgttgtcaattatccttgccagcccagctgggtgctatctgtgtaaactgtccacctgatacatcctatgtaaatcctaactttcactgaagttttcattgaaagtttatagggttggtaaggcccccaaattaagaactcttgacctagctatttagagacaaagtctgtgctccccaggactttacaaatgaggaaagatgtagctatccttacaaggcaccaccccactaagtagggagaattgggccacgggtgcttgatgattttagaggaaaactaggatgattttagaggaaaactctaggtctcaggactgatgtcaggaattacgtgtgtccttgggaaaactatgtatcccagtcctggtctactattctacagcagaccctgaatggcttagcacacaaacggccttggcagaggctggggttgagtgggccttctatttcacacctctgtgcttatgtagtgtgtgtctcagaaatctcctgatggaggactcccaacccttctctctgctgccaccagtgattcccccaaaacacaagttaggttaccgcctcctcgaaaaccttcaggggttccctaatgcctatgacaagcaaaaccttcatgactgggtgccagaatactcttacattctccactccatctaggccactccaaagacccctggctatagccacacccaggcatttactgtggtctgagcactgtccctatgtcttccatcatcctaattagggaaaacttacctagatttaccagactttacatttctgtacctcaacatactcacctgtaaaatgggggcaagagtaataactacttatagagttgtagttaggactcagtgagttacaggcatccagtctcggtaaacctagacaagtaatattattagttgagcattctcctcatggtatggaactaggttcaataagacctcctcctaaaccaggctcagcctcccaaaccagaggtaatgacagctctttctattctcacagcccatgctagtggaacccccagcttgttcttacccaattctgtgtttttatgtgcttgtcttctcctctgctaaactataagcattttgaaggcagggatctaatctaatctattagactgtgtggaagttctttaagggatctaaagtcatttgggtgctagactttagattccttaaagaacttccatgacaacttgcacacagtaggctctcgctaaatatttgctggatgggagctaatctgagaaaaagattaaaagcaggcagccgaagtgcacagactttttggattccatgtgaggattcagtgtgagaacccaggtgtttactccataccacctacccattggagaaatctcatcaaccaaaaagcatttgtacgtgcaactatgtggaggtggctctggaataaactgaatgtgattgtaaccagggatcctgaatggagatttcaggaatccattaacctgcttcaactgtggtaaaaggggatcaagtgtactttttattttttcctagaaagacttcctagagagttttcattgaaggttcatagggttggtaaggcccccaaattaagaactcttgacttagctatttagagacaaactttgtgcccccctaggactttacaaatgaggaaagacgtggctatccttacaaggcaccaccccactaagtagggagaattgggcaacgggtgcttggtaattttagaggaaaactacgggaggctccttcaataattccacagtaagagaccgggaaggaagggaaataacaggcagagagagccggggacttggaagcctccatggctcacacctcctctgcgggtgtggagccaaatttatccatcattacacgtgtgtcctcagcctggggcccagacactcgccattcagctctatctggacatgagggttgttttctgttgaggtgactcaaaaacatactacctcaggatccagatatacaaaacaaggctgttcacctaatgatcgtgcagagttaagtgacacttaaacactagggtaagcctgatacaagaacaaagggaaggaaaagaccattagtgcagagtccccgttgcatctcctgctggcagatgatttggaaggagccttcacgcaggagtctgttttatttgcagaagccacagtggtaaattacagcccatcctagcccattctgggttctccagttcctcttggagctattcctgtcactgcccataggccactaaaacctgcccgcattcagaatgattgattctgctcaaactgcaagtcacaaactcatgtcgaaaaatccacttcaaataagtcattagcttcctttatggatttttcaggtcatgaggaataggacctgaaagtcccatttactggagagtagaaagcaggtgtcggaagaggcgggggcaactggaaaagccacagggagctgggagagcccttgttttctgccaatcaacaaagggggtttagcaaaaatggacccatgacttcattgccagtgccagatattcaaatgtaaaacaaagggccctgaggtctttctgtaaactggaagtcaagggatatggagagagggctcaggaggggtccatctttgctcccaggtcagatggagaatgtggagcacctgggacatagaaagacgtggtaagggaggagtgtctaagactttctcacttgtcatgggatggcccattccagctgggctgcgaagggagaccatggtgggctggtgggataagacatcccagcgacaggaactgaggccttagcagcagcccaaaggcaaccaacatgagaagcccgagttctgtagcttggcaagtttccactcaccacctgacccacgtttagcaattttgatgtaccatgaaacagacagctccagcccaggatgactgcctccctcagcccctctccagcaacgaatgaaagcaagatccactttgaaaattctcccccatcatgcaaactgacacaggcatgcttttcaaaaacccacagccaatctgttgatcattacttatttacaaaggccttcgggcagaaagtcctgtaaaaaccatacttgatacgatatacactagctttttctgcttgtggaaaaaaagtccccccaaggctacctcaaaccatcactttctattgcacataaaatgtagcgtgtaacactaaagtatttaatatatatggtataatatatctacaggaaaggcatttgtgtagaagtatgttaccctggatttggtaatttgatgttttgctgaaggctacgacttaaaaaagcctccacctcatacagaagacctgtcatcttggtacccaagagccaacagaataaagaagtacccttaagcagcaaaactttgacacagctttgaagcatatgaaaacagtataactcctcagaattattattactcaagatcaaagaaatgagccatactttacatagcaaacagggacagggaatttggctccaaaggtttcagatttttcagacttctctttatttatttatttgcttctctaaatttaggtgaaggaaagtggctgggcttttctctactttaaatgggaataactattagaattagataaggtgattacctaaaggtgagtaaataggaaatgaatgctagcatgacactggcatcataaaaacgaaaagcttggcagttggcacattttattcctcctcataaactgtaaacaagcatgcaaatcagccaaacccaaggaaggctgggtgaagtggaaggcagagaacttttaaggaaacatttaacaggaatagatggtgatatggaaaaggagttgggcagggtgagtcttccacggaaaacctgtgtcctcaaccacatgaagaaagactgcccttgcctattttccagaaaggtggatgtggagggccaggaacatgcaaatgttattgaatatggggagtggaaatcaccactattctatttcaaaaatcaaagccggtggccatgaaaagacaaaactaatgtcaagatggcaggcatttccagagcagaaaccacatagggtgagcagtgcaaatctgaaatcactcctgtttcatttgggtggtagagagtcaggatgtcggaggaaaaaaatgctgggattggcagatgaattgaagacaaaaaggggagataaaagacagataggccaagaagaagaaactgcagaacgctgttgaaatttgacttcacttgctatttaccagaggaagccatagtcaagaaagaagtgagggagaaagagagagaaggaggaagggagggagggagggggaagaagggaaggaaggaaggagggaaggaaggaaggaaggaaggaaggaagggaggaaaggagggaacatgtacatgcatgctgtatttcataattaatattgcttttagcctgagcagaactggattacttttgaactttgctttggcaagtccacagattattagactttttcttatcagtcaaaatcaattaacagaaatttgatttcaatcgacaggataaaaggaaggtaatcttcaggttcatttttgattgtgatgatacatctcacatatggccttaagtacagaaaacagtcctcggagggactccagcagaaagagactgccgcaggcaaactaaccacacgagtttctctgattggttaccgccatcattagtgccactgctgtttaggaactacacacagacaggacatggtgacagctaagactttaaagcctatgtatttttcaaacagcttttcaaactgtttttcatgacagaattttttcagctctatcattaactgctgacaagctgacagaataaatactccagcctttaagaagccatctaacgatctcgctcccctcccccaccccgggcttgctggggaggggagactctgggcctggcagggtgaggagagggcgaggggaggaagagaagggctaagagggaaaccgtgggcaaccagcccctctccttacctcatcagcttaggcgaggtgttgggtgagttccgcatgcctccattccgttgctttttttttggtgatagtgttgacggctgctcatcttcaactggaaatacaggcagctcatgagattatgaacagtttgagggcagactgtgcaatacaggcaaaatatcaaaggacacacactcaaggctcagtcactcactaggaattcatggctgtcttttaggacccaatgacaaagaccaaatgtgttagtcaaagaggccggcttagagaaggtgaaggcaacacctctttacactccagcctttgaacatacactttaaacagactaaaacagtttgtaaacaccctgccataagaaaaaaaaaaaaaaaaaagaaatcatgatttatctgtataccaaaaaaaatacttatcattattcttagagttaattttggttactttgctttgcccagtaatagactgcgttttgttgtaaccaaaatcagaaataaagttgtatttgaaatgtcagcataactgccagcctgctgcttctccagatgaaccaacttagctggttcctaacccctgcataccagagaaagagcgttgaaaagaggcaaggattcaaggccttgacagccaatgtttcaatcagatcggggcacattggtgcatgctggctcaataatccccagcccaactcagctcttatccctccaactgccaggagggagggcttgtggggctgtgccaacggggtcctttttcaacccatgaagacaggagcaccggggctggtgaggttggaggagagccccggaatgaaggaggaggttgccattgaatgaaatctctgatgatgcagcagcggggcagggatggagggcagcacaggggattggaaaccaaaagctgttttccaaatgtctaaaccacacagattgctaagcaatgtgaagcttcacttagaaacaccacagcacactctactgctcttgcccaaagacacccactaataagctttgcagatgtattagcctgcatcatgcttctttttaagagaactgcttgataattagcagatgcaaacccagcctgtcacccaggggcatcagcggcaaaattctagtcctcctctccccacccccacaattcaggctaaagctgtaatatcaagaaggaaaaataagatctttggattcttatagttgactgcaacacagactaggaggaaagcaccctgaaactcagaatgcacagcagttaccttaaagctaagaagagaaatattagcagtgatgacatcaaaagagacttgatatatgttaatggtgtaggagtcttagatgggggagaaagtgccatgtcagctacttggtattatccaggaagacccatattagagcatgcattatatggtacttccctgaaaacgctaaataaatttagtaggttatgatacatgcttccaaagctattttaataatccaactaccctccaaacctgcttcaaagtattacacattttacactctcctattctgctgtcagtttgggcttgtctaaaccctggctgatgcaggaaaagggaatgactgtggtgtaaggtgagagtgagaccagaagagatgaaggcaagaaagcacctgcaaacacccacagccgaccccctgtaccacctgcttcctctgacacccaccagggcccaagctcaggccgagactgtatcagtcatttagagctccaggcagagactatgtggctgggatgatatcgcatcttatcagaaatgagtatccaaagcaaatcacacagagactaaacagcacttaaaagattaaaggaaataaatacaagccacataaatggtattgaaaaaatcacttagagttgatatgcatctctcggcaagcaaacaggcactctgagcttgacctgaattcatcttcctttcacaggataggggaccaggcatctgaggcaataatggggtagaaaggcagcgagggtgtgtgggtgtgtgtgtgtgtgtgtgtgtgtaggtatgctttcgcactttccccatcttagaatgaagtagaaagtcttgcactaactagacgtataagacaaggtcatcttttaatatgggccacttgcaattggtgtattgtgttcagggtgacctagactggttgtgtagcatgctggagcaaataacacgtgtgtgtttgtgtgagtgcatgtgagtcactctagtcggggtgcaagttctgtttttctcatcttaaggttataattcagttagacttcttaaggttataatcccacatccaaaggtttttatctaacctagtctaccacggctagcatttttcaaggtcaccagatgctaccatggttgtgtccagttacacaatgaatctagatgagttaagacctgaacagaagtcatcctccctagcatgcctgtgggattattttgctgagcattggcttccctttttgcattgggcctataacaaataatcctctttggttaagtggccattatctttacaccttgttgctacactgatcttcagatgggagagttgcaagttaatacctgttagccagctcaagggagacacctcattctggtagtaaagttatgcctcttctatgcaaagaaactatttattttcattgcaactcagaaagatcatccatcgtaatcatactgcatttaaagtgggatttgttctccaaaatgaaacttgtgtttaaaggtttcctcctgcactcacagcctaaaaatgcagatctgttccctgaagagatgggggaaaatgtctccagcttaaatatatgaacgctgtgtaatggagaccattacatatggcttaggtccctcaagagaagcagtgataacttctttctcataagtaggatataaaccatatttaattatcagcctttatatggatcctatcaatttctgcataaagaaagcagatctaggaaaacttttagttaagctataaaatataattttcatttcatggcttctgtgactacatgagaggaataaaaatggaattaaaagggagacttaaatttactcactttcatgaaagacaaacgtgttgaagtagtgggccactacctcatgacgatgcaaatttacaagctcttatttaacctacattttggctaattacaatacacctccatctatggcattttcacttgccttcatgctgcggaagccacatgaagatatgatcctttaaagaaacctgacttctttagaacacaaacaagttcaggaatctaacgtggaattttataggagctgaactccatccagtctccaagtactcataaaattcaagggcttgtttttgcacatccctaagtataacacttaatgtgctgttgtaacttcccagcgctcccttgtctaataggcactgaatctaacagttttacagtttgggaagactcagtgctagaaaaatgtcaggcaagtctaatgaggcttcagatcccctggtttgcgctagagtttaatttaaagttacaatgatgttttaacatgtttgcttatacttgactaaagaggattcgttatttcaatgacataacctccagacaatgttctgagaattgatttaagatgtggtggtaattccaacagccttaatgcagagttgaacatctgtaacaacattttactcgacttttcatcagcattctgttttcaagcaaaagcaacgtcttccagaaacactggccagaactctgggcttacttcaaaatgattacatatttcactagatttttaaaaaaagaaatatcttcctttatcagccgcgccagactgcaaacactgtgtcagggtttaccaagcctctttatggtccttggagtgaaatggggcaatgattgcaactcccagccttccctaattcagtctaatgcctgcattagatggacctgatgctcagctctagcctggggcacattccctctgccctgtttccccagtgagatttaaggggatgatgccctttaagatttaaaggtgagtttattggctggagttaaaaaacagttcaaagcaaataaactcagaaacgtaataaaaggcaaacaactcataaacatgagtcaaccgctatctccattatgttattaatcaccacatctggagaaacccacatctgtacacacttagcaggtcattagtaatgtcatattcacactggagtcactcagaataagagtcatgcaaagtggtttgaacacaaaggcatctagctaacagggcttccgactgaagtcttgcacaagctgccagtttgggggtgaggtcgttttaattattattaatcgttttttacggttttcccttttggtattttgctgcccaacaagctaagtgcaagctgaaatccacagtagtgcatcgctcttcttcaactgagctcagcatggtaaagtagaatgttgagggctgcagggtagttattaaaaatgggaatgggtcccagtcttccttcacctggctcggtcacaagccgagaattgggagtctccttcttgaactcaaatggatctttggaatagcgtgatctagctgcaaccttgactgccaaacaataaggagaaaagaaaatggaaattaatccatagtgaaatttcttttagaaaagttccaaacaattttaacattgaatagctttgaatcaaactggaagtttctccctcacagctgaattgccatttttttccctttcttttaccctgatgacttcctgcaattctttttgccgtcttattgtcatctgtatcagtagggataatacttctggaaattcagaagacaatcttcttggtataatttccaaaaatatactgagttccccgtcaccccacaacatgtacagacaccgaaaactcagtttagcagcaggatcagacccattctttcctgaagtctgctaaaacaaattctactgaataatcattatattccgagtcatcaatccttggtgataaacttttgctgtctgtctcgaactgccggcttggtcagcccccttagttgtggtatcagtgcctaacattaaatgccgtgagtttgccactcctcagaaagacagatccacggcatttccttcggccgtcagcgacaccagtgaaaagtgggtgtttcaaatgttgttttactaaaatgaagggtatggagtgatggtaaaattcctggaattttacaacagtcgtgttgcaaaatgtaattcaccatgaacaaaactcccaagctgacctaagctctctctgatatgactgtttaagactttcaccagaaagtttgtgcaagttaactctcaaagtcttacggcatggccacaagagcgcagtctctggattggaggatggaatggtgcctggctgtttctcacacgaaccagacgggtaagagggtgtggttgtttccttaagcgatgatgggaaaacaaccacaaaaataataatacatgccagctgaacaacccatactgtgaatttggtagtatgattcctgtaaaggagcacttgactgctgtttcgggatggatcccgtggtggggaatgccatgtgtccatcgacgaggctgagctattaagcacagctaggatcaggcaagccaggcaatggagccaagttctacgcccagagagtagtgggcagtatcagggtgcaggggagttaaagtgggtgatgtccttggaatgagagtttcttgcctgacaaccttgaatagcacatatcactaagaagtttgataagcactgcagtattcttcataaaaatcaactataaatctattttttgaaagatcgtggctaatattttctttttctgagacaaggggtctttgttgcccaggctggtgtgcagtggtgttatcttagttcactgcaacctctgacatcacggctaacattaatccacagattaggaaaagaagaaagatgctgccccttaaaagcaaccccaacgatcataatatctcaaacatatacacctctctaaaatcaaacaaccacattatcatatacattattctggcaggataatttcacaacttctagctaggaaataggaaacacatttacttggaaaacctaatgggtatcagtttttaaaaaatctatcgttatgcagaataagaatttcaaaaaatgtctaagtgacctgtactgccctaggacaggcatagggagtgcccaccccatggtaggctgccagggcagggaagggaggcttgttggagcttttgcatttctggcttttgtggagctaataggaaaatggggagggagactttaaggaacaataggttatgtagaagttaatcacagggtgtatttctggctctattcactgcctaggaaacctgaattgtgtaagtttgagtccatcaacacagagtaatgaaagaattcagctcctccataggagagagaaaaaaaatactatataaatatatgaacagaatccacatgacatggaatgcagtgttctctacaaaatactgcgggcctaatggatcctctagaatccaattgggtaaattagatgtgcccatgctacccatgccataggccctcaaccccaatctcaaactatgttctgtatgcatcctgagaggaactcagcatgtaccaaagccccccatatctagaatcgcagctcatatatcttcgctgtagacttgacctgttagaatcattgcccaacactccgccctgttcagtattcagtagaaaatccttttggaattttctggttgcctttagcccttttctttttccctggaatagactctctattacctcaagggcaaagaaaagtctcaagcaaagatcactaggtattagtttcttagagatgagacacagagatgaacgatggaattctaagaggaaatgcacaattgaaaagaaaaattcgagaacttccctgaatttttgctatggggtttggagaatgggaaggtactaggagatgggagataatttttactttacatccaactgggagggctggggaatgtatagaagtccaatacaaacagcccctcccaactttcctttccttctctccctactccctactcctgacaccaaaagccaactttcggctttgtggcaaaagttaaacctgactcctttaggttgccctagcacttgcagtccgcgtttgtgagggacaacttttagagtagggatgaaacctgccacatcctgggcaccaacagctgcttctttctcatctttctcaagttcaggggtcagcaaactgtagcctgccacctgtttttgtacatcacatgagctaagagtgtgtttacatttttaagtcattggggaaacaaaatctaagaataataatatttggtaacccactaaaaagatatgaaatttggtggctataaataaaattttatcagaccatagccacagttgttggtttaccagccatccctggctgcttccatctctaacgacaaagttgaggacttgccatagagaccatatgggttgcaaagactaagatattaactcgctgacctttgacagagaaagtttgctgacccctgcagtagtttaatcttctcacatttcccttgctttccagtctccacaaagaacaatgttcttcccaacctgccaagacagccaaataacaaaagaaatacccgtggagcccacctgaagtgcacagatctggggacattgggaggaacagaggtagcttagtgactctactgtccctaccacccaacctgctattagccctgctggtccgctcgtgtttgaggtcatgagtcaggtgagtttcacattttccaactcaagctaagttagattcatccacccagtactttggaaagcaaggcgaaccacatctaccgtgagcaattcctcgaagctgtcagcgtgtgctgccagtccaccctgcgagagccccgtacaagacaacagattaaccattagactagatatgttgaaaatatacagcttcaacctttccccagctagctcagagcgatatatagatgattatttcaaccgtcagctgccgcatagatttaaacctctgcacaataactcctggattcatctgccccttgtcaaacttgcacagctttagttggaggatacatggtgtggcagtttcactgtgaatccagaatgatccagacggctgctgtctctttgttaacaggaagccaaactgatgagtttgtaatgcatttcttatcaaaggtagtttcagaaaagaaaatgtgccccatcagtttggctagaatttcacatacacaagattataggcttaatcagaatatctctgttattttcttgaggaaatagataattccacatccattccattaaatcattttatgccaatgaattatgtatttatgaatttataattatccttgatttttcttccccttttgcagtctacttaataaaatcatcagctggagcttacaaagcaatagtgcttaatagatacaagcatgctaatatattttttaagtgaatgctgatctttctgagctgtgtgtctaaaatcatcattgtgaataaaagaattgtaatttccaacccatacatttaacaaagacaaagtggactgtaatggaatttatggagcctgtaaaggaactctttttctaagacggtttataatcaaatagatttggatttactgtaggtcaaatcaggtcccccgatgtgtatcaagaaaaaaatgcctgtaagataccaaacactgctcctggcaccctggaagggctcacacccatggctacagctgctagtttcctggtgtcctcattgtttccacccctagtgaattcagtacttaaatgtcagctttgaaatcaatatttatactgtcttcacttaaaattatgacattctgttcatcctggattttttaaattttgattattttgaaaatattttattttgatagtttgaaaatattgcatgaaactatcatttatcttgattcctgaggttttgggtctcctcttaaatttggtgcccagggcaaaagcttctctcacctcgcccaatttccagccctgaacaccatttctcaaaggtgtttgaggtactggttctgccaccccacagaactggacaaggcaaatctaacacaagacttatttcttttgatcacttcatgctgtttgcatgagattgttaaggaaggcccttgcaacaaacacttcctcgtggatttacaaattgtcaggcatcccaaggagtggagaaaagatcatgctgcctcaggaatctgagatttgccacctgcccagagtgagaaacagaaaagagagctggggtcaggtctctcgtggactttatttcacatcccacatcaaatcctcctggttaacacaatgttgatttacatttccactttggggtgaaagtttttatttgcttacatattttgacaccaatgttactttctttttctttccccccacccccaaacaggttcaaatagccatgactggcagaagatgtcaatcacatttcatttccattttcactttgctgtttacattctttaaattaatgcttgccccaatgattgtgatatttaaagaccagcctagaatctaattgtgtatatgtgaaactgttttctaaaccataagatgttatataaatacaaaccactattattattaacattattactattggctcatccggaaataccatatcttccattgagccaatggtgtcaagagccccctagaattctaatatatattccagatgggtgcactgataatttctttcaaactcagataaaggtaaaatgcatgggtttttagtgcaagccaggtgcccgacgaagaatattctgccagaacactttagaaatacagtatgcttttaaccttgggaggtaaggaccagtgtggattatgactttacactaaacacagcatttagtatatttcttaagggcataatcaccttctatagatgttcttgaactataaaatctttatctgtatgctatcataatttatcctcggacacatcctgtgcaatattttataatgctagtgtatggtgggcctttctggtcaatgcattggagaacaaggtgtggagtgcaacagaagggctggaagcggcttggggatgctctggcctcaccctcttttgcgtcatagctgcactcatacgcagaccctgacccaggacccaggtcggctgacttctaattcagatcatttgctgccagaattctgcctgtgagtgagaacagcatgaggatatgagcttcttgagtcagtccacctgcccaagtcccagctctgaccctctttagagctctgatctcagaccagttactccatacctcaatgtcctacgatctactgtgatccctactggaccaaggacaccaaatttcggagatgctttgggattatgtgacataaccagggggctgcaggctgacagcctgaggaccaactactgtccccagtgtgctgagcttggcaccaccctgctgatacacaggatttcacatgtgggacaatctttaagtctgaagattgtccatacaaatatggatttctaacttctaattaaaaatcttgtagaggactgagtcttcattccaaaagggtgccattctcctggggcaggagcttatcagctgctcaaatgccccactgctgcctactgtacccccatatatagggcagacaccccatgtttgcatttctggccctggaaccagtgacactcaagtgtaccatccccgaaataaagattttaaggcatgggatatccctccacaaatgcctactcacattgagtgggtagagaggttaagagttaaccacacaggtcttaaagccacattgttgggtctgaacctaggtatttggcaaattatctaacttcagttttctcaccaataaaatgagaattagagtacctatctaataggttgttgtgagaattgactgaaaatgtgaaaagcacttaaaagaattcctggtgagctctttctaaatgctacccatgattattgccttggctttgaagagtcagagcaatgagagttctctgctgctgggtccttctccacaccagtctgccacatttggacatggtgtaattcacatgggtccatactctctctccttccccaagcaattgagccgctaaccaacacttagaatggggtgagcattcccacccccacctgacccctagccttgcatctcattcaactgtcacctttgtcccttgtttcatatggccccaatgaagtgctcaagtcaaataattaggttttgccaaatgtcataaaaacaagaaaagccagaaaacgtttaaacggacctcaattggagaaggctggaaccattcagggcaagaacaaatgaaagacagatggggacagaggaaccccactgtttcctctaaattacaggaaattcacgccgtctgattgtgagggcctcttttctttcccttgaatttctgctgggaggtcatgggattgatcggcgtgtgcagacacatgggagacagaagaaggggcagaggcatggcggggtagagaggcagtgactccttcaccaggctctcccaccatgtcttcctttcacctgactacttgaccacccttgaagggacagcctaggctgcctcctccagggggccttcccagatgattatgacaagatcaattctctcctttctttaaaaaatcccctggcacttctgatctcatgccttgcattattataatttgtgttcaattctaatgtgttctactcccccagctaggcttataagctcctctgttggagttcacatatcactgagtctctcacaatgctgggccctgaaaagttcccaataaatagctccgagcagctacagaggcgatgttgcaaaggggagaagcacagcttagtgatcaggagccccggggttctaggcctgccttggatcaactgtgtggccttggcaagacacttccctttcctggggggatgagcattagttaagtatgagacccttctggctctgatttgtaatgactctgagtttaatgtcgggcatacctttttcttgttcttttctttaaaatctttttaaagatgcacaataagagagaaccacaagcctagccagagaaattagataattgcattaaatacgaatatacgaactcataagttacataaatgcaacagtacaaaagatgttgcatgagaatgtcaagggagggctacatgaaatgtcttagacaataagttaagtcctagagagagaattgttcaggaaaaaaaaaaaaaaagaaaggaagaaaaagaagacgacttgaaacaagaataggatgaatagagaggtcccgtatatccccagatggagcacagggcctggcactcagggggcacttgacccatgatgctgaacagactaaggagtggcagtagagggtgggaagggcatgccaggtggaggacacagtttgaaccaaggcaaggtggttggaaaatactaaactgtataaactgtaagaaagtcaatttggctagagcaggaaaatgtgtttgagggcacagttggaggtataaagggcagagagtgtaagcgtttacattccaaatgatagaatttgcacaatatttagtaataatctgaagcctctgggaaagctatttttcttctgatttaaatactgaagttcaaagaggatagtgggtgggctttgcatcttgcaaaagtctatcagaaactgcctagctcgctcagcccactttcctttccaaggtaagaaacacacattcatgcatggaaataaagcagggaggcccttggcaactgtccagttccattgaagttctcatttttcttttttttctggagagcttattcaacaggaaaataaagttatctaatgcctcagaaaggggtcccgtgaaactcacaaggcctattcctcacagcccagccaggtaaatttaccctgatttcaggatggctatttcttgtcttcaactactccagctgatcccatcccctctacagagaactggaaggaaacccgtcagggtttgacttttacatgaaaactgactgcaatccatattttcaaaaaatcattttcaacaaaaccagtgctttaaaatagattcactgagaagaaaatgtttccccaatcctctcctccttgattttgttgaatcaataacatttcaagatgttctctgtgaaaatcacatgggtgagttaaataagaacatacattacattatctagatcctcaacttgcagcccttagcgcagtatgcctgagaaaagtttaaaaactcaaaagagagaaatcctattcaaagagtaaaatactgcctatgcttccaaagttctttacggcctgataggtagaaatttaataatgaagggctgggaatggtggctcacatttgtaatcccagcactttgggaggctgaggcaggtggatatcttgaggtcagttcaagatcagcctggccaatatggcaaaaccccgtctctaaaaatacaaaaattagctgggcatggtggcatatgcctgtagtcccagctacttggtaggctgaggcaggagaatcacttgaacctgggaggcagaggttgcagtgagctaagatcgcacaactgcactccagcctggatgacacagtgagacactgtttaaaaaaaaaaaaaaaggaagaaaatttaataatgaaaaacataaacaaataagtgagtcatcctgagacatatttcaattctccccttctgtaacctcaataaattcattttctcccacataagctaatgtttgcactaaatattctgtacaaaggaataccgcagaccataaaaaaaacagtaaaaagatatagctgtgtcttttttaaaaaacggttgaaaaattgggtatgtgtggacaaaataatttttaaaaatagttttgcttgcacatttgatttctctcttcatttatgatgccctagttgatgagctgatcaacttttctgtgaaaagtcttcctaaaaaacagaacaaaacttaacagaaactctgatcctgtttgtcaaaatgtagttctggccccgagagaaaggcaatattctttggatgacttggattctaaagcaactcttttattagtattattatttactttttttttttgagacggagtctcgctctgtcacccaggctcccaggctggaatgcagtggtgcaatcttggctcactgcaacctctacctcccagttcaagcaactctagtgtctcagcctccaaagtagctgagattataggcacctgactaatgtttgtatttttagtagagacggggtttcaccgtgttggccaggctggtctcaaactcctaacctcaagtgatctgcccgcctcagcctcccaaagttctggggttacagacgtgagccactgcacccagcctggattctagagtaactcttgatgaaagaacatcatactaaggtgatttttatataaaacattaattcagtatatcaatcagtcactttaataaaaatgcccctcattatcctgaggtgaatagaagcctatgggattaatttgtgtaaatagatattagattaaaatgggaacttgccacataacaataatcagatagcataggcaatccaatctcagtgctgaatccagtattgtgtgtgtagttaccttttaaaaacagtaacatgtatttaacttggacttgcttcaagtaagcactgcatcaggcaagttggatttcaaataaaccttagcaattgaggggcattgtcgtactggaagtatatctcttcaaacaacagcaacaacagttttagatatttattttagagaaataaaggagacaatctgcaagagaaaaggcagaaagtgaggaggaggagagtacctagaatccaggtagagggtttatttctagaaaagcagcgccacctgctggtggacctgcatgtcaggcccttctgcggcttgcaggccatctgtcttgcaatctatgcataaatacacagcagtatttctcagctgctgttatacgtaagaattgtattaccagtaggcagatttctaacacactggttgtagtttaataatcctatattacctgaagtatgggttatataaaaacctagaatgttaattgttgacaaaccaattctaatatgtaaagcactgtaagtcacccagtaaatacacaagtaaatcaaaagggatagctctttttgctctaacaacgtgttattaaaagccacaacttaatcacttacataaaaataatgttcatgaatttcgatgtactaagaaatcaggaaaatgcattataatcttactaacagagcttttccttcacttacaatttagaggaaactattttgcagaaaatatttttccctttctttaaaaaatgtacctaaaccaacatgccatttaggaaatttgctcctataacaaaacctagttacaaacaactaagattacatctataaaatgttatatttttaaaatagcaatagagaagttgtggaaaatatgtcactgatacagtgagcagagaaacactacctgtcatttttcaggaaaagatcacacaaacgcgatagcaaaggaacacaataaaaagcagaaacaggaatgtgataggtgactctgattgcatctgcaaaggaaactgtgaaataaattaacacccaagtacccaagaaaggcacattgtggcttcactggaagtgatcattatgcaacagagaaggttggtgattttgtaagaacagaaataaagtgtagcctgtgaaatctagtggtgataactaatgaccatactacttacaactctgatttgatctctaacataaaaaaataaaataaaaaagtactctaaagaatagatgtatgcaatagggattgtgtttctcacttgaaacaaataaacctcaaatgggatcaaagggccccggtaaatgaaaaatgacagttcctatgttgccctgatttgatctcaagcaaaactaccatgctgataacatagcaggggatgtgaggaaggcagtggagttcttggattgctatgaaaaggaggcgagtgtgtagcccattcagctgatgggaagcccattctaattccaaaaagttattgagatttaatctctaacaacaacaacaacaacaaaataactcatgcggcaaccaaaagggtatcctttaaaaacacacatacacaattttgttatttccaatacattctgtagaatctctttacattcaattcttccatctgtctaagctgggtaaggcacatgtgtgaagagaaccaaatgtcacaatgcttgctttgagaacgaagtgtctccagttatccagacagggagcttgactaggagggtctcaggcataggccatgggcatcccatctcccatctcagctggctaccactcactctggagagacagggtttccaggagcaattctggacagatgcaaagggtgaaggggaatctggtggggttcagggctgtcaagattcgagttgggggcttaccctgcctagatataactcctagtgttagcttgtgtattagtccagtgagataaggtctaggccattggctagggtctgaacaattaaaggtgcacaccctgccttaaatatccaaatttatttgggataaattcaaatcaataaggaaacataggtggatgaacagaagcaatgggtttgccatggcttcctaccccgactcaaatacccaatgacatatggaaggagaaaacatcagcacccccagatccactacagagcccaccatgtgctgtcagcagaaacaacggaacaaatgtgttaccttcagaagaagcagtgatcaatttgagatcaatctattcaagagttgtccagcagtcaaaggaattggctgttggctgttcagaaacaaaggttctgttcaagaaggtataaaggaacaagaaggaagaaaggaagatctctagccttgagacttttttttttttttttgcctctggttcagcttctcatgaaagacctttttccttgagatacatgcttaataaactatggaaacatattgtcaacagagtttacatgttaatcagccatttattgaattcacactgtgtgtcttggttactgtgtgcaatatgctaagaattcaaagaccaattttgacttctacaaaaacctcaacataaaaactgtctaatggggtttacatgaaatgttacaggcttacagaaaagagattcactttttctaatttggtttccgggtgggctagttaagaaggcttcacagagatggcagtacttgagctgtaccttcacagcagaggttggccaactttttccctaaaaggccagatagtaaatattttgagctttctgggccataccctttttgttacaattactcagctttgcagttgtagcctgaaagcagccatggacactgagcaaatgaatgggagtgactatgttacaaggaaactttacttactacaatggatggcaggccagactgggcccatgggacagtgtgctgacccctgctctgaaggatgggtaagttttaatctgctagaagcagagaggaaaagaatcacagtctcaggaaaaggttccagaaatgtgtaaagtaatgagaataagacgcttctagagaattgttagatgatggatgcttatgtggagaacggaactagggaaactggttgaggccaaactgcaaaggctttgaatgccattttaatagcagaaagttggaaattatcctcttaaaaaacaaggaaccatcaaaaggtctctctctttaaaatgggataacatgacaaagtctgtgctttagaatactaaagttggtggtggtttggtggcaagaggaactaattgaaaggttgaagggcaacaatggcagactagctgaagaagaaatgagcatgtgagcttggcagtgccactggcaatggtgagaaaaggttcgaaatgtaatctggaggccaaatcagaggacttggccatcggtaggaggaaagagagagtgttacagggtaaaactcagaatttcaaatgtgcatattgatactcattccactcatccctagacctatccacacatcaggtctgctgaaagaaagggatagtggtaaggcatgggtgaaaaacttgggcccagtcttggccttgctccaagcactcatctaattaattacaaaatcaacaagaaacagagcccagctactcataaagcaaggtaggaaaggtgatgatgtgaagtctcaacaccaactggacctcaaagatatggccagacatggtggtgcacgcctgtagtcttggctacttgggaggctgaggtgagaggattgcttgaacctaaaagttcaaggctgcagtgaactatgatcacaccactgcactccagcctgggtgacagaaggaggtcccatctcaaaaaacaacaataacaacagaaaaagatgagttgagatcaagaccatcatcaaaaaagaaattttgatggaatttgaaaggacaggaatgtcttctttccccatctgttctcctctttttgtgttccaactttccctccctctcccaaaaacacattgaatttgctgacgatctccagacctattttagggatggacaagccataaagaaggggtttcagggggatgaggaatgatgagacctgaagtcacagttttctaatgatcccaggacctaaggattctaacagctgggctaaaatctaagacacacatttattttcatccatcaaatctgtactattccaactaggaagcctcttttgcctggagatggtgtccccgtttggccctatatgcttcctgctacacgatttcattcctggagacctggcaataacaaaacaaggtgtaacaaatatgatgaggaggctctttggggaggtcaacagttagcattcattgtgggagggcagggccatttgtagagacactgcatatgaactggtctgggatagcttcagtagctgacaatgttctgattactaataacccccaaatcactggagcatagataataccaggaccccgggttagggagagggcctttttctgtgctttccttgaggaaaataaaagacaccttggaagaaaacaagctgacaataaagtagaaacctgtaagaatcttctgggctctttcggtgtgtccctgtgcgcccagttcctgccctagaagctgcgaactcacagacagaagactaacactgatatactacgaggtttctacacacataattgttcctcacaggacctaccacgatgttgggtaatagacatcagcattttagaaggatttataacagtaaggattgaagcaaaaaggacttttagcctttctcaatcagaagaaggaagataatcagagtctcagagtttaaaggaaacttagaaatatgaccttccaatttcctcattttacacacaaattttgcaaggcctactggatagtcaagatggaaatcaatgttctggggagatatagctgtctcttggtatttttgttggcttatttctgttgggacaattattccatgacctagaaattaaacaaattgactccatttaacttttatagtctgttatactaagctgttcaactctcagccactatctgtgggcttctctgcctgtagctgatatgacctcttataaggctagcttgatgacagtcagtcatttgaaaaaaaaaaaagcactagttatggttaaagtggcttatcattattatttccatcaatactatgggagatggcaagcttctgatctagcagtccactcatccgctatgtgatcttggtcaagttcatctctgtttctttgttaatttcatatgttaatgaaggatgataaaaataataattcaacatataccaggcaatctttatatatattcactcactgaattcgtgcaaccactctgtgagataggtccttattatctccagtttatagatgaggaagctaaaaaatagtgaagttctggaacttactcaaagtcacatggtagtaggacatgatgtctatgctggggatgcctagatgaaatgagatgatgttggtgccttgagaagcacaaagactcaaacacacataagacattactcttattatagccatgagcatctacttggtgaacatgtcaaagcatgacttcaccaggacttacttccaaagtttccagaaaattcacagatctcacccttgtatctgcctgctctgacgtttcctagaatttcaggctgtaattgccaacaagatctctcagttcactgcacagtgaggggaatggcatcagaatcccctaacatagagaggaggaaatacaggagatgtctgcctgtttcccatcttcatcttaatagaagatgtttgtgaaggagcagtgtttccagcaaccagccccttgcaaatttcacattcatgccctaacttccagaccctgtgacatgacctgagccccttcctccctgtcttcattcctagcatagttgcagcttttattttcacctagcatctctcttctctgcaggtcattgtgcatcccttctcagtaacatctgtttagggctttggttttgaagcatccctgctggatatgttctctcagttggatacgttacaggccatatgtggaaatttactcatctgcactgaagaaatggccagatcagccttgacaaaatgcagagagcatttcagaaccattcaaaggtaagggaatgcttggtgcagcctgagagagctttgagaacaatcaggaaaactcttccttggcttgagcagaacaaacagaataatggctcctaataggtaatagctatgagacattcagcttttggatacctccacgcgggaggaatcatttgggtgctgctgttgcattcaagctgcctacctcgagtcagagtcaaattaccctgaccgccataaaaggcctcgaatgttgctctacatttgggcaggttgatgtgcccacctgcagatgctgacacctctctagctacaacagactcctttcctcacatgagccctgcccaatgcattggttttatgctgccctgactcacaccaaaataatcaggtttgctgaaattaataaaactgaatgtgaatgtcacaagtccttgattttccagagcaaatgctctatatgtggtagtaaccctgccactcctcattggaagcattggtggatttttgcctatgtggttttttctggtactttgtttccagatcttctttcccataatttatccttcacaaagaatatcaattgcacctgccatttgatcattttctagttccttcagtcatgtccttgttctttcttactacatttttccctcttactcttcttgtacatcccagttttttatgtttacatatatatactatatagtaagttgctgcttagaaagttttgggaagcttcatggatctagggcgatctggcttctagcacatcaccaattcctttaagggttgggaagcccttcatttattcattcttttactcatgaaatatttactgaactggaatccttcaggccatttcctattcaagtactcttgccaatataggaagcccagccaaggatgtcagcatgctacatttttgaccttggagggagggaaggcagcccctgggtcctttcttgactgagtgtgatccaacaggctccagcccagaaagctgacattggccaaaatgaagatcattttaatgcaagcagtcagctcccttcccagaagatagcccatgctctatggtgtgcagatgcccatctatgcactgtcgatacagctggtgcagtgccagctctagggctggagtctttctcacttcatttataagtctctcagtgcagtcgatcatccctaatgcagatctgcctcaaaagattccattttctatttgcatagggttttctctgcagctctaggaacatttggtgggactcatcttgcggtattgaaggggctagaatgaaaactttcagatttactagaaaaggctgggggagttttttcttgctgtttcccttgaatatgagagattagctccccctgaggatgaccaaatgagatggtctgagaagaaaggccacttttgttagtcctgctcatctgagctggacatcaaaagaatgtctcctcagaataaaaatctgtgggcatgtgtagcaatctccctccaaagcaggcactatctagctatttacagaaaggcctttgcaattccctctgagatttcaaatgcaagggtctgacaatgctggatttagctctgtccatttagattccctttgggaaaaaggtcagctggggaagcagaacccctgtaagcagatgtggcgatggagggtcccctgactatccaggtaattcaacaagctggtttgggagaaagccccagagagagaaggacaacacacagctggttggcttggtgcattttgccacattgcacttccagaagttggcattctcagcatgcacagcctaccaccatgagggaacccaggactcaagtgcttttccatgcagttttaatgaccccctgaggtcaatggtgtacacaaatgccacaatcacggatgctgacataagtaaggacacagacaaaggtcttatgcacaaagcagtaaaaccgaaaagaaaattgtgcatgatacttagaaatgccacatgacttctttaggactctgtgtggcagtacttcacaggaaatgtgttttgtatttccactcgagaaggttaagtgtttgaaaactacagtggattttcagtgaatgggatgtgaagcactttattattttccccccatcgatgtaaggagacatgctgacttcctgagaaaggaggagaaaagtctccttgccatatacagggatttaaagaataattcccatgagctctaactgaagctaccacctgcagctggaagcaagagcctcagcgctggccagctgtccccactggtggctcccacttgctttgtgtctgctgctcagcctgagccaatacttcacaccagcaggtgagagctgcctgcctgtcaccttcaacacactcaagatgtaagatatatttgaactggggaagatgatgaggaataaggaagaaataatggttaggaaaaggaaacagaagcagtagatccccaaggccagtggtagtggatgcagccgagtgggtctcctagtcctgggtcaggggtcaggaaatcttcctccaataagaaggaaactctagcaaacccagctaggaatcacaatggctgccaggtcagctggggagaattaggctcatggaattcagctgctccagagccactaattaaactgtcttttaaagactgtaacttcttggatttgcatctgggcaatgtgcttcacctgcagggtcctgcagactatagatcaagtcttccttctgaaggcttctcagaacagctggggcccgcccacaacaggctcccctctgtttgtctcctccccgagaggggggcttccagctcccctctagtcagtcccttcctcccctgcagccacagcagccctcccaaaacaaagcctctgttaggtcacttccctgatcaaacaccaatatgatagtgtcgcactgtctaaagactttctatcatattacagactaagaacaaaacccttggcctggcccctgccaggaatggggccccattttacccttcaggggggtcaattccctgcatgctaagtaagtcttaaactctagccaaattgggtggccagctgctgtgcaggaggcccccccaggactctctacattatctcgaggtttcattaccagaatcctcacttttttctcctcccttggagattaagtgacttatccatcatattcaactgcaagagtaactgagcaactcaaccgactccacactctgtggagccacacggcctgtgttgaaatcccagctccaccagtcactggctatgagacccttggcaagtcatgagactgtgacatgaggctatgagacccttggccagactcactggctatgagacccttgtgccttagttgccttatctgtaaatggggcacattgcagatgtctcaggttatagttgcctcaactgcaaacagcagttaccacataataagggttaaattaattaatatttgtggtaatagggggagtagtgcctgtaatgcagcaaatgctatataagtgttaaatttaacaacagcaacaacacatacacacatcctccctgtgtactcagagttgcttgcacacagtaagagtagagactacactaattctagtcgtaacatgaatccaagttaaccaactagccatttcttagtaatgctgtgtcaacaagtctcactcccttggtgatgcagtatacacagaatatagatctctttggggagtgaccccatgctcagataagactaaaacatgatgctagcctcaaaagagaaacataatttttcagcaaatgttggtagtatgcctccctctgtctctcctcaccaatgagcatgacctgcttatgattactaggtccactccattctggtttccatttttggctgctctgtgcttgcagcttctaggcttcactgggagtcaaagatcccaaatgttaagatcgttttgaagagcatgctggcaaatgtcctaaatgtgctgggccagatgacaagcatccatctccgatgaaggaagtatccaactgaaatgatgggcaccatatgagaaggagaatcccaaggcatgatggaaaccacaggtgctgcagacccactgtccgtttctgtctggatggggaaggaaggcaggatgcagtgaagcctgtgccactgccccacaagcctctctcgagtgacttcacaccattattggtctgatactaatttgagacaatacccaatcacatcacaacaaattagccacagacacgtgatagcaatcaactcagggggcgatcctgaatgcgggctgggggattctccagctccgtgagccgcacgctcccacagatgtttctaaaagcgtcttcccagaggcccatttagagagaaattaaatgcaacttcgacttaattaacgttttaaatgataatgaatacaatgtagattcataggaggcatttacattgtgttgtaaaattgataaaaatttaataactctttgttaataagttatgtctccccagacccataaagcctaaggcgctgcaaactccacactgggtctaatcgaggctcctggtgcaggtggaggaaagaggcagagacggacttgacatttgctccaagcctgctctaattcaaacctctgcttgttcatcagtactttatttcatacagtaaaggtcaggatttgggctcaaggcagagccttgacaagaaagctcaagtggaaggcgggctggccctggcatctgtcgcctgagatagtggaggaggatggaagatgaggagctaactggccacatctgccctccaccatggaggtaagaggaagcattcactgcctggtggtagaagctgtcaggatgagtatcctgagaaccggccactgtcctgaaataaaaaagcaaacataatttctatgtcaccttgcataagggcctcttctgggcttacatgaggcatgccaacatcttttctagtttgtccttaaagagccgagtcatttattacagcatggtgtccctgggaagaaaggtgtcccatgatggggtatacacaaaggaccctgtcagcttccctcattctgacctttctccttcttgtttcccaatcctgtttcaaagaatttcttttgagaagttggctgccttttgcctactgttcccgtctcctttcatctacctgcagtacatcttcatagtgtattcatcttcaggaattcaaccatactctttttttggaaggtggtgaaagcacaacaaggtccccaaatacaagccagtgactttacctgacactcaactgaaacaaccagctatttattctggagaagaacccagtgtgttgggagctcttgacagatgagcgatgtaaaggatccttctcaaaggcaattttgcccaagcatgatttctgccttacaatgctgatttaagaagctgcccactgcacagagtgagctaaggcccacagtaaggcatatttccagtcaacctatggctcagcgtggctatcacaaaatcaagcaagaggcagtggcttctgtagcctcacctgctaccaataagagtgtcttaagaagccccttccaggcccatcactaggtcttagtcacaggggatgacccagtggctgcctaggccgatctgccactctgtttttacttcctgcaatgaagtacaaagggtcaaatcaagacgcatgggccagggtaactaaagagccaggggacaacccaaaggctctggtagtgtttggtgtgcacatgtgtgatggatattgacacagagagagagagagagcgcactcacatcagcacggcaagcatgggaagatgggagaaaatggagactcagacgaacaggctttaaaactaatacatgaaaaactatgatcacatcgattcgtgcttattatccttggctctcctttttctgtctttttctcactggtagtggtggtggaaagaggggagtaattgattttagggcccagaagtaaaataagcaaatagaatttaggtttggggaatttgaggaagtcacctaaaactgcacataaaaggaatgagataattataggctgttgatttttaaatgtagcttattaaattaactctcctttaacaggcgttggagactgtcaggatagggtgtgtcctattatagacattttcctagagctgtttccaccccctgcccttgtatctgattttatgtacttcaaaatgccattagttcacttaagtgactttagttctattgacaatgttaattctctgtctgcacaaaccaaaggctactcaggataagctgatttttgtttattatctgacaagactcgatattacactaaactgattttggtacgtctcccttcaacctaatcatattggacttctctcagcttaaccatcggagttgaatgccttcttgtattatatttatacccaaaataaaagtcatgtgtaatttaaaattagctacagtagtttgcaaaaggctgcatgtaattgtgcaggtttaaacaattagtaaattgaaaggttggtgtgagcaatcacacatgtactttagctaaagctggttccaagtgcaagtctaaaggtctgcttctcttctaccacaggattaatttgtttgtgccagagttactgatgctttgtgactagaatcatgtcaggcaggtctcagcaggtctgaatcagtatggccctacgttgccactgcatcataattttaattgtccctttctattacatttagcaatcagatagcaggcaagactgaaataacaagaataaacttctaaagagagagaaaggtccattttacaaaattatagtgggaagaaatcgtactgattggaatctacttctatatttatgtgcatgtgtatgttgctagacattcattttttacatttaatagtactagaacacagctacttgtgaaaaagccgaggcccataccatcctgatgtcttttgagagagctgggactcttgcccaggaccatctgaagtggaaacaaaaccaagatgatcataaaatgacactctatgcactgattctagcctaccatattgaacatttcagtcttgccagaaataaaatccttttgtgatgaatccttatcggtcacaatttgccttacttttctgacaccttttattttgatttttgtctttcctaaactagtccttcccctctgaagttcttttggtcaacacagtctggccttccatctcctcctgagttcaacagaagacaactatcataatagcacatgactcaaccgatccacagtaatgggccacacctccatagaggggtgcaccgagcaggcagcccctgttgttagaaggcaggttttcagaactgtgtgagcacttttaatatattaccattcctctgggaaccagctacttctcttcccacttcacaaaacacataatgggactttgtgtttcaatttaacatcccttgaaaacggaaatttttccccttataagaaaaaaaatagagtaaagagggaaacgaaaggaaagagagaaatgaattaggcagtctccaaagcacactggctcaactgggaaactgcgaccaaagcaagctccataatagtataatgacctttaatgagtgtcttgggaaacaatacagccctagcataaaagacaaagggcaaaactcatcatggctctgctgacactaattcaaaatgattttcagaacaactaaagaatgtaagagaagtaatctgatccgcccatctgacctcactttgattcaagggcccttctcctgccatttctaattgtcaaaccctctacatttcacatctgttcatatttaatgaaaagcccactctcaccactgctcttgagtcaacttgctctgtcaaatgggcaccacccaactccaccaccagcgagggatgcctggggattgctattggagcactgccagtggaatttcacatagagacagacatttttataattggagaagaagggcttatgcaggcccaaaaaggggctcaaattggaatggatttttctaacttattattaatggtcaaaggtgagtggtctcacacagggatggatgaaatctgcttttgtttgatggagtgatgacggcaggacgactgatgaaacggagaaggcaaatcgccccctgagctgtcaataccagttaaggcttcaacacgcagcccaaagctccacgtgttccctggtgggggctgattttggaggcaagggagggacaacatgccactcacagaatgtttcttagagaatgggacaatcccaccccaaggttttcttctccctggtctccatcaatggttggattaaattgcacagctgagaaatccctctaattaagatttctcttggatataatggaaattacacacactgggcaccatggggtctacatgggggacacagagtgtgctgtgattggtattgttggccagtgccaagacatgaccaaggggccctagctcagagccagagtggctcctttcttttctccactgagtctaggctaaggttttagagcctcatgattatttgagaacagaagttgtgcattaggcagaagagtaacccgggggcttgtggttactttcaccaccatcagtcaaagagatgtgaccaattcatgccacctcaggccctcctctgctcttcctccccagcacctatctttgaacttggtgtcttgctgcacatcgtagacagacaagttctctgtgcagctgtgccctagcttatctctgtaatggcatgcaaactacagataactcttcaggggaaaataaagtgataaggattcatatggtagcatctaaggattgtaacagaaatctttccaagattttaggcccatatggcagtccacactccctctcaatgcaacctccattaggtattactttgaagtgaatcctgtcccttggcactgctctggagcagcaggaaatcgtgaatcagagagaatgactctctggtcctagatcaaagttttccaaatgcctctaatatggctcgatgcacaaatcatgctttgcacttgaactttgggcccaaacataagcacctggcatggcacacagtgaagtcccggttccctgagccctagaggcctcatggatcccggctacacagccgcactctgctgggaccagcctcaacaccagcacaggggagtcaagccagttcattttccatgggaataaatgcttaagagctcagtgatcttcttcctcctgtcgtcagtgtacacctacccctgctaggaaagtgtagctcaaccagctctgagcacttggaaggtgagaggacagggagcaagaggttagcaatatatgtgttggctgctttaaagaggaagggaggaagtgcagaaacgagaaccatctcctaccttctatgctaccaaaacatgaaaacaaagttatagttatacttcaagtaaagtcctccagtggaaccacagccttttctgcacttggaccaagacccacagtcccagggtctcaaactggagctttcaggaacttcacttatgaaccgtatcaggaaaacagcaaagtccatggggaagcaaggataagggaggtctcaggaaactggcacatctcagccttgccagctaccagctgcatagccttgacaggttctttaacatctctgagcttgtggatgacaaagaagactgacatcagaggcctgtgctatggactcagggatatcacagaggtttctgacttaaattttttgttggcatttggaatcacaattgctgcaagataccttagttaaacaggggctatactattggaaaaataaaagatattaatggaacagtccttcaaaatagtcatcattctgagaaaaagctctgtaatccactagcccagtgcaggctgacagacatagaaaactcgtttccagaacaaaagacaaaatctggcactggaggaatgaggcacaggttagagagacatagtaaaaagaaaatatatatatatatatatatatatatatatatatatatatatatccatctgcatcaaaactctgttgtattttggaaactatctaagaaactatctaagctcactaaaagcaattcaatgctagagctggcttgttctcgctacaccctttccttcctccctttgatacaattcaatttacagccatttcaaaaatattaacatgtacacttctgcatatctctgtattaatacagtaggtgatatgctgtcactttaatttccatttatatttatttaaaggagagagaggaaagatatcaccagactgtaatatcacagtcctgcatgctgttacgagaagcgtaagttaagaaaatcagaagggaggccttcctaggcacgtacacagagacataggcagctggggcaacatgtcagcacacaggagttcacactgggaagaagacatcagcccgactgactcagaaccacagggcacagcacaagacagggatgataccacagacagcacaaacatggaactacgtgtgttgaggttaaacttacaggcacggaaactggtggagcaatcattaacagagacagaagaaagtgggaaggctctctcaagggtgtccacgttaccacgcacacggcctgacatgcatgagcagtcacgctcagaacgtccgcaatcaaaacaacatgcccgtctcattctcttgtagatggacatcttggctataaccgtgtggttggatgggaggagaggaagagcggcaattaatggcaaggtcacacacagcaaggcagctggaagggagctgaagggatttaacacaggtcttagttcactttaacagtcttgacccagaaaaaaatgcagagtgattgttggtaacagtttggttgtacatcaaaaaagcagcgaaaatataaattgcctttatcgtctcccaaggctgttgcacatgatttttctcccctaggtaaagcggtgaccacaggaaaagggcatggctgaatacactcgggttctcaaatgggaagaagagcaaattatcgacagcaaaaaacgtaaccaacacttttcccctgatatgattaatacaggaggacaaaatatacacactgccaatcaatgaaattagctgcttatttggtataataaatggtttttgcaagatgcaaaaatatctaatatgtaggctttctaatttccatccatttctgggcattaggcagaggctgggacaagctttcatcaaattagatgtgaaacgattacgtgttaatacagtatctaaggatgcctttgctgaacttcccgagagtgagtttatatgatggctacaggaatttaaatttactcttgacagaacaaatatccaaatctgtccatataagaaatgcagctactcaagactaacgctgcagatttgacattaaaggcagttcacaaataagaaatcaccaaaagcatatgagatgttgctctattggaatgcatttagctactcatgggtgtattttctgcttaaagctgagaggatctgaaaatcgcatctgcctttctctccccaccaaatagaaattcaggaagcaatcaggctattggttaatcatattatttcttttttccttatacagaaaatattcgccaaaatcgattaaaactgacaaaacatgaaatagaagaataggttccacgtgaaatatcttaatgcaatttgcatgcagcattgatagctcttctaaagctggtatggtaggttctgcactgcctggggatccaaactgagtggtaacctataaaagttgttggaagtcagcatcgtagtttccaatgcccttcacctttgcctttcaagccaatttatatttcagtacaagagaaggtttttgtacctcattttgatgctacaacaggcaaacatgtttgcttatcacttatcatgaactggcctgcttctctcacgaggtgggagaagaattcacatttattctaagcattactgccaaatggtaaacctaaactgaggaggtgttattccctgcacccacaccttccattttgaaagtcatttcccccactctttctttttctttgtagagaatggttgcactcttattttaaaatatggcttgtggttttgccctctttgaatgttacagtcaccaggaagaggggtttaaatctctcaaatgggtcaagtcctgttctaagacctttatgacttgccatacagtatatttgtcaagcaagggtaacgttatgattgtgaagaacaggcactgggggagatgaatgagagatctcttcagcagcaactccattcttgtaaacttggctcacatttttagtgacgtgttcttttagtgtcctagctagtctgttgttcagatcatcatgcagccccagccctgttcaatggtggtatatcattcctttgagctttagcttttaccaaaaaaaaataaaaaataaaaaagttccactatagcatttgaatcagaggaatttagaaggcatggtgtgaatgcccagacatcccaaacaaacagcaacggctgaagtcaagaaagggaaaaaagtcttcaattaaagacatgaacataaatttatcttaaatgcatccggatctggcatacaatctgcagacattcccttgttttctctttcttatttcttttactggaaatattgatttgttatttacacagaagagggaaacaaggatgatttttttgcttcaccgtagataaatcattttgaaaaacaatttttttaatcaaatgctgtagcagaagagaagcccatcaaactctggaatgctatgcttctcattagcaacggtccctggttttcatttccatactgccattttgggtttatgtacaataatagaatctgacacatttgtggagaaagaaagttcttataaatataccgtctttaaggataaggggagggatgatggggatgaaataacttttgaaactatttgttcagaggcaaacagatcagaatgggtgatgtaaacctcctccttgatatgagttcaggaggaaacacagtgacaaaccagtggctctcagggactgtttgcaactgttattgttagccgttctggcgaccatgcattgttctaaaatttcttattgttagcatgcaggaacaggctgaaactggtaatcgaagcagcaaaaaaccatgtgctataagaagattaactgttaattataagcagtcacattccaaagcagcatatgcataaaaaagaaaacatgctattacttgtcattccttcccaatcatttttacactcacaccaaatgcaaaatagaaatctcaaaagacaaacaagtgccaccacacacacacacacacacacacacacacacacacacacaaaatcagcaagaacgatcaatgagaggctcaaagacaagacagaaacagttaaaaactattgagccccacatgttgacaaaccttcatgaatcagaatgtctagatcaaggtgccaccaactgggaaggtggctctttttcgctactgctggcatagtccatttccattgactccctgtcaggtatcttcacctagagacttctgggtccactttcttaaaaggtaagacctcccatctggtggagcgattcatcaggcttgaaggatatgagtactggccaggaagagctctcctctgggccattatacaaatcatgaacaaactctttaactaaaagctgatgaggagttgtctccctggtggtagatgttccagaagaattgaacactctctgtgtaaaattatactcttaagttgtaaaattaaattatatcaaagttaagtcatggacctcctaatttggaaattaccacccctcatctctctcaactctctctggcttcctaacccttcaattttgttacagtgaatcatggatattcagaaccactggtgttttgtttccatttctcagtgactgtttccttttctagagctgatttaggttagaaggttaattttagatatgaagagttccactttaaattcccaaggttaggtctcaaagtgcaactttgaaaatttcaggatttatttcaaacagaagtaagtttcttatctactccctggccacacaaagcatcctctctcctttggtgtttgctaattttctttcttacgtagtcacccattgttcccttcccaaatcccaattctcagacaaggttttccccaggatgtcaatggtaatacaaagtagatctatgaggacatctagtggatcaatgtggaagagcagctagttcatgggcagttggaactagcctttctccaaaaggagcagaaagaggaccctgctgtctctgagaattgaaatatatgcagtgtcatttcaattcaatggcttctcatgatccacagcagatgattaggggtaggggcagtgaaagggtgagaggtcctaggagatgagcctagggtctgcagccacagctggcacaggaggactatttcagtggcagctgactgcgtctcctttttaaagccctgctgcagcttcctgagactgggagcagacaagagtgtgtctctggcaagtgtgaacaccaaagctacttgtcattccatcttagggctcttgaaacttcatgctcaattaactgccccgataggccaacttaactctaggaaagcagaaatacaaggctctagggactcagtttaccctctggttcacatcataaggttcttgttattggaccagggccatggattctatgaggttatgtggttgctaagaatttgaccctgagtctcaccttcctccgaagacctaggtcctggcagtttcacaatttgagaaaaagcttttatgtgcttttcttcaccacagtgaagtggatattcaaccaacatttccatcataacttcatagtactatttacagagacaaaatagaagtatttccctaatggacatcatcaaaactatttgtttactcttgagtgtttaaaacaaaaaggcttctcagaagtgttcttggacaacttttcctctattctcaaaggccatgatcatgagaccagaaacctgttggaaagtggctggtgaagatgcagctcagttactgctctttccttgagtcaaatggataatcagctgtcaaactcaggttctctgctggctggcctttctgagccaagcctggaatggaaggaagaattggattccatcctatcctcagcaccatctgccacctgcatcagcaaccaaattgtcagccaatttccaatgcagaatcttaatttccagggtggattggaagaggcaggaaaaagcagtactggactgaggggcccaggtggagttttccaactgctggggaaaatgttttagatttcaaatggagcaaattcaagggaagactgggatggaagaaaaaaaacatctgccattcaatcaatagatacttttcaggtcacagcctcacttttaaaatcagtcaaatgaaggagggattatttccaagcaagaaacatggagctactcttcatgggctctgcagcaactaacgttactaataaaaatatccacggaagaaaaagtccaccaggatttaaggtgaggcctttgatgtggcactgggaatcagagaatattctttcaagtcctataaatgagaaatgatgtcttcacttagcaaaattcctcccattaccttctggagtaagaagaaaggtcttccaggtggttttccaaaaacagaggagaaagaaaaagctagttaatgtcagcagcacagagcacactgagctagttgattctgcccctaatgactgtattgtggctgaggaaggcagaagtatttggcactagagttgttggttgattgacaccacattttctctccaattctgaaggaccattcaatttagtatgcagctctgcaggtatgaaagtgggccatgccctcaagccatgtttaaagggttctgtcgatgaagaaagccacagagtcgattttggcaagactgtgcattgaattgaagaaggtcatcattgtgttttgtttttaaagtgagcaatctataccctccaaacactgatgactaaccaaaatcagatgatcaacttgcctcttttgctgcaaaggaatgaggggactgaatttgaaacatcttctccaaattccagagccattggactgaactgttccacagattgggtctccttttcagtagagccttacaaacatgaataaagacccaaagctcaatgctggccttaaaagctcctcctcaatggccacatcttgttgagtaaaagggcatcctattccttgagtaagttagaggttcagacacttgtattgacttgttcagacttatacattgctcattgctgaaatggaatgttctcctccagtcagcttttctgccttaaacaggtaaagggatcttccaagatgtctgactaacattcataaagcaactgggtgtgtcctactgagtactgactaaaagaaaaactttgttgtaaagcaagggaacttcatagactgcagataataattaccactgtgcaaatacttgtctccagtaagacaattgagatacttacagtcccaaagttgagtaaccaattaattatctagcaagcacttctcatacagagaagcatgtactgcaataaatacatcactctatggaatatctctactcttatatgtaaaaatatgaatttttacatataagaatgtacatatactctgatacatcatggtacatattgtgtgtgtgtatatatatatatatatatatatgtatcacaacatgggaatatatatgtggcatatgtgtttcctttaggagaggaatccaagctcaataacaaaggagaccaagtataatttatcaaaggcaagcatgacaattaccccagctgatgaagcatctggagttatagtggtaattacttcagcctaatcagtgtcccttaaaagtcctgagacaaggccttcaagagaaacacactgttgtcaaggtcttattttcaaatagaaaaataagacagtgcccgaagctggccagagcccggggactggggtggatggatggagagcaggctccctggggactctctggctccaggctactctgtagactgcattgggggatgaaggagttggggcatgatgtcactgctacatgcaacataaataccaaaagtaaaagggaaactaaaactgtacagaaaattaaaagagtatctcttctagagaaagacagggggaactggactccgggctgctgggaacccgttttactcacaatatatcactaccagtgtgcagttaaaatagagtaggggccgtattccaaggcagcaaagagaaaaaaaataaatcaaagatatgtcaatgatttgaagtcaaagaaaattccttcaaacacatcaaactagacattacttgtccactaggagtccacactttggcaaacttttagagtctgggggaagaaatgtaaatcattagacaaggtttgttatatagaaaaagaaaatgagtaaatagtagaccctgagaacttgctcctcggccagacagctgaatttgactcttttccttgatagagagctatgaagaaatggaaagaaatgcaaacgttaaactatactatcacaggatttccagaaatggaatgtccgcacctgatatttctccggatgagatgacgtgaaatgttgaaggttactgaatgaaagtgaatgaggagctaggggtggaagtgaaaggggaaggctgggttggggaaggagggttaggaagctatgggtaagggccagtgactgtcatgagctctgccctcatgggatctaccattccagggtgaattattaatacctggactaacacgtttggacagatgagtatgtgggtcagctgtcttctccaacttagagagggaaccaagcaatgtctgttcgaaggcatgggggtccccccagtgtgttactaataatcctagtttcttctaattaaagtttctttgcaactaaaacatcttctccaatttcctcacttgcctgacctacatggggaggtttatttttaataattcattttattctaaccaccccctcacctcacacacacatctgcatcctgccctctgttctatggccttttaattagtaggagcaatattcagacaattctgattgttacatagccaaaggcctttgtgagatgaagaagctgaggttgggggaggaggcacagggatgtacagagaaggaagcgaggcccttgttacactggcttggctttgtagaggcaggccttttgcagcaattggtgcagtgcataatgggagattatatacctcactagctccaccaactttaaaggaaatgaagagaagaaaattatttcaaacaattatgggcctctctctccaggatgaagctaaagcctgctgctgtttacctgtctggaaccaaggtggaaaaataccctagaggccaaatccttatttcttatttctagggacaatttagtctgctgtgttccactatggcgtcctatgagggacattccaatgtcagagcaagagtcagagaagttctcacttcatccttccacttccactccttcctcccgagaatgctctccatccagacaccagggacatcttttaaactaagaactaatgatgacatttcctcacttaaaatcttccaaaggcttcctaatataggactaaaacccacacttcttaccacgtcccctgtctccgtctctaatctcatctcatactaccctttccccagtgccactggcctttcttccatccttcaaacaccacaaacttattcctgcctcctgaccttgacctttgctcgtctccctatctggattgggtcttggcctcaacatcacccctgactgaggccttcctgaccttccaagctataaagtagcaccactgcaggattcctcaaccctcaggcagtctcttctctcttcttagcactggctatctctgaatttatttatttacatcatcatggtttgtctccattcaccagagtaaaggattcaggagggcagggactttaccttgttgaccactccatccctgaaaccaaaaatagcagctcatccaaagaagatactcaaaaatatgtgaacggctaatcaatatgtgaatcacagtcttgctatttccttgatactctgtgggatgagggtctggcaaatatcctgtcaggggttattggcctcacctttcctccctttcccaacccctcactacaagcgtttctttacagaagtgttcacctcttgtatttgttgttctctcttatttccctcaaccctcagactgctgtgctccttctgattgaaatgattcaggagatgtctggtcaactcatccgtgctgctgtgtccacaaccaactaagcatggctgggatggactgcctggtgaagaaggtctttggattcatggggtctgtgggggttgaatggggagtgaggttcattctaggccttgttctctcttagatgctcttctcggtaggttgtcagaatcggggaattcttgtcccaagaaattagaggctcttgttttgagatatcaataaatactcatctcgataagagtctgggggaaggggaccagctgtattaagtcagtggaaacagggggaggaaacccatggtcctaagctgccccaccctgaggggatttctgcagaaacttctctagaccaagagtgcaccccaagggaattttccccatgggttgaggaacttctttaccctccagcagagtgatatttatagatgactggttctacattttctgtaccccactctaggagtacaatgaaaaaggtccttccttcagtggcatactttaggaatggtgctcttctgtctggcttctgcttgtgaacaaggattttatggggtactctttcataattgttcttactcatcagacccaagactgcccacattgcctttcccttctgcaaaaaaatgttagagcacccagagaatcaatagaggccttcaggtgtgcccaaatccctgtatgttggctgtgtgactgtcagcaatctcatcctctcaaacttggaagcttagtttcctctttttgtaaaatgggattaataacacccctgccaattacatggggttagggtgagaatcaaagcaatgattataaggagcttttaaaagactaactcaccataggaaggatggcatcattttttgtttgtttttcaagggttgagaacaatttctattaggcaatacagcataattactgcaaaaggcacaaccttctcaaagcaaagaccacttaagtcatggtatctcaggagctcacaattccacgttctggactcactatatctttctcaagaggccccagtggcaaactgctttagaagggacttgagacagaatatgccagaaacaactgagcccagtctagtctaccccaaagagcgatgatgcttgaggtcgacctttggacgatggcaactgaagccctttggcagtggaaagttcttttcttgggggcagtctgaaggtatcacagttgccaactctggcctgtggtattaaaactagcaggaattccaaatggaaagagtcaactcccattttggagaccaagtcctcagatttagtttctctctcaaccctatatactcagggacccccaatccactggaaatcacgatacaaaaacactttgtgctctgtggctttagttctcctccttattatacatcatacttgtctctgttagactggacacatctactgaggcacctctagagtaaagaagcagggactaggcacaggtttcattcctaggtgttgatggtggtgatttttcatcctctgctctaacaaagcaaggacaggtatttatttcatatttctttaaactgctgggtgaaacataaacatactcaagaaaactctcgatgtttagtgtttctctaataagaaaagggaaggaaaaggaatttggggaataggaatgagaaagggaggggacagggagagaaacactacttacgccgtttgcagccacatttttttattcttttgggatctgtgatgtcatcatgacaggccttgcagtaaaaaaatgccctggagaaagagaatggaaaaactgacacgtttcataatccacccaaatgaaatgagtaccacatttcctccacggtggtgccaaattaatgaaacacgccagcattaatttcctttaatcttttgaaaggtttagacatttgcagacggaaatgtttgttgcaagaccatttatttcaaacacaggattctgtgatttgagttagtgctccttttcataaacttccatttacaaagaaactgggaaaaaagttgctgatgtgacacactgtgtctgctcattcgtctttcatttttgagaacagcctttgatgctactcgtggggacatgtgggcaatgagccctgggcccttggtggggaagttaaatacaacaccaaaattcccacagtctggtcaaatatatatttgagggggcagaagtatgtcgtttctcagtcaaataaaaatatcaagcttgtcactctgaaagcaccttttctgggcagccaaagggagacagagttgaggaggtctgcagagagggaaaaacgaaagccacgagtcagtgggttcctctgtcaaaccccctctggagtttcacagcttattttactccaaagctgactggaccaattcccatgctatccagccctgagaacatgcactaaatgatggttttcttctcactatggagcaaagctcagctgaccactggaagggggtgagtagagcttattgaagcaataggtaggtagaaggagaatgagatgaagcactcaaaaagaaaatcccctaatctgacttgaatgtccataggtgattccacagtgcattagctgtgtcaaagatattctggataagaaaaataagatcattcaagcactatttgaaatcacagtgcctagaacagcacaagaggcctgtgccctttcagtactggggaggtgataaaattcactggaacaaccctacaaccttctggatccaagaactaacaaaatccctggcttgttgcctttaccactcccaacaggaaactgaatgccagctatgaacatggccttttcttgaccagggctgcagaaataaacacaattcttgaccatttgattcttaggttcctttttatgttttcacaggacttgatttataattggcactcattggaaaccaatgttaagacttttggatccacacgaggtcttggagatcctgcagcctaaatctctgggactcagtgtcctcatctgtaaactgaggaggttgtcgtggactgcccagtcattccatgctgggattcagccagccccaggacttctgaatccaagtccaatgcttgctctatcctagcaaattctccactctttctttaaatgccagctgtcatctatgtctcaaaaaaattaaaaaaaaaataaaaagaaatcctagctgactgttgaccctgagtggcaatgtggctaagaacccaatcaatctgccttggcacaggaagaacaggaaagtagaaagcatccaagttggggaaagtaactctgcgtccacttcctttggccattttccctccccctttgttgctcttaacacataatgataataacggtaacaatcatatagctaacatctatagagaacagactacatgtcaggtgtggttctaagtattttataagcattaaacatatttgatcctcaaacaaccctttgaaggaggtatgattattatttctattttacagataaggaaactgaagcacagagaagttaagtgacctgcccaaggccacacagctaaaagtaccaaagctgagattgaattcacatagcctggcaccagagcccaaggtctatactaaagagatgatgacatgataataagcctgaatagacttgtgaaaagataaagtttgattacttcatgaactaaagttggattcttttttaatttaatttttatttttaattgacaaataataattgtattatatgtgtggtatgcaacacattgaaatacatatacaatgtggaatagttgaatcaagctaattaacatatacattatacagataaagaaactgaagcacaccttttgtggtacgaacacttaaaatctactgtcttggctgggtgtggcggctgacgcctgtaatccaacactttgggaggctgatgtggatagatcacgaggccaggagtttgagaccagcctggccaacatggtgaaaccctgtctctactaaaaataaaaaaattagccagtcatggtggcatgcacctgtaatcccagctccttgggaggctgaggcaggagaatcgcttgaatccaggaggtggaggttgcagtgagccgagattgtgccactgcactccagcctgggagcctgggcaatagagcaagacattgtctcaaaaaaaaaaaaaaaaaaatctgtctttgcaattttctggtatataattcatttttaactatagtcaccacattgaacaatagatttcttgaacttattccacctgtctaactgaaatttcatgttttagatggacatctccccaatccctcccaaccccagcccctgttaaccaccattccactttctgcttctatgagtttaacttttgtaggttccacatgtaaataagaacatgcgatgtttgcctggcttatttcactaagcataatgtcctccaaggctaggcaattaaggttaataagtgaaatgaggcaagggtcgggggtgtccatggtgatctggagcaggcagagtatctaagctcagctgacctctgccaagtggcatttctttgcaagaatcattctcttccccacccatctttgcctctgtcatgctcacctcgcaaagcccctcccttactgcacacctgcacctgagcaacggagtttcgctgggaaagaaaacatgctgacctcactttaaacccacaaccatggatttcaggggccttttccactctttgggatctaccccattctcctgttgcttgctttctcacactccaaaacagctctctctcctctcctctccacttgctccagctcaccgtacccctcccacaagcagccttcagctggtgatcttgcttcacccatcatcagaccagctttgtgtcctgcaaggctggcctgtatggtctccttgtcctctggtttcctggcctgcgtgtccagtggaaggagtcagcaggagactagggtgaggggggatgaggtcaccaccttgaccccccgggtgccctcctgtacaggtctatgaaatggcacacgacagcctctctctccagctcctgatagccctccttccccttgaccccacagatctagggtgaaggtggcttcccctttcttgctagctctgcagtgcttggccatcccttgttggttttcctttactatttgcccataactttacagtctcttcataaaactctcctcctttttcccatttaagtttgtcatctgtttcttgccaggacaagaaacagcacccacatttacatattcatctccaattcacacttatccccagaactccagactctaagatccaaccgccttatgatatcactgtgtgtatgtttagtacacatctcctacctaacatagcccagatagaatgcttaacttcctactacccaaaacttgctccttctctagtatccctcatcttggttaagatcaacacaatctaagccctgactctagccttcatccttcattcctcttttttcctcacttctgcccaattcattggggggttctgcacactctcccaaatacagtctgaatgggaacccacctctctccacctccactcaggggtcagtccaagctgccatcatctctcacctaaactatgcaataggcgctgagtctctcacctcttctcctgccccattcctctcattctctacaatgcaggaagaatgaccttttcaaaatatacatcagatcagcttaaagccatcaatgacttccattttataacagatccaacctttctataaagtgctttaggagccagcctctgcctctctctaacctcatctcataccactctccccaaatctattccctagccgcactttccttcttggggtccctatccacaatgaacttcttcccagcccatctcttcttcctatctgatccctgcctgatggattatttcccttcatctcaatctctgctcaaataccaacccctctgagaagctttcacttatacccaacccaaatcagtgacccagttgcattaattcttttaccactaattattttttaaaaaactgtaattctttcctgcctagaatatgagccccacgagagttgggacttctccccattgttcatttttcaccactgtttccctggtgccttgtatagagccttctaaatgtaaacgacttatacacatttgatgggcgaatgaatgagtgagtttgagactgcttcccggtattgttgggtctgccaatttttcaggagaaatgagtaataaggatttttatataaaagctcgtaacttttttcaccttggcaactcatttgtattttaaaattgtgactcaaaaggatcatatgtgcaagccaaactgagtcactgagccaccgttttgtgactcctatattaaagtctatgttccaacgttattttaaaaggaaaatatttggtggcaaggaggaaagagcaagtacccaaatgcccatcctcaagtgaccttcttaagactgcagtgggatggtttcactcctcatttactaaaacactgcatctgaaggtttctacaagctagaattcattaacttcttttgttgcttttttgcagtggagggtgcaaactcgatacgagatcatcataatctacttttccatttttacaaagcttgtttagtttcattcaaatctccaatgtcctttctgtggttttttgcagtcttcatctatttgagatcccctaactgacagcatttgctttgacacatcacatgccatggaaaattacagcctggtgttgtagctgattgtgtcagcatgtatttgtgaataccataaagcactgaaatgagacatattgcactccctaatataggaggtaatttgttttttggacggcctgatatttgtgacattcattagtgagagatgcaataggaaatagaattacacaaatgggagtttcatgttatatttgctatctgggaggtatacgtgatatatggttctcctgtgctccccagcctcctgtacttggtgctgagatgctgtttcaagcttttgtgtctcacagtctggacaagggcacaagcttcttctccaggagacctgattggagcacagggagagggaaggttcagtcccattaatcctaatttcccttctcaggtgtacccagttctcaggatactcttgaacaaccgggagattctgtgaactgagtagggaggtatttttcccccacaactcaatcatggcaatctttccccaatttgcagaaataaatttaagttattagagcactcagtttaagaattctttttccttccaacagcccatgttttctttttcccaaaagcttctgtagccagtatggcttagtttgctagagtggatggggaggaagaggaccctaagtatccacggtcacatgtcatcgttctgtgctcagcgtatcaggcttaacctaggcaaataattaagagtgcaagctccaacttcctggctttattcctcactagcagtatggctttgggcaagttagttagccaagttgtgcctcagtttcctcatatgtaaagtgggaaagagtaatgctacctatctcatggggttgcgtgagagtttaacaagttttagatacagagaacctagtacctagaatagtgctggggtgtaataaaccctcctctgtaagaatgtggtagtattattaaatttggtagaaagagagtggattttagaaaaggaaagaccagttccactctgggctccaccacttacttatgtgcctcatggccttggacaaatcacttatctcgattttacagatgaggaaaccaaagctctgagtgtttgagaagacttaccttccagggttattttgaagagcagcaataaagaatgtagcacacctagaacaggcctggctttgactaggaactcattcaatgaagacaataggcttatataactaatgatagaccttcacaattaataatgtacttaaaatattttatgcaatattactgttgagctgaatgacctgtctgaacatttgcatcacattttctgctagtaaatttctccaagttcataagatagaatcaaatacaataatattccatgttgtgctgcaaagggccctgtgaattcctaggctgcttaaacaggtttaaggatacgaataaaaatgtcatgaaacatgtaggccagtgaaatcctgtgctgcacttacagtggcttaacaattgaagctgacaacttcagccacttacctaggaggccacaaatagaaatagagccagtttcatattccatctgaaattaatcccaaccttttgaaattctatttggcagggagagtagtagaaaactgataattctcaagtaaatttcccagataatattaagtaaagagcactagataaggagccagttgtcttgttatgttgttctgaatcatcaggaatcaggatgacctcgagcagtcattcagctctctgagcccccattttctccctcacaaaataaatgagcaggtaactaggcttcctagttctaaaattttattattctcattcaaagatgtggaattcactacatgaactggagtccgtggaagtttttcttacaccagttgatggccatagacatgttaaggagttttggggttatggaagcctgcctacttccgtgggtcaaggtgtctacagccgggccagaaagaaagccagttgaaaataaactcttaccttttaacttctttggcatcacttgcgatgaaaaatcctaaagtaccttcttggatcttaagatggtttccaggattaattaatatactgctcagtgaacaaaaacaaacagagaagatacatttgtgaggtcatgttctgaataaaaccttgaaggctacaccatactgttgtgtttatagggggcccactagtctaaagctttccccaaagattttgtccagagtccaatgtccactgccccatacatttagttggataatgccatcattaagcactactgcttacttcccaggctggcatgctcccagttgaggaaatcaaagcaaatcaaggtattagggcctgggtttatataatggagcagtctagctgccatcatgggcacatgatttgaagcaaagtccatcagaataaattccttttgaaactgctattggtggtcaacacggaagcattattggcctgatgaagctattgctacaacaattttccattaaatgacagagcattaatgggacccctatagatatacataaacatcatgtacacacaccacatattaccgcagggaatggtacaagacacccgtaaccaatgcggaagcaagctgaacgtcttcatgacattgataaggacatggaaattgattccatgtacagcctttataggaagaattggatttacccaaacagtttttttttttaagtcagcagttggatatacttaacaattccagtctgctgtttataaaaacgtacagggtgtttgaataagatgtgtgtctagcatgtcctaattgaggcaaattgagaaaacaaatgcaaacctccccttaaaaaaacttgccctgcagagaagtgggaacctaaatatacattgtcctatttcaaagtggcataaatagattagcggaccaagttgtgtttggactgacagaagagataaatgtatcctaatctaataaatggatgaaacaaacaagtttaattttctgcagatcaaaagcagaatacaagattgtctgatgcagagactgagaaaagacttcaggcttaatggatactgaattcagggattctgaataaaacaacagatacaacagaggtattccttgttctgaaaagatgttgcttaataaggtaatagatatttggaatcagtctaaaggaagttctcagctgccccaaacaatcaaaatatagaggatggtaattaacacataatcttttttcctactgataaaccattccagagaagtgttgtggtcatgaagtgatacgtctgtagtcatacaggaaggacccaggtgaacctttgttcacctggttgggagacctccgagcagatcattattgcaaaataattttttgtggtcacaagaacatctaccattacttataacaatacctgacaggaggaaactgtacttgtgtcatgactattattaacactcaataataccaaaaggctatgaagatttaactgttctgccctacaaccacaggcagcagtgagattcctcccaaatcagacagcagcagtccacactaatagcacggcctgcactgagcagcggctctccataagcacctcctaatgacccctccgccaactcttcacatgggtataacaagccctctgacttcatgcaatcacgagggtgaagtgttagagctcatacagtttagatgaatttatctttcaaagccaattcagtatgatgttttagaaaggcaggattataaattttgcacatttttttaacctcctttcctgcaaggcagtttttacatgccctggctctgcaatcagaatttgggtccaaattccaacactaccacttaatagctgtttgactttgggccagttactaaatatccctagaactcaactttcttacctacaagaggtggataatggtaacaataatctttagagaattaagagagatgatgtatagaaggctcaatgcatgtgggttattgttcctttttttaattcttgcaaaaaaaaatccaaagtgtatttcattttcaacaaagttatcacagattttctctagctgaccccatggaatataatacagtcttcttatcaaaataccttgcccattaatgagatgaaattatagggtaaagaactgtacgctacagaataatgtataaggacatacacaaaaaattccatgcactggctttgcaaatgcaggtaagcctcacacttctcatctgtaaaatgggtcctggctttgcaaatgcaggtaagcctcacacttctcatctgtaaaatgggtgaataatcgctagcttacaatgcctctaagagagttaaagtatgtactatgtgctacatgactgacacatagaaggtcttaaattcttagttgctactctcagtgagctaggtgattataaaactgagaggtaaaaaaatcctcacagcaccatcaccctccactttgtccctgctgctaataaatgacccaggaggtgccctattggcattgaaagacttttccactgactgcaaggaaatccaaagcattttatccctgcacaatatctggtgatgggctaatttagactgacttttgtctgcacagtgaagtatcctgtgttccttaaatctatggctgattgtgtaaggaatcgaaagcatctctaattacctcacagatcatgtggattccaggatgccctcttattccctgtgaacaggggtgagggggtttaaatcatccccatgtgaggtgtaaggcagaaccatttgcagatactaagctaaggctaaggcagccttctgggtgggaatctaaagaatggatccagtccttgaaataatgaaagaaagaaatctagatacataaagatgctcttggcgctgaagcaccagaaactacattactggtttttgtttttgtttttaatattttcgacattaagtcttctatacacattccaaatctagaaagtttaaataaaatgctaatccccgtcttcttcaaaatataaaaagacaaggattctggatagtgataaccttctcccccttttgcctactatctttagaattcgttattgaccttctaataggaacacataaatttttccaaggatctctgatctctttaggagagtatccaatgttaagtttgttttgttctactgactgccaaaagtctctctctctgtgcgccactctgaatcagttctctagctccaactttatataattcactagtttatcagagataaacttcaacatgtgtcatgtgaagaatcaggaaaatctctaagagaaaaagcccatatatccattaacagaattccaacaaggacatgttggcagaggtggactttccctcatttcaaggaacatataaattatcctttcttctttgaccttactggtttcaacagaaaacatccagtgacagctggaagcacggggctggtgtggtcccttgctgtctctgtttcttttgctctcagactagttttaagtctcgacttattctttgtttactcacctcctacatggagcaaatacgtattttctgtaaggaacccacagttgagtagaggggtacaaaacatgatcacattctatttacctttgagtttcctggagtagcaggcttagagccttgcacgcaacaggcacatttcaactatttgttgaatgaataaaaaaaataagtttttaaagcctcagttccataagttttcctttttttcacaaataagtggaaaggaggtcacagttttctttcaaagaacaagctacaattctcatcagtcaggccgattaaaggagtgaccacacctctgctagggctaggggattggccaatgatctagcaatctctcagatgtgttaagtatgaatatgtaaatatcccaatatgtaaacagcctgccacttgcaaagttggggcaattgatttcaacattgaaagcaaaacttcaaagagaaatatgggttcctagacataaaacacatctacgtgcaattggctagcggggctcagtcccgcagggaaatgcctctatcaggtccctccatgagaggagcaccgcgtctcaagttgtatcacatttcattgggtatctctcgctaaacactggtcaggttggaagactgcagcttgatggaggaaagtaatgcattcctttctccaccacttgtgcataactgggggacatctagttttgtcttcaatcattgtaaactttacttgtttcctgtttctgaagacaacctatgattcgtaattcaagtgaaacagatattgtttaaggaaacttctatccattatgggtaaatatgatacatatatatttctctcctctccctttcatttttggtaggtgtaatgtaccattcctcaggcaatttttaaaaaatagcatgacttatatgagaacatactttgtgcttgataacgtagtaattatatttgtgtctagcaagctaatgggacttcattaactaaagcaagcaaataagaaccatttagggtttccattcatgctatgcccagatgaatcatgccattgagaagaggcttctttgatcacacaagttcatatacaatgactctcagttggaactttgtttgaaccaatccgtgtcccctctcagagagtatgactgcatttgtagtttacaggctatgtgcaggcacagttcagagaaaccccacatctcaaatcttatcacctttctggaacttttcattttttctgggctttcaaatacatgctgctgctggagtcccacacaactagacacacacacttttactttaggataccattggagacacagttgtgtatttcatatgtcaatatacttaagcccagttcacttacacacagacagcatgataaagattgctcccagttggtcagactcaaatgactgccactgtggtccaccagagatactggtgaggacttactcagcctgcatccatctcagtaactttagaaatggcattttcaaatatatttcgtacatacaaaaaaatattagccatatgggatggggaacagagaggtgatctagaaaggataatgctggatatttggttctgggagcaagccaaatcattttctggtatacttaggacaagtcatgcctacatcacaacatgccttcaccacaagataaaaggactcaaaggccaaaagccaacagcagaggtgcaaccactgtggacctttaagatgcaaagtgttgcagtaacttcttgcagttggatcatatcaataataccaaactgacaggaagccacctctatttatacacatgtactcaaaaaaacaacagaagaatcagattttggaaaaagatacagacaaatacacacgcacagacacacacacacacacaattacaaacacaaacacatgacagtgattacaatcacagagaaaagtaacttgaaaagatgaacaagtaggcatctcaacagtatgttttcaacaatattgtcttagataacacattattgaaaagctatcctggaactattaacccaaaagtttttttttaaatgccattgatgatgatttagtcatgcttcatgcaatgtaaaacagcagcaaaacagggtgaaatcacatggtgaaaattgagaaacttcatattaagaaatatgcccaaacacactaggaaaaaaaagccatgagtctgtctcaataaacagtactaactctgtaaatcaagtgtgataatctggcaatttaatagcagtgttctaagactatactgagcactgcccaagaaataaaatattcaaaatgttatcaccaaaataaatgtaaggaaaaatagaagtgtaagggcttggtctctgttttgtggataaaaggacaggaattctgctctatagacaagaaactcgacacagggaggaggaggtcactgggaatgtggaagtggtatgtagacaaaatggcactagagtgcaatggacatcaagacacgtcaggacaatacagaaacagacacaaagggctggagagaagcatcctcctgttcaactttaatagtatttgttcccattattggtgccatgactgaaaacaggagtgtgcctttcctttcttaggtttcctgcaaagaagttagtgcgtcatccaaaagaaccaacaaatcaaacaggaacagaaataggctacttccaatttatgtactctagttggagaggggtgtgtgtgtatatatatatatatatatatatatatatatatatatatacacacacacatatataatatagatacaccagacaagggaatgagattatatatacatatatataatctctctcttcttgaattcttggcaaatggttagtcctgtggttaggagtgaagatagagggtggaggttggaagaaaagttaacgaagagtgcataccgctttcggcttctgcaaaacgacaagaaaagaatttaaaatcaaacaatttgataataaatcgactgacaccagaaggaaagaaggaataaaacctttgtttcaaatcacttgaaggatgcatgtgaaaacaaggttttttggcaaagcatgaaaacagtatcatggggtgaaaccaacaacaaaggcagttaaacacaggttaaagaaggtgggaaggagaaacaggtcctttgaattttcacacccagtcagttagaaaatgtgagagggaaagaagtgggacatgtttaaataaagaaaaacattaaaattattatctcagggaagattttaaaaaatgtgtgttttcacgtggatattgtgtttgataagtcctgtgttttctcagaggcatgatccacattccctcaaacacacctttttccacaagaaccaatgtgcttccacactgagaccaagccacatttgagaattaaagctggcaactgcacaaagaaagcccaaacaaagccaaacaagtcctttttgcccttttctgaagaaaaaaaaaatatatatatatatatatatactaaaaactatatctacaaatatggctttgttgaaaacatctcagaattgtgactcaattgaagggcctatccaagaaaagtttcatcttcagggagtgctctgagttagttttcttagaatagtgacattgagttcacaatgaaccattaacagcctttcgctctttttctctccttggaaccaaaaggcaacaagtgaaagacaactgctcaaggttcagggtgcaatctcctgcagtcagattattccagaatggtcgaaaaacactatgcagcatcagcatcacccacatcatgacatttttttttgaaagatgcacaaaagtaaatagagaacactgagttacacaaagatttgcgatttcgcaacacggggaatatcatttgcaaaaatccaggatacatacagttcccctacacaggtacaagtgagtattggcaaaaacatgggtaaacagtaaccccagaaaattccacctcatctgctgaacaactaataatcaggactgtcagtttttgcaaacaatattcttcactttgccaacatgaaaaagaaaatatttatctatctacatatttgttaactgctacagccatgttctacatatggccaccaaatctaccatttttttcttccttttggttgatttgggttttcaaaatagcttaacatttgatcagattgactttgtgagcaatctgatctggtagttaaggtaacagaaaacattggattgatctgtttacaatccagtgttttcttttcttttgttttgtcttgtcatagacacagactatacacttgaaagtctggctgtattgggttattcacccagataaggaaaactccttaaatgatgataaaaggaaacgtctagtcttcccctgtactctgctcagttattaaggtgtttgttggaggggatctgcactctacatttgggcatctgcaggatcaaaaatatgaactatagaggaatagactgtgggtgtcatttcagagaacaaaagcttgagcatttctcaatgagctctctttcttccaaaactattgacaagaactggggagcaaaaaaatcatctctattttatctgtaaggtgtacagtactccatcagcaaaatttcttgttagcacgatgcttcccacctccagtgtgaactcacatattgactgggatgttatctatttcaaccagacccagtccctcatcagtctgatttgcacataattaagtgtaaaataaataaataaagagagctcctgcctctgagctccactctcctggctcatttacatgaagctgatattctgccacctggattttggttgcaccgggagaagcacatatggtacacaataggctgcttgtaatttggctatcaagagagttggtgtctcccctcacagctctaccccaaggctgctgtaaaggaggccagagtccacctgcttttttgctcacagcagtaaaaaggggttttaagttctggtttaatacttagaaggtgaaaagtccaggtcggcatgatcaggtggagatattttgaggactcatccctcttccctggagaaacactctctgaatgcccagcagggctttgggtgccaggctggtctggcatagaagctgcagtgtctgatggggcatgcctcgaaatgtgctctagggtcagagaggttttacatctggttccatgcagataaataatgcacaagaaagcagaagtgaaccgaccgttctcagaacgcactctcaccatcaaaagtgtcagctggctgctgggtcaccgcaaacttaccggctctctcggttggcagacttgtactcaatggctatcattaggagcttgagcttcacaaaacacagcctgcaatgagatggagaagcctcccaatcagttcttctgaatgaccagagccacataacacacactattacgatctttcggtctcctaatgcagtcattaccgaggggatcctcattccaccggcactgtgccaaagggagggggtggaagcaacacctccccatcttccctattaaacctgatttcttgcaagtgataaggtgctggatgctcaaagtgcaaattgcactcaggtctggctgtctagacacagagcccaagcaggaatttgtgcctggggatttactctgggccagattcattagttactcggtcgggtagtaaaatgttaactacagggggagggaaagatttggaccagctggacctgttatttggattccgtttcggtcttttgtacaaatggctcatattgttgttccgagcagacccctgtgtgcttgcaatgatggtaataatacttggcctctgtgtaagtgcccagcacatgacgatggcattgtcactcctggctccatccaagctgtctcacctcatctgcttggtgctctcgactgcagagcagactgctttgaggctggcttgttcctgtttccatcccttcccttgtgcgttccccactctcgatcccttcttctctcttcccaacccatcctcacaggccacgtcaactctaatcttgcaagcagtgggtcttctccagctactgctaccctgtgattttctattctcaaaactctcccagcaccttgtctgtaaccaaatcactgagcctttagtcaattttacactggctgtggtcgctccctattgtttcatgtgtctgaactttgtctccttaaccagagcaacttccttaagagtcctggacttgtttggaattctccatagtgcatagtgaatagacccaccgatacagagaagctaaacaaacaaatggtttccacttactgggtttcaagtctaagaaaataacaaaaggtgcagtaaaatgtttatgcttaaagattttcagagtaagtgttatttatatggagtagaaaaatagaaaacaacctaaatgtccaataataaggccataaagtacagtgcaatatggtactagcattctaaatggcttttcaaagaatatttcaagatataagatcaataaataatatcatataaaaagacatgaacatgtaaatagaacaaatatataaaaatacatgaatatgtaaatggcacaatacagttagatgaacctatacacttacatacttacagaataaaagctcacataaacaaaataattacatacatgatgtatgacaagtgtctacaattagcattaccattttgaataatagaatattgattaactgatagactgaacaatgagttgatgcttatttatttagctccagcattgtaagggggataagatactgggtcacagtgtggggaaggcttccttgtgggtcaatttaatcccctcaatatccctaagaggaagctattaccccaattattcagacttctattgatagctccattttacacgtgatgaaaccaaggatcagaaagtccatgtaacatgcctaaggtctctagctaatacctggcaggataccctacatcttgatctccagtgaagcctattttgtattgggagagacagacaataagaaaatatacaagtgaataaacaataaattcctagatgatgacaagttctatgttgaaaataaaacaacctaagaatataaagagtaactcagaaggggtatatcatctgtgatggttcaggaggaccattctgaggatgcagggagcacaacagcatgatgagaagatatggggaaagagctttctaggaagtagaaacagcaagcacagaggccctgaggcagggaagagctctgagtgtttgaggatcagcaataaattcagtaagactgcagctgagtgagcaaagtcaagcgtgacagtgattaggtcaggaaatgaggggggagcaagatcatgaggtctttgctttccagagcaaggagtctacagcttattataagtggaattgggggattttagttggtttaaaagagaaaagtgacataatcagatgtgctggatagggggatgtgttgctttcaaggaaagtgctgctgaaggcctcatgctctccagggagtgaaaccaattgctcattcctacatgtgaggttgtggtccacagcactgccttcagcagacagtcagatgtcaaaggaccacttctatccaggcatatctgggatctcctggtgatttgcaggttttctgattcctgccagcagaatctaatgacctgggctttgtgctgattatgcagcttgctgaaacaccaacacacatatccaactacagctggaaaatgccatccttaatttatgtcccaaagagcactgctaacatgcaccctttatgggactgttacttctggagcttaaattgtttttttaaaaaataagatagcttatgcaatgtttattgaaccaaattaccaaattaagtaaccactttctaatgtaaatagtagctaaatacaaaaacatcagggagaaggctgatcttaaacttagtatggatcgtgcaaaggttaatttgctaatatcctatgagcaatgaccagtccactttgggactctggtagttcatgggatcaaagatcttcattgcttttataaacctaatcccgctggtaagaagggaagtaacagttcgtagtaatggtgaattatgtcttcctagctactacagtaccatctaccaactggatataaaaagaaaagagtttcctctacaagaaagtcctaaggtctatgtggccttgtattcattccttaaccttataggggatggacccgcagatctgagtcctcttccagttttaaatccataacttcaaaacattcaaatccatacccaagctgattctacaatgccttatagaagccccttttaaaaagtcctttgacccaaaacaagctgtggcccactggccaaaggaaaggagagggatagaatgatgtgaacagagagaacataggcaagccgtgccacaacacagattttcagactcaagcccttcaagattggctgatcttgcccttcctatgcagataacaaactgagcccaaacagaggagagcaactaggtcaaggtcaattgacttttatgtaaaaagccaaaagtggaaatcgagtctttgacgcaatgtgctgcacagatgcttctcatcagaagagaggaaatgaagtggcagtcacaagcccaacaggcagacacattctgtttggtaagtacagtgttttttaaaaaactgtaaatagatgccaacaagtgaattcacatagaaactggcttttcagctttccttgcaaaatcagatagggccacattggcaccacattccacatgctaaaagggagtgcagctgtgaagcacttatccctctggatgggatgtttgttctccaatgtgccacagttcccaccactctctattgtctcagatggcctcactcttcattctttcttgctaactgcctgaaccctataggtatctaagtttttaatccctactataataggtatcctctagatattgcaaaatacaaatcaagtataatacaccatgatttacactggaagcaagagctatggctccctctgtgagtgttcaaatcacacgtttctgttagatcctgccacagagagttggccaatgtcacaatcctgggcttaaggactgcatcctgttgcagagatgcagcctctgttggaggtgtccattggggaagagcagagcaaggtgaatgaacaggggagctggtgtggtaatcacttgtttgcttatctctcccctctagactgagtttttcctgtacaggatgcatgctttgcctcactggcattttgcaaagttcaaagagtaagccttcagtaaagtctggataaataaatgcatgtatgaatggggagtagaatctcatgactggctggagggatggagaaaagataaagtggcaaactaggaaagtctatgcagagaaagcttggaagtgagtatagaatcatgaaacaagctgcttcttagcttgtcttatttgttagaagcagacagatgggaaaggaaggatacagaaggaaataaaagtagtgatatgctctgggaatctaatttttgccttcaatccacaatgccaagatgcaagtccaattctaagatacaacaatttgtccttgggaccttctagagaccctcttatacccttatgtaccccttacactcccaagaatatatatactttcagtatacccagaactgatgttctctggttaaacatttacttgcatcactcaacaccattttttggtaaagaagaatgagcattagccatctaatccttattctaattctgcctttactcaacttacagtgtttcaacatatacagaattggtgtgaaatcaggaagcagggtgaggtgaggtaaggggaaaaaaggaagtaagaaagccttcacaatgtgataaatgggataaaatcagccataagctagcaataatttaattattggtttctaaaataaaatgccccagtatgtccaacgcaggaagttgttgctggttgcaaaaataattacaggggaatagaaatgacttcttttttcaagaaaaaaaatgccacttgtcacaaaaaggtcttaagccagcaatctgcaataaaactgttataataacaagttagattgctttcttgataattattaggtaaaggtctaccaaatttgacaacgacattatacaaagcccaaccccccttttttttttttactgccaacatcatctgttaactacagtagtttcaacccagatgttcctgaacaaaggctcttaagaattagagtccaactgtttctgcctacccagagggaaatacattgttcctgccattaaatcagccccctttactggaaacattacttgctggtgttaattaaacatggaaacctgtcatagagtttgcaccttcaggaagaaaatacaaagaggaggtttggggctgttgaagaggactcaccccacaagtcaggtgagggaggatgaaagaagcaactgtcatcattccccctgaacccaaccccacccaaagcaccagcccctcttcagctatccagagggcccctgggaatgtcaggttggcacatgcaattgaagtagatacggatacaaacactgcacattgggaaacaaggtcttctggatcgaggggctggaatggaaaagattcacattcaggagctttaatttaaaatgacagccgctagaaatcgaaatatccaggtaaagaaactttgaaacatccggatttccaagactcagcaccaagaaaagagaagtgatttaaaatgttcatggaaatgttaagactctttttctctatgaagctttgataggagtggagtgggaaggtttcagaatatccccaccctctctcccactctcttattctctccttctctctctctctttcacacacacacacaaacacactcacacacacacaatctccactagcacacctaagacactagaatttataaatacattacttgatacagacaattaacttttgcctaaagtgtgaacaactgcatttttagagagccttgctattattattaatgagaaacataatatgaaagaaaaaaccatgtgtttgctacaagaacccagtgttgagtcaaagcccaagcgtccaccccatttccaacaggactccttccctgacccttctgtagagaattctggacccaccactgcctcagtagcctgttattgaggatttcaatagactttagggtcaacggtttattcactagctcatagaaggtcacctcttgggtctctgtagtagaaataaccaccaatactgtattcacatctctattcatatatgttcaaccctaattacaatactccccaatcaagtggatgaatagagccagttctgtgaggggaaaatattttttaaaaaatgagatctgccaggtgcggtggctcacgcctgtaatcccagcactttgggaggccaaggtgggtggatcgcctgagctcaggagttcaagaccacccagggcaacatggtgaaaccccgtatctactaaaaatacaaaaaaattaaccggttgtggtggcacacgtctctagtcccagctacttgggaggctgaggcaggagaatctcttgagccccagaggacaaggttgccgtgagctaagatcacaccactgcactcgagcttgggctacagagtgagactccatctcaaaaaaaaaaaaaaaaaaagagagagatctgagcctctccataaattcacttaaaatgctcatttttgcagccaggctaaagaaatctatcatataacaattgggtctgcctggtttctgctccatgttcaaatttggatgtctttctccaaaaactaatgatttcacagaactgaagttaaactagctacagttttcactgggcaagaggcccagctttcgccgggcggtcttaaattttaaatttccccaagcggcttctttttaaagatctgtctgtgcaaaataacacaggttgagagcatgattttctgaatttaggaggggagcactgaatgcagggaggtagaggagggaaaagagaatccccctgcactcttaaaccagcacagtagcatccatacttgcccctgggcttggggacagaactcctgcccttcagcacagctgaggaagatctgattggagttccccaagttccccaggcattaaatactccacatcaaacctgaattttaactgctccatcagctgcagagggacagagagagacacataccatattttaaatacatcttttgtcctaatcccctctgagctgtaaaacctgatacaattaagcttttatattttgcaaatgatgaatgactgactaataggttcccggtgagattcagaacctagaacacagtgttcttgaggcagcccaactgctgaacccatggtttcctgcagctcctccttgtccagcccctcccctcccctctgccctccctgggggtaggggagtgcaccctcgctttcgcaagtgctcaccaaaaacactgttatcagtttcccccaaaaaaatcacaagtcaaaataaatctgatgcatctctttgtctcatctaaagaggaaagcaatttgctgtaactggaaaatctcggagacctaggtgttgagagagctccctatggtaccaggtggcgcagcctccagattccctaccacttagaatgtcctcttccttctttatcccccatctgaatcaaaactcccgacaagacacagctcaaatgtcatctcttccaggaagaacccccatgtccccccagcctacagggagatgtccctataactctcagcatctctattccagctgtgtgcatctaccacagcacttatcagtgggtgtctagatctctctgacgatgggtactatttcccttagccagacagtaaactctggaggcagccaccctagggaaactgaatattttacttggcatttgttggcatttgtaagtattgctattaatcttttcatgcacatatatttgatcaaatctagtagcagtttcctctagaagtggcaccaagcttggcacaatggtgcacatatcccaattcattaaatatctgattaatcggtgattaaccgataagagaatttcctaaaggttaaaagtaaatataacttggatacacatatagctcgcaatgtgtttctttctttctaagtgcttctattatattcaatgagaaagataaaggtagaaggaaaaggagaggagggagaggggaaaagacattaacccgtactgacagataagtcatagcactcctatttcagagaaggagattggagtaagcatctgtgatggttaatattgagtgtcaacttgattggactgaaggatacaaagtattgttcctgggtgtatctgtgagggtgttaccaaaggagattaacatttgagtctgtggactgggagaagtagatccaccctcactctggatgggcacaatctaatcagcggccagcatggctaggataatgcaggcagaagaaagtggaaggactagacttgtgaagtcttccagccttcatctttctcctgcgctggatgcttcctgcccttgaacatcacactccaagttcctcagcttttggactcttggacttacaccagtgatttgccaggggctcttgggcctttggccacagactgaaggctacactgagaatctcttggcttgaaattgatagagatagctttcggggtggcaggaccttctgcccccactgcctcttttgctctccttcctgttctcttgggaaacaatctcaaatttcacccctacatcctgctcccatatcttttcatagaatgactcccctagcttctgagaaaactccaagctctcccaatcccaccctgcaagggagcattttgccagcctagagaaaaagcacatttatttctttccatgctttaagatgttattggctgcatattgttttagcgcagcgcataattacagaaactgctctgaaaatctgtatattttatctgtgctttatgatacccagaatattccccaattctttttcttcttcgtgaaccagcttaaaatatattttggcatcctttatgtcattttgaaattgaatagccaattcttactgtaatgaaaatacttatgtgccagcccagtgatatacaacactacactctaattacggctgtgctttaattaacctgaattgaagagtgttatcattaaactgctggtaactttgagttatggcttttctttaatttaaagtagaaaacacagataattaagcctccagataatcaaatgcttgaggagagcttcaatgttttgggatgttcctaaatctcattaaatgtccttcttttattgatcatttctacctctgctgtatcattgtattaaacgaataatagcactaagttgtacacattctcactcacatcagaagtggaatatatatatattccagaaactttactgagcaaatactaaattatctgacaacaatttgtctccttcttgggacatgttctaaatacaaaaatcaatcaaagggaatattcacagagccactagtgccagctcttgagctggctgaaggccagtgaagttccacaccacccagtgggtcagggttggcaaactcacacaaccacagggccaggcctgggatttatgtgcaaatctggcctggtttaagatatcagggaggagtaactacatgactatactaacccctttgctacatcaaactggagccagttagcattctgaggaaatgcaggtcttgcattgtcacattagattttctaaagaatccagaaatctagtttttacgtgacatactactatttggaaatatcagcaactagttgatatctacgtgagtcaaacatacctagtgactatcccagttagagcctgtagggggagcagtcctgacccttcaagttacccataagaggaacggactcagttcccaagagcagagtaagagaagggtggaaaagcaagaagggcctgggggttggggagggagcactcttgttagatacaaacaccagttaggccagggaaaccctacagccaaggaagggggcttgacggagcccctgctgacaccctcaccaacataagactcccgcaggcgctggcagctctgctatgtgctcagaccaccaccacattagacagccaaggcttcaattgcctttttataaaactagcttctgttaaaaagcctgctttcccccggggctttgtatcctaggcagaccaagctccagggagggggagatcccctgggacagcctcagtgttccaggacccaatgcctctgaatgcttaactcctctcagtggcaggaagagaaatagctctcaaagaaaggcacacatgggagtcacaatagggcatccattttcagaaaataactccttccgaatcaattacctattcacttttccagtccatttagcattaaaactttcgcttagagacagggtgagaaatttcagtaaacagccaaaccattttggattgcttagggtctgggcccagggactgacagagtgcacctgctgtgttcagtgacaggaggctccaggtaaacacgaagccaccaagcgctccgcctccctccctcctgcatacagaaagaaaaccgtgatacagaggaggccaagggcacccaggactgtcccctcctttgtggtaaagcctgatcagttttgtttcgatgtcttcagacctctcttttggtttgtatgtaggcaggaagtgcaagcaaatggcttttcttcctcagcccagtgagctcccagatacccctgtttcttcccagtgagaagaatccttgtcaaatcctttgctaaggtgtcaggagaataggcttaatgtttcaccaacctcagggagtttgtgttttcagagggcacaaagaccccgttcatcttaaactcaacatctgagattttttattattattattttagagatacaatcactgctatccaggctggaatgcagttgcgtaatcaacctcctgggcagcctcaacctcctgggctcaagcaatccttctaccccagcctctagagtagctaggaccatacgtgtgtgccaccacactcggctaattttccttattttttgtagagataaagtctcactgtgttgcccaggctagtcttgaatgcctagcctcaagtgatcctctcacctcagcttctaaaagtggtgggattgcaaacatgaggattctaagtgaggaatctgaggcactgtcatgcctcacggcagacacctggagctcttgaggtcatcccccataggtgaccatctattctacctgcagtggccatggcgggtggctttgatccatcctgctgagccagtggaaagagaagctaagacttgttattattataacatggcagttgtctatgtgggggctcaaggcctccttctgtatatttggttccacatttcctcagcaaagggtgaaaacactttgaatggctttatttcagtagcttctctgttgtctctatgatcagacttgatgggaagacagattaaaattcctttcattgaggggctggcaagatttgttttgccctcttagaatcagacaggcaggggtttatgccactcttcataaatgtgtctacatcacagaaggcatgcaggataactgtagttcataagttagcataaatgatgaattcaagtccaagactctcaggcctgtcaagaaaagtggggccagtggaaattccccaggcagaggccatgtaatgacccaccctcctattcatcacatggggccgagcacacgggataccctcggcaattgtcaagtgctccaactgtacccagcagaggtgggaggcttccttgcaaggggcacattcaatatccctgaaagccaaagagcatccagttaaaggtcacttactcacaaacagtagggaaggacagacccacgaaggcactggagagatattctgtgtacatttcatttgagactccttccaagtagtatttctgccatgtgtcttcctcaatctaaaggaaaggaacacatgcggagagtttaaaatatgacggtgggctgtaaaagggaaacctgagttacactcttaggcaaacaaatgaatgcactggttagataatggtgaccttttcagcaatcaggaacacggcctctgcacccatataaagccttcaataaccctaaactcataaagtgtgtgccctctaaaacacttttttaacctgtgtgatttctttcctttttcttttttctttttctttttttttttttttttttttttgagacagggtcttactgttgcctgggctggagtgcagtgggtcatagctcactgaagccttggacacctgcactgaagcaatcctcctgcctcagcctctggagtagctgggactataggtgtgcatcaccacacctggcaatttttttttttttaagagacagagtcttgctatgttgcccaggcttgtcttgaactcccggcctcaagtgatcctcctgctgctgcctctcaaagtcctgggattacaggtgtgagccaccgtgcacagtctttaatctgtatgacttctaatggtgcggagacatgggcactcacccacattagtgggcaaggaaattgatacaactgttttgaagagcaattttgcaattattatcaaaatttgtaaaagtacacagtcttttacactacaattccatttgaagtattcatagcaaagaaacaggaaaacagaggtaaaaaaatatacaagaacatcctttctattcatgaaaaatgggaaataaccgtaaatggcacacatacaatggaatactaagaagcaattaaaaattataatgaaaatgtatacctgttcatacagaaattctgtaaaaaggcacattataaaatagtgtacataatctgatcctatttttttagatggcctatagttatctgaatgtttgtaaagccataaaaagaatttaggaagctttatatcaaaacactaacagttgttacctctgagtggtagaatgatactttttttcctctatagattcctgtattgtctgaaggcttttataataagcatgtatatattataatgaaacagtatatttctactttgcacaaaatgacagatttttctgaccccccaaggaatatcacaaaaggtaaaatgttagtttcagagatgtcttgctccaaatttcaaaaggagtatcacaaaagtaaaatgtagtttcagagaggtcttgctccaaatttcattaaaatatgcattttttctaagtagtcaagtttagctggttttcccagcaaccctcttcatgctaggcatctctgaaaggatttcacaatgtagtgaatcttcttttttgtttttttgagacagtcttgctctgtcacccaggctggagtacagtggtgggatctcagctcactgcaatctctgccccctgggttcaagagattctattgcctcagcctcctgagtagctggaattgcaggtgtgcaccaccatgcctggctaattctttttttttttttttttttttttttttttttgagacggagtctcgctctgtcgcccaggctggagtgcagtggcgcgatctcggctcactgcaagctccgcctcccaggttcacgccattctcctgcctcagcctcccgagtagctgggactacaggcgcccgctaccacgcccggctaattttttgtatttttagtagagacggggtttcaccgtgttagccaggatggtctcgatctcctgacctcgtgatccgcccgcctcggcctcccaaagtgctgggattacaggcgtgagccaccgcgcccggccctaattcttgtatttttggtagagacagggtttcaccatgttggccagactgatctcaaactcctgacctcaagtgatctgcctgcctcggcctcccaaaatgctcccaaaatacaggcatgagccactgctaccggcttacaatggagtcagtctttagaaactggtgaattacaaggagaacgttgagccgctatgggagcttagggatctcacaggcctccctgagggaaggagggcaagctgtgtgtctttggctgcagcctctcaggcttcccttccagtgggggcatgggtaagaggaagatgagaggaagccaccccgccaacaggaagtggctctttagaacggcttgtgcttatcttgtattaaaaggcatcttgctggcagccagtcagtcagttcactgggagaaatgcaacatgtggaccagaaggagagctaggaacagtgggcaagggcacacctaccatctacttggtgacactccagcatacaaaagccagaaaaaatttagaaataaactgaaggctccctggctctgtgctctttgtctgcttttagctcagtctgggcaattagattatgtaggttaacctcattagtttgagctgcttccagcctactcccacaggttagacattagctaggcagtgctgctgggtatgagcagtttatctacaaattggccttccccagagtggggtctttaaaaaaaaaagtcactcaaccaattctattgctaaatggtatgattttaaaaattaactgcaatgtgtttagctaagcctgaactttttaatttctccaaaccataagatctcaataatttttttcgaataaaagatatgcttgacttataagcaaaggtcactaactctaactaatttgaagaaagcctaatctgccttagtaaaaaaatgttggaatatagaatatttgggaaacagtattaacataatttgttttattaatgaataggatactatatgaggtatcactaattacaaatccccatactagagccttatgggcaaatagtattcctgaagtaaaataattcagcctattcttttcatatgtgttcttttataatgtgttgtttatggtctaatttaaatacaacaactgattatcaaaaataatgaaaatacaaacctttattattgatcattggtggtattcctcaattaatatggttttaacaaggttcttttagttttggtcagaattttcatgcctttatgtcctaatgaagctattctttataccaaattttattgtaggtgaatcactaaactttttaaataagaaggaacacattttttgtaggataacaatattattcatgtttgttttgaatttagcaaaaattgttttattgagtcattcattcagcaaatattgactgcatatatttttaatcttaggatctgttctagcttctgattaaatcaaaactggtatttacttccccatatttttctctttgctagagaaagcaccagatgtatctgactatgatatacctgaccacatatatctgacttttactgatttttccatatcttttttcctgcaagtttgcctctgtggctaatcaaaatgcttgaggactgaaagtcgtataactggaaaaaagtacagaatgttctagaaaacaaaatgcctcttccacatccttgtgtagacctgcggatagtctctacacactagacctagtagcatcgaatcaactgaataaatgctggagcatttaaatccgttgccattgccatctgtttaagatttccacatctttaacactatttccatatggatagtcaatatgtttttgaggtttctggtaaaggaatttcactttaaaaagagtctaaaattgctaattgaattacactgtcatattctcaagcaatgtatgtagttggtgggaatgtaaagtggcacagccactgtggaaaacagtatggtggttcctcaaaaaattaaacatagaattaccattggattcataattccacttctaggcatatatccaaaggaactggaagaaggatctcaaagagatatttgtacactcatgctcacagcagcattagtcataatatctaagaggtggaagcaccccaagtgtccatggacagatgactagataaacaaagtgtggtaatttacaatggaatattattcagtcttaaaaaagaagaaaactctgacacatgctacaacatggatgacccttgaaggcattacgctaattgaaataacccaatcaaaaaaggacaaccgtgttatgattccacttatatgaggtacctagagtcctcaaatgcatagaaacagaaagtaggaaggtggctgccaggggttgcagggagagggaatgaggagtcatcgtttaactgagacagtgtccgttttgcaagataaaaagagttccggaagtggatggtagtgatggtcacacagtcatgtgaatgttccactgaactacatgcttaaaaatgattaagatagtaaattttgtatgtgtattttatcacaattaaaaagatttttaaaacccttatgtataacataagagcaggagaatcagtaattataattaatactgagaccatttaatccttaagtcatgccagaacaaggacacgaataggccaatcacatcagacaagtcaggagtgagaacccagagtcattacatcatagtgcatcacaaactcagcaacagaacttcagtctttatacctacccaagggctgaaattatcaccttctatcaaggtaacttttctaagtctcgagtgtggtatctttgacttactttggaaaagcaaaaacaaaagtgtacatttctcatacaatgcattcttaggacagaaaaaaaaaacagtgtaaaatacattgaatttaaatccttagccacacctgtatcccagcactttggaagctgaggcaggaagtttgaggctagatatttgagaccagcctgggcaacacagcaagaccctgtctctacaaaaaattaaaaaatttgccaagtgtggtagcacacccctgtagtgccagctactcaggaggctgaggcaggaggatagcttgagcacaggagttcaaggctgcagtgagctatgactgcgccactgcactccagcatgggcaacagagagagatcctgtctctaaaataaataaataaaaccttgtgtttaatactaagaaaatgaaagtgaacaaagaaatctggaccaggtaaagggagttattgtcattatgaattccccttttatagatgataaaactgaggcacagagaggttaagaaacctgctgacagtcacaaagtgaatccgtggtacaaacaggattcagagttcacactcttaaccacccaccacaaagatagaggtgtagggaggttgtggtgttaggatttcggggaatggggaggatttgctgtgtacaagtaccaaagagggaaatatcaaaaccgaagcccatcaaggactcaaaagcccaaactctgtagcctatgactttacgagacgtctagcaaggagtaataatccattttggctctagctgaaagggcggttcaagcctcctctcagagcataaaagtatggtttctattatacaaaatggaaacttcctagcctacaacttctttcctaaaatagtacatgctgttccccacatttgtgttgtcaatgtatttttaactgtaatgtgaagacacacttctcagcagaaaaaaatgaaggaatgggaccaaaatgacttagggaaaggtgccagaattaatttgccagccattcagcaatcagtcaaaggcagagcatttcctgaggcagcaatttatcctttggctgtcacatcaaaccccagctgttttagaagagcgcctagcaaagatgagcagatgatgctctgtgggtccttattcatcaaatacacacgggatcatcagtgagaacaggggactgagccaatgaactagcttgcctacacctctcatttactgtcttatttatctactcttcattatctaatttttcatccagtctagttgaacctcccaagcaaatggtttcacaccaatccacgggcagacagctcccccatcaaatgtaccttccaactggaaacctcagccttggctccacgggaagtcacaccttcctgatcccaggttctgtgtgtgtcactaatggtgggttggtaatgatgccttttattttttatgcttcctctgattagagtgaaactgtgtttctctaatgctaacagcccagtgaatgtgaaaaattcaactctcctggctgggagtatgttacagccatcatgatttctgttcccagtaaaaagtctgaataactgtgttgattacagccaaataatcttgcaaaagtccacctctacccgtgaagtcatgtaaataattccaaagattgtcatatactagtccttatttaattgaaaacaggcaaattcttttaatccaaatatacattatattatgcacatcaaaaataaagcactaaaaggaaattataaaaaccaatgaccattatgttaatagctgcaataagaagagatgagtcgtaacatatacacactaacactgcccaaaacaggtagtagaaggttagtgtattcacaagaacttactacatttactatttttaaaaagtctatctgaattttcagtaaatattcttcctataaaggatccacagttttaaatcttagaagtgcttaataagaattagagacatttgaatgaatatttatatatatcaattatgcaatacattgtcactgtcctttataataagattgtctgaaacagaatgcagtcatatgaactgactggcatatcttagatgccattaaaacgtatttatcatgaccccacaccccccaagaaaaccccacaaaatgtgtcaagtccttgcctacaatactaaacatgaaatcagaattgatgggctctaagttgatgaatgtttgggctggttactaaaatggatggggggtcatttgtatccattcctcaacagcatgctctgtcaaggggaaaagtttaattgaatcttgcgttttctcatttcttgctgaaaagtacgatgttaaggccagcaaggtattaagaagacttcatcatgggacttgtcagattctctcctcctctatttccctctatgttccaatgtcaacaaacttgccccagtttttatcaaagggcatgtggttatctccttctctaccccttcttagcctcttcgttcttcagtataattgcaaatcctaaaagcaattcatagaataaacaaaatgaaatgtttgagtcttgttagctgaggtccaaatggtgccagcacagagaatgcctcactgcacagctttctggggtggagttaactagtgatcaagttgaagccaaaggaagaaagcagaagagaatagtgatttgcaccttttcagaatgtatttcttctctgtgccaaactgcatctcagcgctgaacttcttggatgtggactcagttcagctgcctttctgaaagttgcttggatttcagggactccataacaatttggcattccacaattatggcctctttcagagagcattttccagaatgtgtgactaggacaaaaagatctcagatttttccaaaggcttcaggacaatgtcaattaaaacaattttggggggatttgatggaatgccagaaaactggttgcttcagccatgaacaaataaataaacaactccaaatattaatttcggaatggacttgagccaaatctcttactcccagaccagtgggctgcagactatcaaatgagatttcttccatcaggcattatgaaaaagaatcaacccacacgaggtgttcagagggcgattaaaagactacaccacatgtaaaagtaccagaatacatggtattttccctcactccattatcccaaccaggtttatttctggaaagacagagtgccagaggaactgaaggtaaaggaagggtaaacagcaagagtgatatgagaactttttaaaataataattgagaaattattttttaaagtgttacatatgtggcaggaaactggtctttttttttttttttttaacacatagaaggttttgccaccctatcctcaattttctctccaatatagaaaaggtgtttacacttaagagccttttttaaagattggcctattcactctctgttcagagaggaatttggttttgcaaccttgctaatagtaaagaacatatttacatgtccttcaaataataaggattcttaaaaataccactgaaaataattcttatttgggtaaattgagcaggaagtaaatgttttcagtcagacgtctgccaaaccaaccccagaatagttcagcttcgtatgcagggttttcaggacagcccttcttaccccatctgaggtgagggaccagggtttagcttttatttctaatatccattcttttgcaaaatctaataaaaatgaattacaggccaggcactggctcacgcctgtaatcccagcaatttgagaggccaaggcaggaggatcgtttgagcccaggagtactagacctgtctggacaacatgatgagacaataaataaataaataaataaataagaattacaaaaaaatgaaaagacaaatccaatgcaaggtacaaatccaaaatttttatcatagattcacaatccatataaaattaatccatccaattgctttgaaagtttctaagcacttactctcatcttctgtacttaactcgtcacggatgagtatcaaacagctcacagtccccatctatggaccatggaccacacttggaattgtgctggtccacaacatggcaccactctgtcttaaaaatctgacttcccataatttcccctgcttcagaaaagcagaattgttctcaactaatacttcacagaaagaacttgacaaaacttaatagcaggtgttatctgaaacaaaggagaatggggaggggattctgtggtggcccctactagaatgtgggaaatgttgaaggcacagatttttacctgaatctccactgcctggaactgtgcgtggtacatagtcatagctcaataatagtttctgaatgaatgaaataaacttgggaagcacagaatttaacaaagccaacttgttttatttaattttattattttactttcagcacaatactccttagagtatttaacatgttaagaggaattgtaaatctccaagaggagaacatgacttttttgtttttttgagatggagtctcgctctgtcacccaggctggagtgcagtggtgcaatcttggctcactgcaagctccccctcgcgggttcatgccattctcccacctcagcctcctgactagctgggactacaagcgcctgccaccacgcccggttaattttgtttttgtatttttagtagagatggggtttcactgtgttagccaagatggtctcgatctcctgacctggagatccacccgcctcggcctcccaaagtgctgagattacagacgtgagccaccgcgcccggccagaacgtgatatttagtcacagaatcctttatttcaaggagcagcttaagaagatgggaaatgctaatctaaaaacttcctctcctgacttcccaccctgaaatctctgtttcccttgacgcttctatcacaaatatgtctctctatgacctttttcagttgtcaaaatccagtgcttcctgtaactttcaagtcataaactacctcctctctgaggcctttcctcatttcaccaatgtgctgtgctgtccctgccttaatgggaatagtaactgcacacatctctcaggaggccatgtgggctgaatgagatgatcagtacagaatgtctagaacagtacctggtacttagtaagtgctccatgtgtggtgattagcattaagtaccatcacagcatttgacttctctgacatctgaagagaactacaatgaggtggaattccatttccgtatcgactgtaagctccttaaaggaagagctgtcttactcagctctgtatcttctagaaggagcagcacagtactttgcaaataagaggtgctgggttaatatctgctgagttgaactaagcaagataaaactggagagagaggcctaaagaaacaagaacaatttttctaggcatctgatcataagtaagcatgaataacttcaataacttcatagcgtttagtgttggggcatgaaataaatcaattctgcttctgagcatggaaaaaatttctgcactgttaggatctaccagggagtatgtataactgggtcatttttacacttcccaaaaaacttcttactatgagcaatattttctgggaaatttttcattacagaacatcttgggcttcttagcaactgacttacggttttctaaattctaaatccgataacttggaggcttgaatttgaaagacaaaactctcaagaactgatatattgccaccaatctaactggagttattcctactagctagaagtcctgcctgcattcctctgggagaggaagccccgtccctccccatctcatgcctattctatcttccccatgtgactcagccctccttgtcttctccttgtcttcattttttggattccaaagtaaagtcaaacaacaattcaacaggaagtagactgagcccagggaaggtgatatttggcaagttcattattcctaaattctaaaattgaggccaaaacaacttgatcttttctaaaaaaaaaaaataaaaaaacaaaaaaacaaaaaaaaaactgggagaagaggaagggagttagaaagaacatttgaatccacataggaatggggagcttgcttttgataacacaaaaaactagagagttgcctgtgcctttgaaggatctttactattttagacagtttggtgagaatcccaccagccactgctgttagcaaatgacaaggtctcaccagtggatgtgtctgagggcttacttagtaaaagtcctttgaaatatggagtccagtgctatctatactttgatatgcacgtatgtcacccaagtgtcttggcaaaatccagtttctcatgccttagtcctgaggtggggtcaagtctatgagtctgcatttctaacaagctcgcagatgacactgatgcttcccctatagggcccacattttgagtagcaaggagctgttcccaaagacggtgaagaataaggggcaagtattctccatgatgccttgaggacaagagattcagaagaatcgattacagcctaaaggatttgaaccagagatgaaaaagaatgctttccatgaagtattgctagatattggagccagttacagagaaagcttttagacaattaagcacaagatgggtatccaagtgtttgggctgttgtgataattagcctaaacaatatttcaggggtccagatttatctacttagtctctctccattgattcagtgaccccagtaatagctgaatctccattggaatgtgggttgtgtagatacagaagcaatatcatgactatattgaattcaattaaaaataaagtttcagaaaatggccctgatttgcatccctaatttctattcaactttcccattttaggacacagtattgagtgtgaggacgaaaacgctcgccaacccagtcctgttttagtgacagcagattctgggtacttatgtctcctatcgccatacaatatggcctaataaagtcgcgccaaagagactagatttcatttcagagcaaagggttcagtcgtaaactttagctttctggctgaacagagccattccagccgcaagcataaattctgctagttttaggtatcagagtgattgggaagccaaatgggttatttgtgagcctggtagcaaaggcagaagcgccagctttattgtgtattcattgttatctggacaatctcttgtcagttagagaatattttcacaggaagttagaagcgatttcagaaattcccctctgcagtttctcagagtggatgttaggcctcatcaaaaagacatttggttcagagattgaaagtgggcagcctataaattgctgaggtatttagctgggcttagcagttttcctttgaggaggaaaccatgatcctgagtgctcactgagtacagcagggaagtgcctaagttcacgcagcctctggcttcaaaaaatcccagccttatcatgtgctcctgagccaaggagcataacctctccaagccttaattcccttcacctgcaaaatgagagcaacactagtacctacctcctagggaggcagctgaaatgaggtggtgcatgtaaagtgcttagcagggtgcctggcaaatagctaacatttgtggagtactttctatgcaacagatgagcatgtgttctaaccatactaagagatggcatttattgagtttgtaccttgtagacagtctatacatgtcagctgtcattataagtaatgagtgatagtgatagtgatgatgctgatgatgctgatgatagacaagatagctctactgctcagacaaaggaactatgccaattagatgtggggcctgtgattcatggcttcctattgcttagctgctgctagaaaaggctggaacatcagtgatcatacagtggttctctgaattgaagagaaacattaagcagcctgagtttgtccccaaaagacagcaatattctctggaggtcctctctgccacccatggactttcctaacggccagtaagttaactctgggtagatatgatgataagggagaagttgatattttgaggggacatgatggtctcccaaaatagaaaatggatcatgtgtgggtagcaccattaacatgatgcaggatcacccagcctggctttctgaaaggagccctgggcaaacaggaccctgatgaccagaatgacacttgcccacatctctcagttagtactccccacacactattcgtacctgtcgttctccttcctatcaaatggctttgctactcacttccagccttgcctccacgactgattttgaatggatacctagcatatccttggtccacaggatgagtgtgcaaaaaaaaaaaaagggtacttattcaaaatattctttttaaaaatacttgtccagcttgtatttggaggacagacagagcagtagatggggtgatagagagaggaatgatccctggtcagagtcttcagctactgaccctagtaattcaatcttgagcccaattttgcatactcagcaaaagaaaagttttgcagtcaagcagacccatgctttttagaaagcaagttataaaatatctgtcattacttgaacatgccatttgggaggaggagactcatccctcctagccgaaaaaccgtatcaaagtattcccccaaataccttattaaagtattcaaagtaatctcaaactttctgcctcctgagaagagttctgggaagcacacttttctatttcttgttgcatttctagaatgttttaccactcattgtagttcagcatccccagaaaactgacaggcaggccatcaccctgcagttggtataagatggaaagagggagaggacttgctatgatcctgtttgggcaaagagacccctccctgtccccatgctcacctgtcccatgagcaagttcaagtcaataatacatgtctatccactgaggtaactcattgcagcacacagctgttctccttgcagtcaacaccagtgcagagctctccctgggcaaagctgcacttgctggatgggttttcattaacatatgggaaagaatagtcagcaaatcttcactgttgcagaggactgggaaaaaccagacagatgcacctagttctcacctatccatgcagacaaaatcatctagccttagggagtggagggtgaattgccagagacgctgaaggggttgggaaaaccagtgtcatttaggttgatgaacaatgctgctgccctaaaaaatgtattcagtcagaaaattctgctgactccgtatctcaccacaaagagctccagggaccttccccgacatcagtcatttacaaaagtgttggcaacacaaaattgtaagcactgtaggtagggatgcctttatgccaccttagagggtggttttatatcaggattattcctctatcttctcccatcagtgatccagttctgacccagtctcaaatctcatcacaaatagaaagccaaacagcacctacctccatctcttaagaaagttgaaggagagaatttatagactgaggggtaggtgctttcatatacggataatctttcaaaaataccataagctcttccattttttttacagcaggtaaatagggagctaagagaggttcagtagccttccccaggtcttacagcaaatcgcgtcctaatcagagtcttataatccttgccctgtcccatcctgctgcccactgcacagccgcacaacccccctcacacttcacaaaccagggataacaggaagggtgagggctgtggtagcaattttggataatatagtggtccatgggtacttatagcagggaaatactatctgagatcttcagatgatcaaaattgaatcctagttagactggaatacccaatcccattctgaaggggaatcaaatattcctctttcagttgttcttgcctctctagcctatttaaggagaaagagaaaaaaaatactcaaccacagatagaaatgtccttctcattgccaaattttagccaaaacaagaaatcaacagaagcttcttaagaaactatacctatttgtcccagtctagaaaaaggagaaaggatagaatccatcaccctaaaaagcaatgccacaggtatgggggccaggaataaacagacttccacagccagactgacaacaaagagcttctgcacaccagcatcagtgggcacagagatatatgttacttctcagtgggcagagataccctatctacttacagggtatggaaaaaagagaggaagtgatgactcttattcatagatattaattagttacatccacttcccatcctccagtgtatacagagtacagccatcaagacaggacccctgtatttctccgaacatgaaaccctaatcactgggactgcatcactcgttaccatgaaatacatgtggcagttaatgataaaaaccacaaaaattacactcagttcaaacgttttattgcatgccattcttcaagatggcagatggctgcctaaattgatctcagtgtcatgttacaggtgcccctaagtttctctaaatcagccaaatgagtttgaagttgaaacggccacctcacattgttctaccaggagacgcacaggatgccactgtaatgcagtttgctgaattatagtattcataggctctgattaaaaaaaaaataggtgaactacctgaaacttgccccacagagaatgattattgaatatgctaaaaagccatgatgctgatgaccctgacttaaaggcaatattctccccattctggctgtacagggcaaacatagcatatggcggctaaagagatatctgagttactggttctgggtaagatggagttatcacagttcatcctgtctttcccactgaatgatgttctaagacctggacagaatgcatggagcagctatttgaagacattgagaataaacaatggcaggtagattgaagaagacccgaattagaaataccaccaaatcagcagtgaatttaccattgttctcttctggtatcctctagcctgacctcgaggcagccagaacctggaagggatcatcaagatgtggacaaaaaacctccaggagaagcctcatagtagaactaactaatgcgaggtaactcttagaaaaaatggaggaaatcactgtttttccctccctccctccctccatccattccttcctccctctcttccttcctctctttcttctttcctttcttcctttctttttctctcctcctgtgccccaacaccaagccatctagtagtggcagtagcagtggtgacaatgcaagccagaaaaagattaaaggagataggagaattttcctctctgcccaaaaaacctatggtcctgagagaatgaaaaccaaaccctattgctttttgtctctctctgcccttctaccagttggccccagatgtgaacacaatcacagaaagtatacagaaagccagataactaaagcctcagcagcccttccatcaaaagatcaaaaaggaagaccccagggaacctgaaaatattgcagagatcacatagaaagaggacatggggaagtagtcactaaattgtttataaactctggggctcacgctaagctgtgcatggatgaaactgaccctacacagcacatttagattctaagaactaaactacaatatagaccaccacccagtctgagggcaatattggacagatccaaatagcactgccaacgctttgaaaactcaactaacattgaagtcacaacccatagaagccccataagaacctgtagcctaaaatcaagccgatcaggccgggcgcagtgcctcgtgtctgtaattccagtatttgggaagccaaggcgagtggatcacctgaagccaagagttcaagaccagcctggccaacatggcaaaaccctgtttctactaaaaatacaaaaattagccaggcgtggtggtgggcacctgtaatcccagctacttgggaggctgaggcaggaaaattgcttgaacccagaaggcagaagttgtagtgagctgagattgcaccactgcactccagcttgggtgacagagtgagactccatctcaaataataataataataacaataataataataaagtaaaataaaataaagcaggtcattaccttccaaaataaaattatcaacattcttacaaaatttaaacaagaatcagagtttcataataaaaaaattaaaatatccaagacacaataaaaaattacttgccataagagtaaccaggaaaatctcaacttgcatggaaaaagacaatcagcagatgccaatgcctagatgacacagatgttggaataatctgacaaaaaccttaaagcaactactatttcccgataactaagaaagaacacatttgtaaagaagtaaaagacgggatgcataatttaaaaatcaaaattttaaaaatcaaatggaaatactacaattaaaaaatacaataactaaaacattcactgaatgggctcaacagcagagcaaagatgatggagggaagagtcaatgaacttgaagctaggtcaatataaattgtgcaatttgaacaacagagagaaaaaagtattgaaaagtttcacacagagcctcagggtcctctgatacatcagaaaaagatttagcatttgcatcataggaatcctagaaggaaagcagaaataatatggtgcaggaaaaaaaaatttttttgaggaaacaataagtgaaaacttctttaacttccccagagacaaacctagcagttgaagaatctcaatgaactccaacaggataaacccaaaagaataatgcctagacacattgtaagcaaacaacagaaaactaaagacaaagagaaaatctagaaggcaatcggagaaaaatgactcattacttataggtaaccacaattcaaatgactatggatttctcatcagaaacaatggaggcaagaagaaagtagaacaacacttttaaaatgttgaaccctgaattctatatccaccaaaatgtccctaagtaatgaaagtgaaataaagatattttcagatgacagaaaacagtgtttgttgccagagcatggctctgaaggaactgctaacataagttggacaaacagaacaggaatgatactaaaaggaaggaaacaaagagaaaacaacaacattaataaatattagaataatataatagactatacttctcttgaattctttaaaatagataaaagcaaaaattataacattgtctgatatagtttgcaacagctgtaatacataatacaactataacataaaatggggagggtaaagaaacctatagtttggtaagggttctacatttcacttaaagaggcaaatcatggaatccaagtagacttaaaaagttaagtatgtacattacaaacccatgagcaatcaattttttaaaaactatataaagaagtataagaaataccacagaccaaaaaaaattctgaaaatgttcaaaatgattcaaaagaagaaagaagagagttcaaagtttttgaaaaattagtctaattttcaaaactgaaacaggaaacaaacagaaagcaaataaaatattaggcctaaatccaaacatataaataataatattatagataaattgtctaatgcaaccaattaagaaagagagattcaaagaatcgatttttaaaaaatcacccgactataaactgtctataagaagatcacttaagttttaaagataggtttggttcaaacaaaaaagaggagaaaagatatacttttttccatgaaaacaccaatcaaaaaagaaagcttgagtggctatattaatatcagataaagtagacttcagaacaaagaaaattacaaggatatagggataatatataatgataaaaaggtcaattcaccaagaaaacgtaacaatctaaagtatatgcacttaacagactttcaaacacacacaaagcaaaacctgacggaactaaagtagacaaatccacagttataattggagacttcagcatccttctcgtagtaagatgcagaactagcagacaggaaatcagcaagggtatagaagaaatgaacaacaccattagccgactagtaataattgacatttatagaacactctgcccaacaatagcagaatatacattctttttaagctcacctggaacattcaccaagacagattacattctgggccataaaatgcaccttaacaaatttaaaagaattgaaatcatgccaagtaggttcttaaccataatggaatcagactacaaatcaataatagaaagataagaggaatatcttcaaatacttggaaattaggcaacacacttctaaataattcatggatcaaagaagtttcatgtgaaattagaaaatattgttaactgaacaaaaatgaaaacacaacatatcaaaatttgtggaatgcagctaaagcagggaccaggaagaaatatatagcacaaaatgtttacaccaaaaaagaagagtctcaaatccaaaatctaagcttcatcttaagaagaaactagagaagaggagcaaagtaaatctaaagcaagcagaaaggaaacaaacaaacaaaaaatacaggaaataataaaaccaaagccgattatttaacaaagatcagcaaactttatatctagtaagagtgacaaataagagagaagacacaaataacaaaatcaagaatgaaagagtggttatcactgcccacattaaaaggacaataatgggatactatgaataactctacatacataaattgaaaaactcagataaattagaccaatttttcaaaaactttgaattgtcacaactcacccaagattaactatttaacctgaatagtcctataaccattgaagacattgaatttgtatttaaaaactttcagaaaagaaaaaaatctaggcccaaacctagtagtatttcactgccaaatactactaaatatttaaagaaaaaaaaatcaccaattctacacaatttctcccagaaaacagaaggaagggaaagatttccaactcattttataaagccaacattacctgacactaaaatcaaagacagtctaagaaacgtacaaactaatatacaccaaaaaacaaacacacacaaattcttcataaaaatattaacaaaccaaatccaccaacatgtataagaaataatcacactaactagggtctctcccaggaatgtatggtggctggttcaatattgtataatcattcaatgtaatttaccatattaacagtctaaagaagaaaaactacatgatcctatacattgatgcaggaaagcatttagcaaaattcaacctccattcatgattgaaaaaaataaaactctcaccaaaatagaaatgggaaggaactccctcaacctcaaaagaaaggtatctacaaaacatctatagttcatatcatacttaatggtgaaagaaatgaatgttttcccttgaagacaggtgacaaagaaaagatgtctactcccactccctctattcaatattctgcaagaagtgctagccggtacaatatgattgccaggtacaaggtcaatacagaaacataatgtatatttctacataccaccaatgaacaattggaacccaatttttttaagatgtcatttataatagctccaaaaatgtaaaacttacatataaatctaacaaaacatgtacagaatcttgatgctgaaaactataaaacactgggtaaaacaagttaaagatgacctaaataaatgaagagaccaaattgatggactggaagatacgacatagtaaagatgtcagtgctcccccaaattggtctataggtttaatacaattccaatcaaaacacaggaggaattttttttaggtataggcaagctgattttaaagtatatatggaaagacaaggacactagaatagccaaagcaattttgaaaaagaatacatttggaggactcaaactttgtaatgcccattttaagcaacagaagattgttcctagaccttgaagctcaatggagtttgccatattggaatctgaagttgtttggttccggtacctcctttcatccttccatattctcccttttggaatggcactgtctatagccattatcctatggctgtcctgccattgcatttggggtgcagagtacttgttttctagtttcacagatccaaaaatggagaagaattttgtcccaggattgatcacacccaaagtctcacccataactgattagatgatgacattgggacatgtgagttgctgatcttcagctctgattttggacttgaattgttttgcagggttgagacttttggggatgggggaatgaggtgaatgtattttgcatgtgggatgaatgtagatttttgcagaagtgattaacgatcttgtgataggaaggttatctaagtgggctctaaatgtaatctctattgtctttttagaggaggtttggctaaagaagaagaaataggagatgtgacaatggaagcacaatgttggagtgatgcgatgacagggacaagagccaaggaatgtggtcagcctccagaagctagaaaatgcaaggaaacagattctcctctagagcccccagaaggaaccagccccgccaccatgttgactctaactccactgaaactcagtttccaagttttggcctccagaaaaggaaggaaaaaaacttgtgatatttacagcaactaggtttgtagtaatttattgcagtagccataggaaactaatacatagagtttcatttatcttgggtagatatctaggagtggtatttctgagtcatatggtaactcaatgtttaaccttttaagaaaaactccaaatatttcaacttaaaaacttctttccaggaaagaaagtttaagttaagaaaatgaaaacacaagctacagattaggggcaaatatttacaaattgtatatccaacgagatccaaaatatataaagaattcttaaacagtaaaaaacaaattcaaagaaacaactcaattaaaatggacccagcacttcaccaaaaagcatatacagatgacaaataaccactgggaaggtgttcaacatcagtagggaaatacacgtgaaaaccacaatgagataccacactgcccacctactagactgtttaaaataaaaagtattgacaatgccaagtgatgataaggatgcggagctacagaaactcctgcattgcttgctgatgggaatgataaatggtacagtccttctggaaaacactttggcagtttcttttaaagttaaatataaacttaccctataatccagcaatcctaattcgagatacttaccctagagaaattaaaacttatatccacacaaacttccatgtaaatgtttatatcgactgtattcatgatcgccccaactggaggaaaactaaatggtgtccaatggatgaatggataaacaaactggtacctgcatataagatgtcatactattcatcaacagaaaggatggaatactgatacatgcaacaacctggatggatgtcaagggaactatgctaaatgaaaaaagccaatctcaaaaggttacatgctccatgatgcctttacatgacagacttgaaaagacaaaactgtaatgacagagaatagatcagtggttgccagggcctaggagtgacaggagggtgtgactgtacagcatgagggaatttgggggtatggaaactatcctgtatcctgattgtggtggtggttgcatgactacacatacacaaaatcaactttactgtatgttaatttaaaaaataaaatgaaaaacacttctggaaaactataatcatttccaaatcttactggaatcatgtaccttcagcattttcctataatgcaaatggattactctgctaataaccttgaggacttatcaatccaaagccccaacacctccactcgaattgcttgagttacttgaatatttttgttatgatcagaaggtgtctgtaaacattaggattaactatatttttttctccaagatacttttctttcttcatcttattagcactacctaacccgtccggatctcactcccctttacagacacatttcacacatgggaagtctatcatactgcactgtaacctactgcttccttctttcaaatggttgagactaaactttatagctttcttacatgtccctcaacaaaccagtcatcatctcccttctgtactcagttgcgtcccttggcttgagcaatacatcctcccactacaaggcattatggtctagacaagacagcacttgcctgggtcttttccagactaagctaccaccaagggaatggggcagacatatgtatctcctaccttggaaaagagcttaatttttatagtttttcatggttgaggggaaacctaggataagctcattttacaaatgttgcaaagtggtttctattcttagaagctattgatttgaatataaaacaaagcagtgtttacattcaagacatttctcttggagaagcaatgtgtaacagtggggaaagcgctgagctgagaagccaatgatgttgtagcgttctggccctagctctaccattccccaaccagccatgcaaccagaagtcatcttccgatttcctcctcccaaagagctatggtgatgggtcctgtggcttactattctacaactgaagaaaggtcagagacattaggttctttgcatttggcatgttttccatatgtatctggtttccttgtgtatctggtcaaataaagaatttaagtgaaaatgtatatctcagccaggcacggtggctcatgctgtaatcccagcactttgggaggctgaggtgggcacatcacttgaggtcaggagtttgagaccagcctgggcaacatggtgaaaccccgtctctactaaaaatacaaaaattagccgggtgtggtggctcgtgcctgcagtcccagctacttgggagactgaggcagcagaatcacttgaacctgggggctgcagcggctgggttgctgggggagaggtgggcggaggttgcagtgagccgagactgcaccaccgcactccagcctgggtgagacagcgaaatctccgtctcaaaaaaaaaaggtatatcacgtaaactgaaaagtgctgtgcaaacgtaaagtattactataattccaaagttcttaacagaatacccacggtatcaaatcaatggtgcttccttgttttgcacccctagatgtgtagaatagttgcctcaaagttccaaattcctcatcattgttctggacacagattcacacttaaaatcaccttagggcaacgacaaccaatagacttaaggaaatctgatattttattccttatggcttacataggactttgcgattttcatgtaacaatcactaacagtggatggcactcaaaaaaccaaagtcaaaaatttggaagagtggggaggcagagtagacccagtctgtggatacccaggtggactcaggaatgcatgcaattaattaaaggccaattatctctgaaagagctcagactgatgcttggccagaggcttgttcaataagatggctcttatttcacatcagtgactatatcctgccagccgagaagggccagggtgagtgtcagcttctactggattttcgcattaagtcctgaccattgccgcttctcgggccccatcctcgctgggcaccggactctgtgtatatgttatgtaatctttctgtgctgcctttctctttgttcagtccatgccaagacccatataaaagaatccatatgtgattacagctataaaaccaagaggaaaatattagatgaaaatataacattttggggtttctaagtttgctttacctttaatgctaggcagacagtttacacaaatcattttgctgcaaagtaaagaataatgagttaaatgtgttccctgtcaccatcaatcatgtacatttgcttttgattcaccaaacatataagacacatgaaatgactttctaatcatgttgggggaaggagggagaagggaagaagatggggaaaggagtttcaacttcttttattttattcagaagatccgttgacattttctggcaatctatcttctaacatgctgtatgggcttctttttgctaataatgtttgccttgagaatttgtaaaggtctgagaacgctttaattcaatgttctagaaattaccagggccataggggaaatgaatccctgttaatagctcatggattacttctctctttattagaaatagttttcacagaagttactctactttcaggtgggcattagtgggcttggtcagactgagtggcactgcgggaggcagcatcctgcatggaagcctctgatctaatgggatctaagtagggtgaaaagcgggtacacagtgacgttgacccaaataggatactggggtttagcaaattcatttcaattcatgggtgtttattttgatttgtgaacttaaacaacacactgactggattttctggcagttgaagagctttataaccaaatctaaccagcctctgcacaatccttgtcaaggattaaagagctttgcatttcatgtttctacattgaatcaaagctctttaatttggcaagggaatcatatacagtagcaaagaaagaagttttctgcaccaaaatcacaccaaattacaagtccccgctggtcctggtcccacccagctgtctgtaatacaggctggtcaggctaggctgaggccaaccgatgcattcatttactccacaaacacgtattgagtagctattatgagtcaggcgctgttctaggcactgaggattcagcaagtagccccatcttcacagtgctcaccttgtcccagggaaaagaggcaataaacaccaaagagtgccacgggaaaaaacaaagccaagagagtaaataaggatgtggatgtatggtgtgtggagggggagggggtgcagattcctaaaatgcaattctgttttttccacatggaaacttcatcccccaatgaagctgagaagaacagctgtatacttcctagagaatatgaagtgggacatctactctctctagagaccctcacaagccccagagaacttgtatgagcttagttactttcttcctgattttcctgtatttgccagggaagttgttgaatcataaagtatccctttataagaaatataccatattcatagattggagaactcagtattgtggagatgtcaattctcccaagagaatccagaaacagacccgatcatgtagtatcacctgacttatttaaaaaaaaacagggggttctgggatatttgtaatgtactctttgttaatctaggtcctggttacatgagcactgagggtataagtatttaacaggttgtacatttattacatgcacacttttattatatttcaataaaaaattcatttttaatcccttttaaaaatgcagttctaatgccttagaggaaagactcaactgagaaattaatattaagcaaagacaacaagagttggacagaggggagccaagcagctgctcagggaaggaatatccagccagagggaacaagaagtaaaaatccctagaccagcccaagggagtgtggctaacataagaagcaggagaacactcaggacttaagccaatgaggttccagggacctgactgcttaggacctgcaggccattgtagggactttattcagatgagatgggaccccatggagagacttatgcagaagagtgacaggatctgattcatgcttgagaaggttgttctggatgctttgttgaagatagattggaggtggggtggtaagggcagagcagacagaccagttaggaggctggtgtaatattctaggagagacatgatggtggtttggagctagtagtaggagtgcaggtggtgagaagtgctccgattctgggaatattttgaaacttgaaccaagaggatttcctgctgtattgaatgtggtgtttgagggcaaataaataaatttttaaaaatgagtcaagggtgactccagagtttttagtttcagccatgggaaggatggcattgccaatagtaaaatgagcaaagaacaggtttgtggacaaagaaaaggaattcgattgtggaatggtaagtctgagaggagatggggtattcaaatgtaggtgttgagcagcagttgaatcggtgacgccgggttcaggggagaggttcttcatggaaatataaatatggaagtcatctatgtatctaaaagcaatgagaataattgagattatcaaggaagtgagtataattgtattgggagctgctctccactggtgaggaatatgtgcagaagtctgctgtcataatgccatctgtggttagggtgacattgtccatgggtaatagagtaagcaacatcttgcatctccctatctaatttccaccatgtgggtttactttgccagacaaactctctactctggtaccactagttgttctttcctaagtagagagccacctcaatcccagccttatcagttgcagccctggccccatttcagagctcttgtcaactccaaccctgccacgcaaggttgagttctgcttctggtatgcctccttcaacctggttagcagagcttacacccaccagacaataagaattgcttgctgtgatgattaatgttaacttgactgggtcacagtgtacccagatatttggctaaacattattctgggtgtgtctttgagggtggagggtgtttctgcatgagattaacatttgaatttgtggagtgagtaaagcagattgctcccccaacaaccctcaacccaacccatgtgggtgggcttcatctaacccactgaaggcctgaatagaataaaaaggaggagtaagggagaatttcctccctctgcctgatggtcagtcttaagctgggacatcagtctcctcctgccttcagatctagacttataccattgactttgctggttctcagattttcagactcagacagagactataccatcttctttcctgggtctccagtttatagagcttgggatttcccagccactataaccctgtgggccaattctttataatcaacatctctctctctctctctcacgcatgtgtgtgcacacacacacacagagacaccattgctctgtttctgtagagaaccctaatatacttactttgtcccagaagcacctacctaagtcatccccagcccttcagctccacttggtttagactccaattagtttcacctcctcaaaacagcagtgtgtgtcaatcccttcttgggagcctagttcattccttaccctgactcagcccagcctagggtaactgttatgatgcagtggcctctgcttttgcagagctgggcagacagaaaggtaaagaagatgcacagaatggagctatgcaaacatgtgcccatacatccaagtcagaacagaagctttctgaagcttaccagagcttcctagacctaaggatgctgatgggattagcgcactgtctggaacatggtaggtccccagggcatctctattgcatcaatagttcacatagaatgaactatagaaagctaagatttgtgctaagatgatggcactagctaaagttttcccttatcgtttctcacatttcctttcagtatactcaagggcaaacctggaaccagtttgcttgggtttgaacacctgagtttgtgaattccaaatcacacatccgcatgcaggttgttgaaattctcttaacccatagtgcctgccactgtaaaaggaggataataatagtgacaagtttgggtatggtcattgtgagaattaaatgtgatattgcagctaaagcacttaatacgggatttagcacatgggaatcagtattttttagctattattaaaagtccttgatttacatttttagctgctaaaccagactaattctatacatacatatgtacaagcacacatatacacataaacataacccagactaaaaatatttaaatgattcccttggctatggttagtgctaggacaaaaactttgtgtgtccagccatatccacttcagccaagatacaatctgaatagcatgcttctgatttctctagtgcattctcattcagaaacagaaaacatgacagagaagcgtgtattgttatcgatattaagtaacatttcacccgcaaattccaaatcttgcggcatagggaaaaaaaaacaacactagaaatacataacatattttcttcattctcaaaactgatttattcaacaaagaaataatcatggagagcatactgtgttccaggttttgtgtgtgtgtgtgtgtgtgtgtgtgtgtgtgtgtataaaatgatagattaacagacttcaaatagttggcaattctgagaactatttaaatgtgctacattggaagtcccaatgtacattgaaaaacaattttaagagttaatcaccctctaaacacacacacacacacacacacacacacacacacacacacacacacacaatttgtcatgtgcaaagacagctaatcctagtaagaatgatagcacaattcatgaagatggcaggccatgccccaacttgaaacctcatacgctgaagagaagctaagtatgcatagtaagactcaaaaacaaaaacaaaaacaaatcaatggatcttaaattacatccaagtgaggaagccaagtagagagtaagtgtggccacttattcagggctgaggcaatagcagataggctaagtaagttcattgcctgggtctttacagaagacagcagggagagtctcactagaacctgacaggctaggagtaggagatcagacagtggcaaatgaacagcatgttccagggctggctgatgatgtgaatgcagataagtcacaggcaccaggatgttcgtgcgaactccttaaaggaactcaagggttcaaataagatcctattgcacaaaatgcttaacctgtccttaacagcagctgctgagctggaggatccctggattgccagcttgagtctctttcctaaaggtattagatataaaattagcataagatttgttaaatcctagcactgcagaagctgtagagggcatgccttgaagtttaaatggagtaaattaaggacaaatagccagaaaaaaaatatttagcagtagttagcaaagttaagaaattcattacccccaaagatatgggggtatataaaatataaaaaagattcctaaaaagtttagatcaattcagagatatatccacataggagtgaggttttcagggacaaagacttagggtcctaaggttggtatctttgagagtggcattgatggagagataaagaagcattgctccatatttcttggtacctccaggctgggcctcttttgtaattcctgtatgccagtagtccctctttctttttctttcttttttggagacggggtcttctttctctgttgcccaggctggagtgcaatggcatgatcttggctcactgcgacctccgcctcctgggttcaagcaattccccggcttcagcttcttgagtagctgggactacaggcatgcgccaccaggcccagctaatttttgtatttttagtagaaaagggatttcaccatgttggccaggctggtctcgaactcctgacctcaggtgatccacctgccttggcctcccaaagtgcttatattacaggtgtgggccaacacacctggccagtaatccctctttcttttattaaacatatcacccccactttcagtcttggcattttggtctcatgcatgataaaatgcccagtggaagtggctcacacctatataatcccagcactttgggaggctgaggcaggaggattgcttgaacccaggagtttgagaccaacctagacaacacagggagactggtctctacaaaaaattaaaataaaattaaaaagcccagtggatagtcactgtgcttctgcctgtgccacatctttgctgttacagtcttgtttctcttattttaacaggggttctgccgcaccaaaaaacagacacgaccggcctaggggaagggagagggtgagctaacactttaccttggcttccagaaatgctaattgttcccaaaggatcaagtgctgccaaagcctcaccccttctttgtccatcctaataggcctgcttgtccccatggaaatattgatgaattctccgtcataggatacggaggtcattggagaaggaagcaatttctgtaaacaataatccatttgtaggtttacttttccacctaccccccacccccaacaaaagtaagtgagggctttgtgatccctggaatgggagataatacataaaacatgccaaggagggtgccattatggtgttcaccatgacctaaaggagacgaagatctgggatttggaggtaagtacacaaagatagcaatgtagaatggggagcatgtgaataaggcatctctattttagctgagaaaaatatatgaggggaaggcttgtgatttccaggtcatgtaccttagccaattccaacacaaagaccatctcagtgtcaaaaggtcatattcagagagctacttccaaacaggcgggaattggccttatacagaaataatgtggtaacataacccccagaggaaaatgtgttttcagttacaccagggccaggcccagcctttcccacaagctcttcctaaataggaacttggcaatgggattagctgagctggagcggacatccttggctttagaggtgaggcccatcagggtctggaggaaggttgggcagaggttttccctgctgctaatagcactgaagaatcagcatcacatccattttattaatttccttgacagacagctctagttaccatgcaggcaccacaaaatcaaaacatacgcatgtcaaggggccccatctgtggtggggccctgccaaagcccatgttacatcaacacgaggaagcagagcacagctccacacaccatgtgcttggtcccatgggccatgccctggaagaaaaccaccagagcttgattgaaagagccagagaagttctcgtggtgacagtcctttatcctgagtctgggcttttcatgttgaacataagatccctgggagacacgtggctacatctggcttcagggtctcgtctctaaacacagctacacagacctccctgccacctccattcagttccacccatgcaggatgagagcagcctggattaaagaagatacctaaaggaatgcaacatctttatttgtaagctggatctgagctcagagttctgctgagctgagacctttggctgcataatgagcataggaggattttttaaatcaaggtatcccttgctatcagtgttgctaaagtgattgaaggagctccaaagcaatttgttcctttatgtggagcaatgttaactatcagttggctacataatgccgatttggcaggtacgaaggataaggacttagaaaaactcctgctctaaataatatcactcataggtgcccaaggtgagcaccaatgcatctgtatcctcatgcttcccacccatccctcttattgcaacctaggccatttcctcaaaaccatcaaggaacttggcagtcaattaggtagccacatgacagcaaaaggcaggaggtctcatacctttgattgcagagcttccagcctcctttatggacctcgtgctgactcatgaactttctaaggatgtaatttcccaccttgccagctattaattctgctccttacatagtaagaggcaagatgtaagcccagatccagagctaactgcctcccatgccataacagaaaggctcaagctagacccgttttacacacgggtttgtcaccttgactgcctaatctaagaacagtctaaggatgaggactggagtgactgttatcccaggctccagaagcccccttgctagtggctgggcgatcaatgcaaggctctggaaacacaatcctaacctggcccaccctgggaggacagagtcggttttttttctctccttgcctgcactggtgcagcaggtatggccaccttggggactctggagtgtctgtccagccagctctgacaaggacatgaacacatccagaccgcctgtctctcggtgcaaagggcactgctgccgaggactcagtacattgtttcgctctccattcaaacaaccgcggcatgtcagtcctgctggcctccttgattgtgcagaaataaataaatgaattatgctgttggggtttgggcttcagcacaaacacatggtctgcatttatccacacagtgagaggtccaccagccacttgatataaaagagcaaaatgataattcttttctttaggcgctctgttgccatatggaatgtatataaatcatatttttgttttaacagcggaggctttgttgatagataaacatgtggtttatctaaaaaaagaggggattgtgctttgaacaatcatttaatggccgtggatgtgccaaataaaaataaaaacataattttgaaagaagttggcttcatgcccaaatccgtaacaaggaatttctccttaacccaagtggttagagcccgtcgatctgttttgagtttaagctgtgctctctactcaaccccacgacaaatggaatcccgagctaatgtgctctaataagacgagacgttacctttatgaatgacctcatggagaagaggttggcaagcatggtggagaggccttgagccaggcagctctgggctatgaagcccaacttcaactctgcgaggcagattgcgtcatcaccttctttccaattccagctcgggatgtttagcagatgggcctggggaaagaaaagcaggtatgagaccttgctctgttaaatgttcaattgtttaacatttcttctgggaaatgcagcattgcccaaccactcagggccatccagtcttgcccttcttttcccttgctgcggtctgatgtttgctgttttatgcaactcttctgctcatcacacttcagtctctctggactgttgcttctgcacccaccaagcccaagtcctcccctgggtttgtcatttagccaaatagagcccagagggaatttcctcttgtgacagacccaacagcctgggttactaggatgtctagctaaatcattaagttgagtcctctaatagaccgtaggagtgccaaatgcctgtatattttcagtttcttttttacctgcctttccaatactccagatcagtgactcccaggcatcaggagcgggcatcagaatcacctgtacagtttctgaaaacacagattgctggccccccaccagcatttctgattcagtagatctggggtaaggctggagaatttggcatttctcacaagttggaggtgacgctgacgctgttgatctaggggccacactttgagaaccactggcctaaaacatcaggtaaatcacagtgtcgacgtttccaatctcttgcaaatggactggtcctattcaacccttatgtcaggccctgagacaagaacccagaggcatgctcatccaattatttttaagtggcatgaagcagagagtcatagaaaatacattggatgaaagaatcaaagttcaaaaggttctccagagttggaaaaatcggcaaaagaccaaactaaaaagatttacaaggctttcatgtcaagtacagcatttaggctaaaaaaaatcaactatataaattcaaaatgagaagacctagcttggcagcaggcaggagagaaataaaagaaaacaaaacacacaaagctaaatttaagtgtgtgggtaactaaaacctcaaattttaggctagccatgtgacattacagagaaagccagtgtttactttttagaagtgctccccagatcaagggaaatgaacatttcattctgttgtgaattggtcagactagttccagagtacttgatccagttttcagtcagatttaaagagggaaaatgatcaactgaataacttccagagaaaagtgacaaagacaagaggaggtagcgtctggaaaagatcttttgaggaacagttaagacagccagtaatatttggcctgaagaaggctctcgtcctcacagagacaggatggttacatctgaatacttcaggtgctgctgtgtacaagattaggtttgtcctgctttgttctagaagccagaattaagactgactggtatatattccaagaaagcagatttttgtcttgttttataaatgaacttcctaaggatgtaatttgtctaccaaacggagaaggttaccttaaaaaatgaaaggtctttgtccctaagactcagtaagtatttctccaagttactatggaaagaacttttgctctgcactaggaggttgaatcagagagcccttctaagtctctgctagtgccaagattctatggctttgaagttattatttctctgcacatctcagcaaacacaaggagcaccaagggagcattcccttcactttcagaacaatatacaatagttgaactagaaggatggaagactccattgtgaaaacaaagagcaagtccaagggttccacactctgctttcaaaaatactattcttatgaaattccttcttgcaaaatccgcttctgtgacaatcttgtgcatcctaagccaaaagtgggtactccagggagagatgacagtgccctccctgatgagagcatggttaaatagtctcatggaggggccacagcaagtggtaattgctgtcaaactatcaaaggaccttccccacactgcagactcaattccaacaactagccctaccctttattccttcctctccctactctccagtggcttcagatggccactttcccttttacttcctgggcatcgtagagaacacattggtataactggagaaatactcacttgcagtaatatcatctgagaacctgagaggaatgaggagaaattcagtttaagtaatgaacaagtcaagcattgtgtgtgaaaggagatttttttggtccaagccctaaagagacagctctgaaccttcatggcaccttcaaacaaacaagcaaaacctttcagagaaagtctctcctatccgcatgtgctatctaaggtataaggctgaggcatttcatccttgggtcccccatggccctgtctggtttgagttctgtaggcatattttgagctttctttctcactgtccaccttgacacttggccatgtgattatatagaaaagttgagtttgttccttatctcagggttctgtgccctctttttttggatattatattttctccaacgcagggaaggagtgagggtgacctgctgaatgcttggagggaaatctctgtgcatgaaacaaagagaagagactgacccaggaacataaatcctttgtttctggaaacttcgtccttttccatttgaagtaaattgagtctgatgaaaaatgccagtgttagtgcccagaagtctggaggcaaatcctctctccctaacttggagaatataaagagcaggtctggcagacctggctgcccttcatttctgctacttcaccacccctccctcctctcatggagaaggaactggaaatacgctgtcctggaaaaccaggagagatggatttcagtcctagttccatctctcactacatacaattttgggaagccactatgaggaacaaagaaggccatgaaagaggaaacgatttaatacaattgcccaagtgtcagggtggacagtggaaaaaaaaagctcaaagaacttgcctctatctgcactgggctcatgggacttggcttccagagataaaggcctctttcactagagtctttgggaaaaataaaaaatccactgagaggtaaatcatcaggagtgatacttttccaagaagttataaaccaatctttccttgaagagctttgagccatttacactcaaatcagaagatgcagggccagcatttaaaagatggccagcatgaaagcgtttctctccaagaattctagtgatattaaaagatacactttggagagcatcagcccttctataatgcctactctcgggaaccacagtttggttcaatgggctgtggctccatttaaagagtcggtggcagtaagctcttctgtctccccgctcgctggctgcagagtggtggccatgatttgtgcccagcagagctgcgctgtctatacagagcttagatgccctgctctgaagttaccctgggatgctaaaatgcacagatggtccaacgagtactaaagaagataatggatgtcaaagctcttttaaaaccataaaatatgacacacatgtctacaattatgatgatgacaaactcagggccagttttacatggagagaaagtaggcagcttccctacatccctctaggccctagaatattactattactggatcataggggattgaaatgcttcatatttcaagcccgttgtccaattatgaaatcagctatctcttggaatatgttcatagtgacatgactttacaggcacataccaggtcctttcctgaaagcaaattgtaatgcatggagatctctaagcatctaggatgagtgcagcaaaaagtgccaagaaaggcagaaaaaaaatgttgaaagggaagaggaagaaaatgtattgaaagagtaggaaacatctcaggaaacacagcaaaactgtgaagcaaggtgaagaatgtccatttgcaattctacaaggaatgaaagacaaacaatgatgagtggacgttttcttctttctctagaagagagatatgaaagaacaacaacaacaaaatgccctgtgtcaaagtcactctattccctgtgtcctgactaatcatccaaggatctgtaagtgattctgcccaaccccaaaactcgaatagtttgggatggttctaaacaaaatgtgttttaagcaaataatcatgaattggttgatatcttcctcactgtttctgaataattacaacacagaggtttgccaaacacattcaggttgctatgatcatgtgattactgaccagggactgtctggatcccaggccggctgagctgctttgagttggacaataaccacagctaaaatcctccttaatttcttgaagatgctgcatcagcactcattggaaagagaaaaaaaaggaactgacaaccccttctaaacatacaacattaattttcctattcaatctaaattcagccaaaaatctaaacaacagcttaaagcactcccacactaaatgaaatttcagatcacaaatgaaagaaggagagctcgttgctgcaggagctgtcactagtcacagccttgctaataaaattcacctccacctacaagggctgccatcaaaaacttctccagcttgacacccgtacattaccaatatcctcactttatctcttcagtgtccttgggttttccagagacaaacaggcgaatgtgaccttgggtgcccaccaccaaatccgttggctggagaacaacacgttctgcaagggagccacctgccgagggctgggcagtggctggcagcagtcagccgttctggatggtgggccagtcactgacagcaggctccactcagtgacagcctctgatgggcctccacacagcaaaatgggccagcacttgccagcaattaagaaataacggcatggcactggtgcatttggcagaatggggtttttctctgcatcacctgactgcctatttcatagggaatatggcccataagagggggtacgctgttactcataacccagcagcgagttattctgtacagacaggacacctggctccaggtactgggcagcctccggtttctaggtttcattaaggacataactggtactgcatcaaatggagaaaggtgccaccttccctcccctaaagctgtttttttggaagtttattgactggctgagagaaggagcactgcctttgaatgagacactggactctggtttactgagaagtaatcacagggaaacagcatagactctgacttttgtcttctttctaatcaatcccccactgtaagctataacacaaggaaaattcctttctctttaatctctggatagcttactattttcctgattcaactctgcaaattctcatctcgactctgggaatgtgtcccacattacactcttacagagcgcattatgcactcactagttcacctggtctcagatagagaaatcctatcactcacttgcctggagcattctacaccttaactgctaaatccccgaggacacaaaatagggcttctccttcactgatattcctgtgggtgtcagggagagtgctaatcacacagtatgtattcaataaatatttactgaataagtaaatgactgcagcacatacaaataaaagttgttgtaacttaagtatggatgggatccaagagtaaatcaatagttctgaacctcgggttccaatagacacttcccgaatgaatgaatcagtacatgaaggagcatccttccagtgaccaaatgcaaacacgttgtttggactaaagaaatgggccagaggcgtggtggctcatgcctgtaatcccagcactttgggaggccgaggcgggcagatcacctgaggttgggagttcgagaccatcctgaccaacatgcagaaaccccatctctactaaaagtacaaaatcagcctggcatggtggcgcatgcctgtaatcccagctactcaagaggcagaggcaggagaattgcttgaacttgggaggtggaggttgtggggagtcaagatcatgccattgcactccagcctgggcaacaagagcaagactccatcccaaaaaaaaagaaagaaagaaagaaatgtcccaggaagatttttaacaatcacacctctttacccaggtctttgagttgcgcacatgtgggcatgtgagagtgtgtgtgtgtgtgtgtgtgtgtgtgtgtgtgtgagcctgtataatgaggaagaagaggctggacctgtggatgggtcttcagacctggagcgggctctcgcactcctaccttgttgtgatactgcagcatttgagtgatgattcttatcttcggatggtagttctttatggagattactctgaaaaagaaagaaccaatgctgagacaggtctgccttatgcatggtgtctgacaaaaagatcaattttactgtctccaaatggggtacccatgggactgaggtaggaggcaggacttgattccagaggcagggctcagataccagacaaaattgaagactagctgaaacagggatggggcagaagcaacttttcactggacaagcccagcagtgtgccctgtcagtttaccattgccatggcaacacccaggaggttccctataacctctaggccctagaacattactattactagatcataggggattgaaatgcttcatatttcaagcccgttgtccaattatgaaatcaactatctcttggaatatgttcatagtgacataactttacaggcacataccaggtcctttcctgaaagcaagttgtaatgcatggatgaattccagtcccagttccatctctcactacatacaatttggggaagccaccatgaggaacaaagaaggccatgaaagaggaaaccctttaatatgattgcctaagtgtctgggtggacagtgagaaagaaagctcaaagaacttgcttctatctgcactgggctcatgggacttgcctttctatggcaatgacccggtgacccagaagttactaccccttccctagaaatttttgcataagctgccccttaatctgcatgcaattaaaagtaggtataaatacgacagcctgcccagagctgctactctatggtgtagccccgctgtgcaggagcagtcacagagctgtaatactactgcttcaataaagctgtttccttctgccctaccatcagcttgcctttgaattcttttctgggggaagctaaaaaccttcatgggctaagccccattttggggctcacctatcctgcatcaggaccagcagccagggctatcctgaggggttgcagacactgggccaggttaaacagtattcccaccaccatatctcttgctagtgtgaaaacaaaatcacaaaacagccacagtctgtgtcctgggcatgaaaaatttgagggccccttggaatgcattggagatgggatgtatgcatgtgcgtactggggagtagggggcctggagcaggggctgccagcttattgcctacgtagacatcgaaagcgagcccaaatcatggggcctccagaggtttgcaatctcccacaccctagggactagcccagaaacaatctgctgagtccaattctccaagttaacaacttgagacaacaatgacaaatcaaacaagcaggatgacaaatggttctaattgtgacacatgcttggccactatcacaaaaaatgatttctaagcagggcttttaggatgagatcaaggactcagccttccatagctaatagagaaaatgatgacttaaacgctggttaaaaataagtgccaaggcattgcgggggtcatgatctggtggaaaattgtctcctacctgccctcagtccaaactcaatgttaagcatggcctgcacccaccccaggcctcacgtgtcctccccacatcaattatggtgctaaagggaggggcagagcgcagatgaatggaaacacgtgggttccagtcacagctattgtactaatgaactgcgcgacctttaggaaaaccctgggctctctgttcctgtttcctcatctggacactgggagcaacagtacctgctttatttacttcacaggcttggtatgagcagcaaatgggagaccagatgtgaaaatgctttgaaatcattaaaagttctctccacgtgtaagttatggtttttgtcattaccaagtctgtcagaagtgacattgtacatttccttctgtgacaaggaaggctaaagaatggaattccacagaaaggcccacctcctaagcctaatcagaaatgcaagtgcatttattatgaccacccccacaaacttcccacccagcagcgctccccacttcaccccttttagtgcagaaatggagagaaggcagccagggagcagctttatctgaaaagctgcaacgtacgaatttaggaaatggatcacgctaaagcctctcccagcacaaattcaccctgcgtttttgcacttgaaggatttcattttatttttgaaaaagtgttgcgttggcccacgcttataactcaaggactttgagcctctgtcagccctgccttgcagttcacagcttcagccagttttctgcattagctcatttcaaatggatctttgacattttaatttcaaaggaggcagattggtctcattaaactgaggaggaaggaggattatacaaataagagaaagacaaagcccatttttaaccctgaacttcccacttctttttgcagccaaggcctcagttctggctctacttaattacatttctgatactacctttgaccagtaatttctttttttcttttctttttttttttttttttttttttttttttttttttaagacggagcctcgctggctctgttgcccaggctgtagtgcagtggcgcgatcttggctcactgcaacctccgcctcctgggttcaagcgattcccctgcctcaacctcctgagtaactgggattacaggcacacaccaccacacccagctaagttttgtatttttagtagatacggggtttcaccatgttggtcaggctggtcttgaactcctgacctcgtgatctgcccaccttggcctcccaaagttctgggattacaggtgtaagccactgagccccgcccttgaccagtaatttctatgcctccttgtcctgccagtcaccctagtacctatgtgtcttcatattaaccctaccacagttagggtttaaataaaatactacaattaagagaaacacccatttcaaaactattactcaggtagccccaaacatctctgtggagtcaaaacattaagcttcatcttcttttggttttccatttggaattttgaagacagtgaagccaggttccttaaagggttacatttttttttttaaatcatttccaatgacagaaaaaggtgtcaaaagttgaaaatccttcctacttcaaagaaaggaacaagtgacacacccaaccctgatcctggtgtagccactgtgcagctgtaactgattcgggaatgagcccaggtgtgaagccagaatctgttccaccctctctctgcagcctggcaagcccaaagcttagaagagttcacgcatccacttccttaaaatgacctcactaagcatattgccaaagaaaactgagtggcaagagaagatggtgccagatgttgcctgccagacacaaggaccagatgcttaagggaggactggctcctctgaaatgcactggaggaattcccccacctcactgatggggaagctccggtcacttggggccactgatggaaagcaaagacaaaggcaatgcaaacattgtcaggatgtaaaggtaacttcttgaccttcaacctcaggtaagttcccaggaggcagtaaaccaagccaccggtagagggggaaccttcggcccgaaagatggctgttcacagttaggtaaaagttcctgggaatgcagtgggacggaaatcccactgaatttagctcaactctccagaagcttccctttatcatttcctctcagccctcttaactcttctgcaatttatgctacagaaaagacaaattccaaagggcctctaactacctggagcaaaataccttgactttttagtcatttcattgtcacacaatgtgactactgggtttatgcaaggaacaaaaactgaacaattgctttttttctgaattaagaaaagaataaggtgctggtgttggggccaatattagcagttgacaggcctaacccttgtgcacaaaaagcactgcacagtgtttcccagtatgacctcccctagatgttctgtaaaaaaaaaaaaaaaaaaaaaagggagggcagggcagggcagggcagggccacagcggcacactcctgtaatccagagttttgggatgcccaggtgggaggatcacttgaggttaggagttcgttgagatcagcctgggcaacatagcaagaccctgtccctactaaaaaaaaaaatctaaaaattggccatgtgtggtggcacattcctatagcctcggctacttgggaggctgaggtgagaggatcgtttgggctcaggagttcaaggttatagtgagctatgattgagtccctgcactccagcctgggcgatagtgcgagactctgtctctatgaaaaaaaacgggggggggttgggggaggtgggagaggagcagaggcttatagtcaaataggtttggaaagtgttctatagtacgttatctcagagatgcatattagtattaaaagcactgaaaagcctttcaagaaagaacattaattttgggaaactggatgaaacagcctaactggtcactaaattcccctttggggtgataggaatcaatatgccgtagacacacttggaaagccctagtaagggttttctcagcctcgacaccattaacattctgggccagacaattctctgttttgggggctgacctgtgcattgcagggtcgttcgcagtgtccctgggctctacctatcagatgccagcagcacggtcccctagttgtgacaaccaaaaacatctccagacattgcaaaatgtcccctgggggcatctgcctttagttaagatatctcaggcccatttcctttagggaacatggtactttaattcaggccagcacccatctcaatctatttcctagttctgtctcaaggaatctcaaacccaaggccagctgtaagccctagagctgccacctgctgagggtgagcttccggttggtgacaccctgtgtgccactgccccaacccacacagacagcctcggctcccccaggcctatgcagctggtgagttgtacagtggcttgtggggcaaaaaggcctcatagagatagtcctctgcagaagatccaaaagggccgtgaacagccacagactgccaagcccagggccttccgcagcgccccaagagttacctcatgatattcgaggcatcctccgcatccgggtcagcgcagtacttgttggcaaggatcaggcatgcatctgctgactctatctaagacaccgaaaggaaaattcacagaacacaaacatataaatagccatgctcgagtgtagtctctctctgttgacagcttcttggggaagctttgcaaagaaaaaaaaaaaacaatcctgagagcctgagagattatagtttttgtcaaaagtgtaggttccaagttcttgttatggtataaacatttcatcttgttgctgttggagggtacaacatgtaccttggtaattatacttttcatttggcatcgttgcttacttgtaggatttccagatttctttaaataacaattaattaagcctttcagtctcctccccacctcctttctcaaccatctgcaccatcatcctaattcttcctatcaggagttggaggtgggtgggttaaatcccttctctccagttagcaaggtaactgagtattggggattcagaaatgtacactctgaagtccttcatctgacctttttcacatcttcattttctataggctgggaagagatcagagctctaaatcagataacatcaccatattgcttagtatccgattagtattcagatattcagaagacaacaaatctatgtatgaaataatgtgttacagttgaactcaaaatatacctactgacttatccaaacacgagcccacaggggtttattccttagaggggaccatgagtttgatgtgctaatgattgcttgcatttaaattaggtccacgaacaataacaattgtccctacgttctcataagattttacataagcaataacttgagttatgtctggataatatcaagattaactggactctatgagcataagaattcttatgctggctcaggtctgcaatctgtcctacttggtatgttatacttaatagatcattcctggattttgagggaggccataatatcctccgtggtatgtcacaaatcatctctgatttctttaataatataaagaaagaatttatccaaatccttttggattattcatcttggccaattatattatttacaaaattatgcggtgaccacagttagcatttagacttcagtgaattcattatattaatgtacaccccctggcatgcaaatattgaacatgcttacaaaatctatattacataggtaaagtagcagatgccattttgccttgtacctttcccttctaagcctcaggtgtgctttatgagaagattctaaattaccagtttctggaaaaaaagattcgcccattatcaatgatatcagataactgcatgtttagttttacaccctgcgtcttagatggggaaaaaagaaagctcaaatgttttatcgcttagtaaaattttattttatattttagcctaatgtttctttcagatgtaaataatagaagtcagagctatattgagtccaacttaagtgttcaatataggaattacttgattattatgttgtataaagctactgggtccatataactggtctacttccttgatgagtagctgattttgaggaatccagcaaagcaagtttcatgttatgaccagtccaagtgtgggatggttataggtagtgttgcatatgccagcagaaggaggtcctgggaccagtggaagggtgacctcaaggttgctggtatgtgattgatctcattaggtgtttaggagatgactcgtggccaacctaggaggtgtgtcccctcagcacagagtcaggactccccccagacccacaccaagatggaataaaagcagaagtcacctcttcctccttaccttgactcttgcaagatcatgtggattgaggacggaaccctgataaaattccacctgagtaaaatgtcgtttgaacagagcttcaagctccaggttgggggagatgctacacagggagagaagaaatcgctattaatttaatggactcgggggtttcagcctccatgggctccttcctctctaatttccacagggagccctggggagaggctgtgacctacagtcacccttttgcttgccataaataaaagactcacactcaagagaagtaaaaccccagcccaactgaaaaccaaaccagtaccatggtaaaagaaagaggttcatgggctttaggaaggccaagacctcaggacaaatgtcttctcttcggtatgaatggaattcctatcttataaatatggaagctgggctgcgccactagtgggatggttcattttatgcggactgtgccagagggtgcccagatccagtgtgatttctgggtgtgtctgggagagtctctggatgagaatggcatttgaatcagtgaattcagtagactaccctcctttgtgggagtgggcatcatccagtcctttgagggtctgaagagaacaataaaacagaggacagaggcgtttgtcccttttgcttctttcctgccggcttgaactgggcatctcttgtcattctcctatccttggactggggttgacattggctctatgactctctggccctcagactcaaacaccaccagctttcctgggtctccagcttgctggtggcaggcagtgggacttcccagcctctgtaatcaaatgagccaattcttcctaataaatctctctagagatagatagatagatagatgtatcaatatatagataccgatatatatctgtattagatatattgatatatatatttcctattgactctgtttcactggagagccctgactaatacaatcaaggattagccgaaggttcccctgggagaggcatcctgctgttccctccatcatgaaccttatctctgcttctgtgtctcatggacttctcatcccccaaggcctggatcaaaaagtatcactctgaggagccacagacagacttaatttactctcattattgttcttgattcacacacatgtatgcgactcatcacatttcttggtgctgatctgtactgacatctttctctttggaggacaaggattaaacaagtgacctatttattcatttgttaattctgcagagatgaaaaagactgtcgataaggtaccgtgctaggcactgggagatgatatttagttagaacctactatacgccaggtaccgtgataagtcaacacttgcctaacatttgtgaagtccataatgacaataataataatagttcatgttttgtaacatttactatatggcagataacattttaaataaataatagtaaaatagtattataaataaataagtaaaataaataatatttatttattttattttattttacttagagtttatctctgtcacacagactgcagtgcagtggcaggatctctgctcactgcaacttcccaggttcaagtgatttttgtgcctcagccttcagagtagctgggattataggcatgtgccaccatgcccggctaatttttgtgttttcagtagacacagggttttgccacattggccaggctggtcttgaactcctggcctcaagtgagccacccaccttgccctcccaaagtgctgggattacaggcatgagccaccatgcctggccatgatgagcattaattcatttaaatctcaaaacaaccctataggcaggtatgttattaacccagagcttcaagaggttaattaactgggccatctactataagtatgacattgatggatgttagggatacaaaggtgaatcctagcaatggaagcatgagcagccagtttttgttttgttttgttttgttttgttttgttttttggagacagggactggagtgcagtggtgccatcttgactcactgcaacctctgcctctcaggatcaagtcatcctcccaccacagcctccagagtagcgagggctacaggcacgtgcccctatgcctggctaatctttctatttttgtatagatggggtctcactgtgttgcccaagctggtcttgaactcctgagctcaagtgatcttcccaccttggcctcccaaagtgctgggattacaagcatgagcaaccacaccttaccagcttgtttattcaaactaaagcagtggatgagagaaaagtggctgcctctgtgaatctgaccagtctttcagacccatgacaagtcatacctcattcagaagcctgcccgggtaataccatagactgatgctccttgaaagagatgtccccagtcacttctgccacctgatcaaaatgacttcagcatcccttggataacacagggttgatgttgtctctaatggttgcatgtgtgttcatcttgaaatgcccaactcatgtgggggcacagcctacacactatacctctagagaactttccaaaacgctcagtagaggatgggccacacagcaggtaatcagtggctaagcactgaatggaacctgtgggtacctgctcctgtgctaacatagcctggtctgttttttcaaagtttggagaaatcagtgcagaaaagagaaatgttggtgccccaacatggtgacaagtcagaagtctagcattctgtgagcaaatgccagaggacgacgatccaccaaacagggagtttgtagggaagccgacctcagtggaacctcagagtaggaccgcgtgctgggtagtcaacagcacgtcaagccagcacaaacatgttagctttgtcctggactttgcgatgtggtgccaggactggccccatgacagccccatctccataaaagaagatgaccatggtaccacacatgtcaccataatggagccccctaattctctccattcctggggcagactaccttttatctaaaaagaggattagtcaaagttgaaaacctcaacattgggtagaagggagataccttgctttcctcccctgtaaaacatacaagataagacctacctcctaagtggattatacaaccaaatatatgttatttttcaggctgatagctaacacttattgaagacttactgcacgcctgactctgctctgcacacttcatatggattaattcatttcattctcatcacagcccaactaggtaggaactactatcatctccatgatttatggatgaggaagctgaggcacagggagcttaagtaacttgctcagccagtagttggttgagtcaggattcagatcagggaatctgagtccagaatatgtatttttactctgtttgtggagtaaatgggagcctgcatgcacagtgacgggctagggtcccatgctgggggttcctaggaacggcagttgttattactattaccttctgtcctgcttcctcttaagttggtgtcttgcttggtcaccaactgactccagaactcctaacgtatccacaccatacagctaatcatcccacagcagataatgtggacacgccagattgctaaggggacaatgatgatgacttggacccacaatgagctccactattatttcttccagagataaactcggatgtggtcccagaatcgcctccacagaggcagactctgctctcatcattgaaccagtgtgttgcttccctttccattggttctgcaatatcttctccaacgaggccaaaagggatcatggcttacccaactctggccccatccccagtgccattccccaagacctccactcttacagacattcagggagtccctcgcagggtgtgtggttgggcagagggtctgacagcagtaggaagctcttacttgtgaagaaaaacgatctccacattgacgtcatcccggtccttgtgcagaaagtccttcaggaagttggaaacactctccagagtgatgtgtccgcagaccacaatgtgcctgaacaggagaggccagttagatcaggccaggcaccacgacaggaccctgcatcccaccccctggcaagacagcagaagccaggcagctgcaggggaagcattcatctcctccctccgcctccataaaagcccagctcccatccccagagggcagtgaggcaaagcagcggtgctagcaggtgctgagactcctagacagaaaagccatatggcttctcacctgatgctgcacaaaatcctattaaaagcccaactgtttggccaagtggttttatgcatttaacaataagtgacattatgcttgtgcttaaatgctgcattatcaagtcccttgcagattcatatctctccctttctgcccacaaagcgtcctccggggagatttactgtatgagtcttggtttatgacatagagcttatcaggtaatgagataacaaatcttgctgaaacgatgattttgtgtgtaagaaagcagacttttatcagggtggctaatgtgcggcctgacacgttataggttctgctggccataagcagtaaaaaggaaattttgcatttttccactataactcctccgacaatgggggcatgtaacactttacagtaagtgagcattactcagggctaaatggggctgggatgcctatggaatggaagatcatgccagctggctgtgcgtccccagagggctgcttccttagggtgcccgggatttccaggagagctaaaggaatttacctcaagatggggagatgctgggaagggatgaggctggaattgctcgccttgtttgagggtggtttggacttctgtttctggaagtagtggctcacccggaagagatgagccccacaactgttgagactgacagtccctccaaccgctcggggctcctggccaatctgactttggcaccaggcaatgtcatggccacttatatgtgccacataatgcccagtcaggagtgagcatttgatgcaagagtcagccacaagacaaaaagccagggactgactgtggagataaaaccactggcttctagtgaagagactgtatgtagcaagaggctcgactcctgtccctgtgccccccaggctcatagtgacagcatctgagtctctagctgcgctctgagacttgggcaggtggtgaacatgcagcatggtaatttcctgggtaaaatttagaatggccatgtcccttgcacttcataattgctctgtgcacattccactaaggcagaaagctcattggctggaggtggctcataataggaggcagtgatgatggcttatgcaatgttccattagatgccattataagagcctgccctttcgttgtaatttggtgcttgactaagtatgtgagaataatgcagtaaactcattggtgaaaggataatgatgcagaacaaagagtaaatcaataatatgcacgatgcagttaataatatcaccattatagactgttattgttacggtggtgcacttagcaatcaggcacgcagcggccaccaaggtgagggaagagtgtcaatgagctacttcagaagagatgtcttaacatgatcactttgctctcctgctaggttgatgaaggtcccttagccacccacccaaattttatgcccaaagcccatatgactaaccccctcattagtatatggtgagtagtatgaggctaagacagtgtgacacacagtgtatcagaatacacaatatagattgaacatttggatgatatgcattttatcatatattttaaaatgtttcttgtggcacatgtacatttacatggacaaaatacttcaaataaatttgcacgttctgaataagatttcagactttgaatttgccaaatatgtttgaagtgaatgagaaacagaattcccctactgacctaacttccttgcaactgacaatagggctactttgccattctaacatcctctgcacatagacttccaagattaggagcaaagccaacatgaatccaatgcgtgggtatctccacaggacagatacgtggctgaggctgttctcatcacttagatgtgaaagtaagccagatgtgattccctgctctgcgaccaagggtgtgggcaaagtatttattcccattcagtgcaggaggaagctgagaggttaataccacccagccggcctcctgtgccaggcattgtaaagttcgaagttctataccagcataagcctggttattactcaaagctaggctcaaatcaatgataggtctggggaaatgcctgaacattcgttcttcctacccagcatgcaaagaactgaatgaacatcagccagcatctcctcctcctctctgaaatcattcatccctaggaaagatgtgtgagaagtgcaaggggaaaagatgagttcccccctctcacccttgaatcaaaagctcagctggctgatttattcagccttagaaaaagtcagggttctcttccttgaaaatgtactgggtacatataaaatatattccaatgcaatcaatattatcccttaagcctttaattaactttcacttctcttaagaagtagacaaatgctggcaagagtgaggagaaaaaaaggattgacttttttcatttggtgctagctatccaataccattctagacaattgaaaatatatatcttttagccacagcatgatttctggggtggagagctgtctttatcaaaaaaggaagaaaaaaaaccttccttcaacgtaattggtatttttgctcagaaaaaaagcgagattgattgaaagcagattgcctttttgcccaaggagagttattaggtacattatcatggcaaccttggagaacccatattgttccaatctgtcctatatctgatttgaagatttatggcctcccccttttgtgccaataatcatttccctccattttgttttccatacagtgaaagttatcaaggagcccacatattgaaaatgtttgaatgcagttagaattgatggatggggagaagctgcctctaactcagcaatcggtattaggagatctgcttccgccagcctgtgtctgaggagggccctgcaagagcatgagggatggatggtgaatggggaacatttatttaccagaaatattttcaagacttttgaagattctagggccatagtttggggaaggatattattgcaggaagaagagaactagaatttattgcatcctcaattattagagatatcaacacaaatatgttaagatagacagcagggtgtgacctcattggaggcagagtaatggttgttcacagggcatgatttgaagaatgccaaaaaagatccccatccaaagttatctctgttgggttccatgatgcctacatatctaccatgtgagattcatactctgatagccctgtgttaactcagctcagacactaaataactaaatagtcttggacaatgtaccaattttgcattttacaattaaaaagccagagcctttgaggggccagagctggtgcctgattcatgaagttatcctgatatctaaggagatgatacatggaagggccaagtaatctgctccatggtaagcactatgaaatggtaagtgccatatggtatctgtaaattaggatgtaaccaatataaagtattctgtggcctatgcaatcccacctaatccttcaacaaccctgtgttctcactgcctgagtcttttcaggtaacctctctgaaactctttccttaagtcatatatgcctggcatcccacagcaagtaaaagtgacttgcccaggatgcaatctgggtctcccacttcagttcccactaagatgaaggtggtggtggaaaggaaagaggcttgtatatctcagcttctgctccttcagggcaagcagaaatggacccacagaggtcctcctggatacatggtggagggggtgttggaggggtcctccactggccaagggagaggtttagtctgggaactggagtggataaaccatcacagttttgcaagatcactagagtctggctggataggcagtatcatgatagtcttagcaaagtctgattacaggcagaaatcataagttccaccggtcaggaactctaagccaaacttaactgaagccatatgattggagcaagctaaggggctgcaaagtgatgcaaatgtccattttattttatattatattttatttattttttagagacagggtattgctctgttgcccaggctggagtacagtggctcaatcagaggtaattgcagccttgaactcccaggctgaagcgatcctcctgtcttaacttcctgggtagctgggactataggcatgccaccacagctggctaattttcttttggtttttgtagagataggttcttgctatgttgcccaggctggtcatgaactcccaacctcaagtgatctgctcaccttggcccccaaagtgctgagattacaggcatgagccaccgcgccctaccccaaatgtctattttagacatgtcatgtacagctcaggacttcctcaccagcctggaatctagaagataataagaatcttaatgatccatttacaatggggaatatttaggaaagttcagctatgagagtagctaaatctctccccatctgtggatgtggatctgaactttcttagaccatcagcgattgtcctgaccaatttctatagggcctgaccactcaatttgtgaagatgaccaatagtcctcaatcaataaccatttctgatctgatgaagtttttggttttaaatgctaggtctggatctgtaaacaaatatttcttgggcaaaggtaacataaaatagatataagctgacaggtcatggcttagaataaaagatccacctcagaaacacaaggaagcatcttcaatgccaaaatagtatccaacggcactttctggagaggaattattcatccagtgtgagcaagtagtgcctggtgctgggtcagggctccataaatatgggctggtttaactgaaaagggcagtgcggtgggtcacggcattggaggggtaagaatgacttcatgagaagaagtttgatgattatgaacactattgagggtcaccataaattcgccagttgcttatttcatgtgcatatcttcactaaatatacatgggtgtgcttctcctgccatttaagcatcgctgcctccagaatgaaatcccacaaattcttctcaatccttctactctcttctcagtgatgggccaggaaagcctgcatgcccaagttgagccagaacttcagtttcagagctcaattccacaggtacacaggacaacctaggggaagtgacttaaggcagaaggcagaagaggacaggagggcagtgactgaggcatcaagagagccactgaagatgacttttaggtctatgacaaggaaaatctacatacttttcccaagcctcagatactggttgttagagccagtagcctttgaaaagggaaactgtgaccatggaatagtcaccattgggccccctcccacgttcttaagtttatctcagcatctgaatgaatagcccttggcaattgtttaatctagcacctttcttctctttgatgtggaaacaggttgcaagatgagtgccagatccagagcacaacacctccctcagtttcatgccttctgatgaaagaaagcagctggtgccagggaggataacctaagctgggaattgggagactggggggcgagttctcagtgacctggggccagtcactaaaatgaagaggcccaggctgactgggctgcacccaccagacactgatgaatcctcacacagggctccagttctctgtccgaccttagttcacacctccatcataccttatctagacatctgcaatcgcttcctaactgatttccctatttactgtccccactgcccccaaccattcccacactccctcaaaaaagccaaagagaagggatggcagcaaatcctactgcgatcaggttctgcgagggcggggaggccttagatctttctttagcagagcctcgctctaggaagacaatgtaaaatgcacagctctgggctgtttatttttaaagatactatatccatttttactggaacgagtataaagaacttaaaaaacccagagctatcttgtcacaataaatcagacagagtaaattgaaaatcctatacagctttgcctgaatacattgtgctcactttgtcaaagaggtagatgaaatgtggcacatattgatctagatgtctctgtaaaactataatatttatatcaaatacatatgctagactctctgtctttctgctgagccttctaattgtgttttcctcgtcctgctcctcccaaaatgcatctcaccattggtagcccctgacatgatgggaatgaattttaagaagtacttctcaagagaaccagcagcactgtatcatacaggaagcagggcgtggggggttagagacccaacgacctaaaccacacagtggtcagcaccaaagcttcacgtttgcccccctaggttgaccttgaacccttggtgtctgcatcaccacctctccatgacactcctgcaagctggcctttcctttccttctcacctggtagtgcttttcttggctacttagtcttaatgcaggtttccctgatttggggcatgtccttcagggttactgtttcccagcgcttcccttgaggctcaatcccccactgccaaaaaataagactaatccaactcccaccttcccacttcctcctttactgaatgtctcaaagagactgacttcagtaaagataggggagacatcatgggcaaatgaagcctaactccaggctgtgctgcctcatccctccaccctaccccaggacctggcttggaacccccaaaacttgctgggctttcaggaactatttgttaactgatggattggttgacaaagtatgcatcttggagactctatcccatggtaagtgcagaaaaaagttaacaggtagttcactgcaagccttttagaccataggcttattccaccaccctgaatctactagcatatttcaagtttgtaagggatctgtacacataaagaaaaataaaaacaaagcaaatgagagtgtgtatcagtcccacaaccccaaaccctgactatcaccatttcctgttaaaataatttttttaaaaaaaaggaggttcagcaataagataatttcctatccatggacacatctagtactttgctaatcacaaaggaaggaaatgcattctccctcctagtgaggaagtgaataaagtaatcttcttctccagctgtcaatggagctgttctggatgtggcaggctgtgctgctgtttccctaaatggggcagaagtctgagcaaatagatcccaacagtgcagcaaaggcacctctaaagcagagccccaaggtcagaggacagacaactggcagccccagtggggaataccgggatgtcccacctgggccaaaactttgcatcttatcgcatgcagacagtcagaacctcagctaccctagagggatctgtgtctacacctccaccatcccaaatcacagttagacctccataattagaccgtggtgagaaatgatcacacatattttgtagcttgtagcctacatggagcctcagtccaagtctttaaattctgagaaactcagtgccggggacattggtagattttgcctgtcctgcatacaccctctcttctgtggacagcacctcattttaatttggggaattgctcctccccaaattaaatacagtctcccaattatatacagtcttgggacctttagtgaaggttttctgcccaagtgaggccaatgggtactcttaaatcttggatgggctgatgctaatcacagtgggagttgattcaacctgatgacaaaaccctgtaatgactactcccgagtttccacttcctcagtgtcagagctgcatctctggttcttttctgtcctttctgggatcttgctcttcagtttttcattggaatctctaaggtaccctaacctttaaaaaaaaaaaacaaaaaacttttcttcttaagtcagcaaaaaaataagtttctgttgcctgcaaccagagaatcctaactggtagacttgtttacctttactttggtttctcacctaattctcactgttacctagtatgcaagtattaccaccatttaggtttctttctctctcctttcctttctttccttccttcctctctggaaggggaattctgcagctttcttcagtaagcaattccacagttgctgaaccctcacaaactgcactgattcctcctatgcctccctccccaacaccctcacccctctgcatcttattcatcccattactttgggcttggtggcctttggccattttaaaataagcaagtcttcccttgacctgaatctcccaatgctagatggttctctgctcttacagagaaatcagggagctgaatggcactttccttttttcagatcaaagcagatttgcccgatttcatttttaatgctgcttctgtacaagcagagactgagagaagactaaggcaggcaaaggtcagcctcactcttcagggatgaaggtggaatagagggagaatgagtccaagcaaagaaatggctctgaattttgcccaggagagggttttgatttacaaagcgagccccacctccctccctaacacccctggtgaatcatgtatcatggtccttgagcacatactgttgggactgaccctcccataatgacaaccaacttgacatatctttgccttgttctccagccacacccaacggtgttgccacagctagcataagctgctagccattcactctgtagactcaacatacttgcataggccccagcagacctccagcatctgttagtcacacagggactggaaggagctacaggttagaaggctggcggatcacctgcggtcaggagttcgagaccagcctgaccaacatagagaaaccccgtctctactaaaaatacaaaattagctgggcatggtggcgtacgcctgtaatcccagctactcgaggggctgaggcaggagaattgcttgaatctgggaggtggaggttgtggtgagccaagattgcgccattgcactccagcctgggcaacaagagcaaaactccatctcaaaaaaaaaaaaaaagaaaaggaaaaaagtaaaaagaaggcatgatacgaggcatgacaggccacagcaggacctttgtggggtctggaaaggagtggacctcaggatcacatcagcggattcccaaccctcccaaatctttctgcacccctcttttactgggtctgtaagcttttaggtgaacaaggcaatctgctattacctatgctctccactgttcaatgggtatgttcaacaacgtgaattatcaaatgcttttgggaggcttccctctaatgtctcttgctttcatgattattgtacacttccatgatttcaatgaataaaattcctgaaaaaagagcatttcactgggaagacgctcctgcatactcaagcttctgtttcactgccactgtttccttgggtggtactgattggtcagaatctcagataagctccaggagagcaagaaccacattttacccacagcacatggtggggattcaaattattgtttgttgagccaatatgttagaatgggagttttcctaaggctgttctatacactagctgacatttgcctttggagtcaatggctaaggtcatataagctcccactgagatgggcacatatctatctctgaactgcccccatgtcctcttgttagaaaggtacaaggaggggagatagattacttttccagcaactggtacccatatttggaacagtccctgtggttctgggggtgacagcaggccattgtgatgcaacaccagtactggctgtggagactggaacccttgggacaagagaatcagatttccacaactctcacaatgtattgacctctataatgttttaataaaaagagacactggacttggccagttagaaagtttcctggtttagtttcatagtatgatgacagcagcatggaaggaaccccaaagctaccaggaaccattttgcacagctctggaaagaagtccagcagagtgaatgacatggtacgaagacagaaaacagggggcaacctagtctggatggctgcaattgttcctgagattctgaatctacccggcaaggattcacccaatcaaaggagccattgatcagaatcttcagcaattataatttgagaaatcatattcgaattattttttaatggaagaaagaatatttgagagtgaaaatctaggcttgaatacgactttttttttaaggtacacagttcatctcccacctacatttctattcttgttttcagaacaatagctggaacattttgctaagtgtgtggaagggaagagtgacagcaggaaaggaggggagcttcattctatcagtattatcaggaaattgatttaatatgcttccaagtctctttaaatagagcttcaagtttgaaagggactgaagatatggcttagaggaatccaaaacagatgccaagaaagaagtgcccatgtcccacgcccaccaagacccctctcatcaggaagggatacctagcacatcacatcagaagacatggcatctaatgacaagcgctttgggtatctacccctcagcaccacgtttcagaagtagtcaagaggtcatttttccaaagtattagggcaagctcattttttgttttccctgttcccaagaagtttaatgctaatcaaagcagaatgcctaatcagtccaagatgttctgtcaacttgaattatctatttgtcttcttatttactgtatctgtctgtctacagttcttcatatctttataaagatcggttattggggcctgtgtttccttctgactagaatcgctaccagatgatccttcctggtgatatgttgatgatttgctaatttatggcttttaaaatctaggaatccaaagacattgctgaggggttcaggctggggaagtcacgtggctcatgcaatgagggctgaatggctacttgatgagggatctaagtctgtgtaggatgcaaagcttcagtcacatttcgaccagagccatgtctgcaatagagaaatcgtaaatgacattttataggaaacacccctcatgagagcagtccgccccttgcaggcgaggaaaagtgagaatagctgttgcccaagacacaagtaaacatggaaagaaaaggcctgtggatcggcccaagtcagtataacatgaaatcatctcaaatccgattcccaagtgctagaggccatgccttcccagaaagagtcgagagggaaatggtgttgtagcaagactctctcagaaccaagagaagaggtttcaataagccctgatattggacttcccaaccacttaggtggccaaatagtacgatgtgtagctcagaaaagctgtggtatagttggagatttttatggatgtgtagaaatgcatctgtccccagtgcctggtagcaagccctcagtaaacacatgtggaatggatggacatgaaggcatgactcgtgttaattcctttaaggtagggtaggctatggggccatagattaaatgagtctttgtaaataaatgatccatgctctggcacactagacaatttaaaattccaaatcctttagaaatcagtctagaaccctggtggacaagacatgagtgtggtggaggaaatggagtggaattccacgttgatacaagacagccaggcaggagggaatagtgtgcgctctcaggaaggaacaaaggttctgagtgagaaggagagtccaaattctgatataaggaaagacacagagtttaaaaataacccaataatcaggaagcagggaagatacgcaggatgccatctcccgataagtcaagcaagcactgctcaggcaggttggggtctgagcgagcaatcagtttttaagacttcctctagtggaggtagaactgaagacctatgtttgcaagtggggcttgcataacctggattttaaaagcaagagtgttagctcccccagcttagtgggtaatgcaagctgggtcaaggtcattgaacaagcgttagttagcatctcctcctctgaggtgtcgcttccttggactactttatccagtgtaactaatccctgtttttctcagttgcagaatcttagtcttttctggttttgcagcacacattaaaaatgtgtaattggcatttgctttagttgtacccttgctcagtgcttgcaacctccttgagactgtaaactccaggaggacaggttccgagggtagtttgttcgccaatgaaccctgagcacccaacaaaacccagcatcatgcctgatgcataacacagagaatgcctgcctgccgagtgagtgaatgaaccgatggagaggggccacaggaatggacagtgaggcaggtcactaactgtgctgggctgtttttagttcttgaattttgttctcaactattgaatactcaattatttcttctaaagtatggaatcctctttaaaatatgagcatttacaataaagaagataattaagtactctagtttcatatttaaatagaaaagcatgacaaactgtccccatctctctgaatgtaaggctctttccaatgtggagaccacatccgaggttgaaggcagacagccctaactccctccagcgggatacaggctcctgagggtgaatattccaagtcaaagctatgaaacaaacacacagaatgcaccctgcagaactggtcacgtggggctctactgtgcctttcactgataaggaagaaaccacctccagatactgctctgtgctgtgcggcagactaactaaggagtgaaagggaacaggtggttccatctgcaagggtatagaaggctctgcaggtgagatctgcccagcagggaagtccaagtttagcagatcactacaattctccatggaactacctttaaaggatggagccaggaaggggaagaaaatgttgaaatccacaaaaaaggcacaattctcactttaggtgtggttcatctgtctgtccttgagagcctttcattgctagaagtgttcaagagggaattagaattctagtctaaccaaatgggaaaaataaaggaaggaatggttttgtcccctctccatctttttcccctcaatcctggggccaggacccttaggggtagtgggtgggcaggaggggagaggagacagccccaaagtgaagctcatgcctttctcttcctctccatcatgagcacggtactctggctccccttatacggaaaggtggaggaagatacaaacaataggagatcactgagtttagagcagaatggagtctcaagagatgacatggagaggcagcaggacgcagggaagcaggctgtccaggttcaaaccccagcccaactctttactagctgcgtgatgtcaggcaagttacttaacctccctgttcctcagtttcttcactcattccaaatggagatgatggtaatacctttctcacaggatcaatgtgaggattctgaaatatgcaaatatttgtaggtattactattgccagagaaggcagtcctggggctttaggctgcactgattcacattctcatttcaggaagtgtgtggcactcctgtctctataggcaaatgttccaagagaagccacagcatttaagtttcacaggcagctttcttgaattggagcaagagacgggttagtccatgacaactattccccaaaccagaatggcggctcagcagcttcatcctgaggaccttccttcaagttaattacactcactttcctctcccaccttggctacatctagtctttcatgactcattcccctctcgtgtgccctgtcagcatttggctaccaggaatcagtagaataatccaaacccatcccattctctctgtcccaaacacctgggcctaggattgcctcaaacttgagtcactcaagtcccaacatgggaaacacaaggtctgggtggctcccggctggactccctctaacaagggggttacagcagatggattcctctctgtgactgattattttccatggcccttggccatgtgaccttggaccacgatcttgtcagttctcataaactaaccaggagtggaatgaatcacactcagggaggagacctctgggggaaactgcaaggggctgtgagagggaggagagagctggggatcccaaaggccatgggagcgtcaccagccctcaggccttccctgtctctaagcagctttgaccttacacaaaggaaaggaggaggaggcagtggccttgggaggcaggctgggctgcaggagggctcccttatgaataagatttagggtatcagcccaagagcccagagagctctaatccctccaactcagagagattacctgcctcagctactcactgaacccttggttgtggacacccaaacccctattcttagatgctccaatccatcataacatacatgaaatagccaacacacacgcacatgtgcacaattacccatacctactgcagggactgggtatccttcaggaggtgatgaaaatgttgggtaaggcactctaggcccttgaaatagtgttgatggtgaagaggctttgagaatgctacttgaaatgtttatattatgccaaacacattgattaaaactgaaaatgaaatgccaatgaaatcttcatattctcaaatatcctgaatttgggtgttgtacaaacaaaaccctgatcttctctgcctaaattttgtactttaaataatctttgaatttcaaagttttatgtctctgtagctttagatcatgagttaccttgagttctctgacaagttaatatattgttagagaaatcatttctgaataaaatatgcacaagtaaacaaatcccttaactatgtatacattctaatttctttctgggcatttatttgattgggtcctggggagcagagaacatgtatgtgtgtgtccatgggcagagcacatggacttatgcatacacaaaaactcagagcacagcacactgttttaagagtctgaactttatctttcaacaaagtttagctgctttccttttgcaaatgcatttaattttatctggaaactttttgacgttagaaatagaacaactgtagtttctcattatgtttgctgccagaatccatgcttggttgctcaactaaagaccttatattgctaattactaccacatgcccatatcccaagcgaaagaaaacttattgattctgacagcccattctctcaacactgaattccaaatgaaaactcaaaatttggccaaacataacatttcatcaatcttgttttactgactggaaaaacaacatcaaacaaagggtgctaatggccctttattaccgtgcctttcccaagcttatattttctgatgaaagatctaagtgaccaaaggccttctttaaactacttagtaattagcttttgaaccaggaaacaatgcataaagtagtgaacaggcccggtgctgatgacaggacggactctgtgtctgcagggtcaggaacagtggggacccaaaaagaacattaaaagcaaagtgcattttcataaacggagaagaaaaaaaagagaaagagagagagagagagaaaaccaggctaaaagcggtgataaaagattacagagccagaacagagtggcaggaagtctgtgatctgaagtcatcagcacctgaaagtttgagtggaactgccagggtgaaagatgaccggatcggactgggggcagtgagtgagtgccgggctgagagccccatctgggtcagctggcaccgaaagctgccggcctccagcccacccaccagctcacccacatttgactaggaaaattatttcattaaaaaaaaaaaatcacctggaatgaaagtcaagaaatattttcaacttagccttcagggcaattgattttattgacttcttggggcagtgattgggaaatgctggcggagacgtcagaagatagggaggccataaagagagccccaggccctcagaatgccttctgctttatggagacctgtccacaccttcaaggcaaaatgaattgagatgctgttttcctcttggcatgggatacatgaccactgggaatctttggacttacttggccttttggatccaaccaatggcccagaaatcagaacagcttggttctaacctcatccagggctgttaagataatattgaggggagggctccattagagggaagatggagggatgtgctgcctcccggaaaagacgccaactggcctcctctggcccactgtcctttgtgcctttgaaaggaaacgggtgtcctgtgggtagttcaagaaaatgagcccttttgtccacctcctcatttcctgtgcagaggcctggacacctgagctcaggaagcactggactcactgaccaaaggggagggtccactctgtcccacacggctgactgtcaaaaagagaaggcagcagtggagggaaatacaatgctcccagtctgattttatttcctcttaaaaaaacaaaagaagctctttaagagttcatttgaaacagaacgagaagggaaaacaaaacaaaacaaaacagttccatgataggaacgtccatgactgggaagaggcatgagtgatgaaagttttctgtgtcctgatccggatggtaggatgatagtgactgggtgtgtacataggtacaagttcctcactttatatgttaaagatgtgtacatttaactctatgtaagttatacctcaaaaccaaaaacaaacaaaggtgactactccagaaaaagctttaaaaaaataaataaaggatggctgctgccagccccctctcccccatggcattctcctcttgaggttgtaaggtactgccctctacttaggaaaaaaccttggggtctctattgaacctgcacattgatatcgagagtgataaagtgatctgagcacacactaaaatagttcccgagaagaaagcattcacatttgggaagccaaacaaaagatttggcaggaatagcatgtagtaccctaaactaccagaaatatactatttcttgcccggaaggaatttcagctgagtaatgagtccctttgaggataagatcggtgcctcctggatgaagaggagaactgggttcccagtggccgcagtgcctttgcagtaggccagatgacctggatctgccacccaaggacttctctgccagagtcttatcctgtgttcttgctacacacaaaccaccataggagggcatcatactagtttgagggaccagaattttatcacatagccagatgatggaagaatgaacgagttttgtttacttgttaggggtcagaagagaaaatatgggcccagttataaatggactcctttcaggataaattcattacatctcttggaatttgtgaatgggagttggtccaagcgtggcaacgtcctcgggtcacctctgacatcacaccccatgcagaaactgggccttccctcacagaagcacccggtggggttggggaggggcagaattcagatggcacctccacagggactcctgaaagtcactcaaccacatcttttctgatgcaactgacttactttctgcctccatgtttgttaaaagtcccgccgaatttattccgactcaggatgagagcagcaatttcgggcacgtagcgggcaaacattgcctacatgcatgaaacaaagaaacaagagccaaaaaaaaaaaaaaatggcatgcagagaggattctaccgcagcagaggcagcaaaacctcttggcatacttactttcttccactaaccgcactataggagcccccgtatttcttgcggtttcctattaactctatgatttcagggacgtagctggcaaacatggcctgagaagataggagacagaagagagactaaaaagacaggccaaagaaaaggggggacctgttcagagggtgggggcactaagatctgaaaacacaaaaggattaggcctgcaaaggtatatattgatatgttggatcataaaaaactaaaagcacgaagagagcaagctcccagaaatacacaagacaaacaaacattggccaccttgacaactaaagaacaaaaaaaaatcacagtcgagaaaaatacaaaggcgacaggaataaataaggtgatatctagttcttcttgctgaagaaaaataggcaagagggggacatgctagtgaaactaaacacacacagacacatgtgtgcatgcacagacacacacagtttcgcaagagaagatcttcctttgtcattaaaattcagaggagaatcaatgcttttatgagtgacaaaagaaaataaacaccaaaagattaaaaactacatttttctattaaaaaaaaaaaaacactgaaaagctcaaaagggaaatttaggaaatcacctgggaggagaagatagcaaggagaaacacaaatctgccatgttttgtccaacaaacatctggcctgtggctggctggatgggtctttttatctataggcacctcacggatgctgtagaaatgcttgcgtgaatgtacacatgcatgtgcacatttatatacatttttaaaatgtataggccctatgcatacaaaacagagagaggtgtatgcatcactacatataaatgtgcgcacggtgtacatacatgaaagctgtgtatggattaggattttaatcactcgcttcataaatggcaaaaaaaaatctaaacttaaaatgagctactttgaaagacaaaatgcagcaactgccaacgtgtggccagaaatcccctcgatttacattagaaggggtggtttagtgcaacataaagagctgcgtagacttttaaaaagcaaacagtgaaactttcttagaagaaaggagcaaaaataccccatgtgtccgctgcagaatggagtgagctgtttgcaaaactgcactctgctcacatggggatgtccgcctggacaagactaaggtgctctctctcctttgatgtagggacccttctctttagggcaggccccagccacagtgtttgttggaagttaggggaggaacataaaggggaagggagagctcttgaaaccgcaaactgtctctacaaagtatcgacagcttctaccagaggcaggtgacagccactgtccttgtagcataccagatgctgagttacattgctaaggggtagacactctcccttattaacagcatcacttttcttaagacaattaggtttgctcctggctaaatggctgtccccgacaagggcaatgtgcctggatctatgggacaagtgtaatacaccaagaattatgcagaaaagtcaccatcgtgtttggatttacttagcctgattgtaacgttaaggcttgcttctagtgcagaatacagtctaaaatacaaagctttaaggaaatgtatcatggaaaatattaacagccatcaaaatcaacatcataataaagatttttttttaccagtcccccgaggatgaagaagaccatgaagaggcgcccaagtgtggtttttgcataaacatccccataaccaacggtggacattgtgaccatgagtaaatagacacattcccagtaggtgagagcctggttgttttggaaattttcccatgggtcccctgaattctccacctaaagcaaatgggacaggggagaaaaaagaaaaacatgctattgaagtgtatacatgcaataaacgcggaagctcggcactctcgaaggccacttgctactgcacaccactctccacacgagatgtgtggttcccgggctgagttctgtgagtcaggatgcagagctcctgagcaggacacagagaaagtggagaagcagctgcaggagatgtcttcctggctgattgagacagagagggaaagcaagaagggaaatatctctaggccttttctcttcttctggtaaaatgtgggaagccagctaaaattcagggcattgcctctggccaggttttagagcactctcttcaaggaaagagccagagattccgtccctgaccttcctcaatgggtttctaaggcccagatggcctggatctgcctctcccacagaaattctaaacacttccgtagggggctgcctccttccatcagtttatccaaagagtatatatgggccctgcttatttctgattcaaacagcatctctggaatctggccctgctctccctcctttgcaaattggcaatggtggtcccagccttgaggctgctggaatcttcacaggggcatggaaagtgagctcatgagaacagcttgcactggcacagcccgttagatcaagggctggcaaactttttcagttttgtgggcgacacaggtcctgttcaactctgcagaggcaaaacttcaacaaatgggtgtggctggatttggagagctttggcccgagactgcagtttccccactttcctgtccttccatcatatttgatctgccaacaaggctagtaggtgggcaggaaaggtactttagatactctcaggagagagggagctgcgggcccaattttactcaaatatgcctgtgatccacccacagggcctgtagacggtggcccccaggcctccacctctgcctctgcaaaatgtttccagggcctggcctctttcacacatcagtttgtcctcaatgtgccattttcacaaaagtttcctggtgaacctgaagggacttcactaatacccgtagtaaggtggggtcatcatcttattaaagacaactatctcctccacatatgtgatttgggtgcttcgtgcttggttacagcaagaattagggtgattaaggttgattttggccatgaatcccatcagcattaagggctgggcaggagactctagatctggtgactacgtgaggccccatgccccaaccactgccatcccaggcctgtcttcctttgggtgataattacctaaatcccaagtgtgggtagctaagcgcgtccttctatcccttatgcaaatagaggctcagccactggtggtcaactttatccaaagtctcagagctagacgaggctccttccagttgtaacagtctatgtttgcatgaaacacacttcccacaatggctgtgctctctaaaagcagggggaaagtctgccttcgggtggtgtgaggggcttgacttaatacaaggctttcaaagagtcactaatgaaaaagaatgaacatttttgaggtacaaatcagacaaaataatcaaaggtggcttttcgtaaggcggaagtggaaagaaattgagggatctgaatttgttgtttactaggaggtgtgggtccaacttccaaccttgtccccagaccttttccaggtgtttgcttaggaagcactgccatcttgtggcttactatagttattgcagacagaaggaaaatctaccaaagcccccatgacaataccaatgagcaatgaactgaaaaatgcaggttaatagtgcaaacattactcaccatttggaactagtttggggtaaaaaggttggaaacccagacaattgtgtggttgcttcccatcttcctgtctacaaccgaggtgaagttaatttccagcaagataaattttaggtaataaaatgactcagagagggtcttgttgcaggcaagcgagagcagaagggtcttcaaggttactcaccaaatggatgaacccggctgcagtcagccacgtgctgataaatatggagagcagattcaccagcttgatggaattactgtgcaagagacaacaagcaaaatccccacgttaccaagggaaggccctgctggggctgccttacagggtaacagcacccgcttagcaggagaggctgccacatctaactcccaaccatttctccattataagggaattctggaaggtggaggaagctgctgggatgaaggtcaggacagagcctagaggaacaaatttaactttggtaaaaattaacttttatttaaaaaactcttcaaatctacagaaaagtggaaagaacagtataatgaacacttgtacgctcttcatttagactgaccaattattaacattttaccacgggtgctttatctccctacatgctttttctcttatcccccccgcccttttttcttctcttcttcttgccatgtacatatatatatatatatatttgctaaaccatttaccaataaatcagagacatcatggcacaagccctaaatactttagcacccaactcctaagaagaagggcattgcacagcataatcacaataccattgcacgcctcagaaaattaaaacataaaaattcagtaatgctatttaatatgcagaccttatttaaatatctccagttgccccaaaattatgtttattgatttttttttattttccccccagacccaagtttcatgcactgcatttggctgttaggtggcttaaatccaactgtcaggaaacaaggacagagagtaaatattttaggctttacaggccatatagacattgtcacaaatactcaactctgtcactgtggcttcagagcagcttttggacatcatgtacaggaatagatatggctttgttccaataaaactttatttacaaaaacaggcagccggcatgggctatagtttgccaatcccagcttcagtcccttctaatgtataattgacaccactcctttgtaatgacattaaattttgtgtgaacctaggttgtcttctataatgttctatattctggatcctgtttatttacttatttatttttattttattttttattttttgagacgaggtctgactctgtcacccaggctggagtgcagtggcacggtcttggctcactgcaacctctgcctgccaggttcaagcaattctcctgccttagcctcccgagtagctgggattacaggcacccgccaccacgcccagctaatttttgtatttttagtagagatggagtttcaccatgttggccaggctgatctcgaactcttgacctcaggtgatctgcccgccttggcctcccaaagtgctaggattacaggtgtgatccaccgcgcccagcccagtttattttttaaataaatgttattgtgtatgtttgaggtttacaacatgatattacctaccatctcacatagttacgtttttgtgtgtgacaagagcagctaaaatctacatatttaacaaaaatcccaaataccatacaattttattagcaatagtcctcatgttgtacattagacctctagacttgatcatcctacatagctccctacttaagtatttctgttaagaatctcttcggggatggcatcacatcaggatatcccagcccaatgactagctccatccatgtggctaaggcagaaatgctaatgtctccactgagaggtgcccatttccctttgtaatgaatatgccaccttgagtgaggccccgagactgcaggaatatcctgctccccaaaaaccttatacctaatagctttagcattcactggtgttccttgagtggatcaactggaccttatgacattttgaggtccctaagagctgaggccttgtctgtctggattccaggagccctgggtccctggagcatagcagacccgtgactctgcactgagtgcactggtatctgcccctgctctctttctaaactgcatcctgttcagtcccactggggtatacctgaacgctgctgtcagcaggtcacttcactgtccaaaggcttcttgttgactaaaagatgacattcaaactctctccttccattgtcaacaccttgtgaagtcccagtctctcccaccacccctctttcacataaactcttgaaactgccatgccagctaaacctatttactatagctattgtttacactatttactcaacttgaaagcccttcccatctagtcaaatttccccattcttcaaagcccagttcaatccctactgcttccttaaagtcgttccatccatctgcaagacaaagtgactttccccggctctcaactccagccattcattggtaattgatcctactgacttaagatgtcttttgtaaagttttaggttgctatttgactcttgtgttccttgctgcatcttgcagaaaagaactctcttttctagctcttgcattttcccagtagtggcttaatgcagcctacagggttgcccaacccattagttttggtcagttcatctctgttatgactgccctctcttacctctcttttggagaaccaatgatttaaattctaggcatttaagatcacagtaatagtttcagctagcttgtttacagttctttcccagtgctcaccacatgtgccaccatcctaagtgctttaggatcacctgtgctttatgtatactaagtcatttaatgctcataacaacaatctttcttcttctatggaagagcacagaggaatccatagtcttagtttttccagagttgattctgacagttcatggaaagaataaacagattcaactttgtgggtgagactgatatttcaaaatgtgtggaacaactttcttctggctcgaaaacttggaaaaacagccaaaatgtccattctgtctctcttggtcatttctagagttaccagattataataattgccaatatttattgagcccttattatgtgttagatgttgtgttaagcagaattctctcctgcctgtaccttgtaagtcctctaaggtgtgctcccacattggagggtaagaaatagatgaagaactgatagccggcgacaaagggaggcctcttagggaggtgtgtgttgttcattttctcagggtatcgttaaataccaagtggcttcacttacatactcctggattcttgggacctgaacacagcagtgtcccaccaacaaccatgtagagtcctcttgagatattaaacctatttagagtctgagtctccttggtgctttggaaaaatgacctaaatatggtgattactaaactctaaatgatggttacagtgatattagtagtgcgttagggagctcttgccatatgcagaacatttaatcattgttgctaaaacagtccatgtttagctctgaaatctgattatttttatgacatcagtattatcacagatccctaggtttaggaatttgctttctaaatgaaactgtatgaccacacatctgaaagctacaagcaaaagatgcaaggttaacccctggtgggcattctccacagtctgaaatgtgaaccttgccaggttaagtagggctccttgggaagaaagagtgaggcacgccaggagcagggctgtgtgctctgcatagcaaaggttatatatctctgtgtggagatagtcatagccttcctggtcaagcccagggatctgggccaaacacgaagctaccagcggttagaatgatttgaaccattcagattctagcctgcttcctaagctttgagggagattatgatcttatcatcaacacctgatccaactaaagtcaatcattctcatgttgcctatacaattcctgagtctccatcccatgagttctaattcacatcgatggacacagtgaatcatgataggtcaggcacaggattcttgtagattagagacctcttccaagaaactgtggatgctgcaagagaaggtctggctccagagattacagctgtaaacccagagcttctggggcctcctttgtcctctatatgtttaacaagacatgtttcagttaacacagaaaatgccatgcactttgtacaaagaagtgtacgtttgtccctgttctgcttgtctctaatttttctctttgtttctggtactgccaggtgctgctggccttgtttgttttactgctctctttgctggacagatgtaaaatacccaccccctaaaaagttaactggactgcaccacactaacataaatggtctgaatgacaacatgagtggaacaaagtgaaattctgccaattcaatcccttaattatctctagatcccttcttctttctctgccccaatttgcactgcctaaggccatgccctaatacctcttccctggactactgcctcctaattggtcttatggtctatgaggtctttgatgcttcaaccccattctctatacaactgttggaatagtggatctttctaaaatgtcagtctaaccacatttcctctcctgattaaaatccttcaacagctctcatttgttctcagtaaagtccatgaatctaagaacctgcatgatttggcctctccctgcacatctcttgcagtctccatatagaatactcttctttacaaactttatcttggagccatttctaagttcatgtcagtagtaatgttttagtttcaaaaacgcctcccaaaaccatattggttaggtacacgatgactcatgcatatcatggaatgctatgtgagaaacaaaaggtgacatagtagatgtaatcattatctcaaagtagtgtgatgtggaggcaattttactttatcctatgtgattttgtgtgttgttgcaatgtttaccatgaacatattttcaaaattagaggaaacaggctgggcacagtggctcacacctgtaatcccagcactttgggaggccaaagtgggcagatcacctgaggtcaaaagttcgagaccagcgtggccaacacggtgaaaccctgtctctactaaaaatacaaaaagtagccaggtgtggtggcaggcacctgtaatcccagctactcgggaggctgaggcaggagaatggcttgaaccctggagacggaggttgcagtgagctgagatcacgcccagcctggacaacagagcaagagtctatctcaaaaaaaaaaaaaaaaaaaaaaaaaagaaaagaaaagaaaagaaaaattagaggaaacaataaggaaattcccattttggaaaaaattgctgagtgatccatgttttagtcatcaatatttaccacagtcaatgagatgtggaattacagcctttaaacacagctgctgactttcctctgacagtagaataagtgttctagcacctgtgtgttagatctccagtttgcagggcaactgagaaactgccaaaacctcagatagtgagagggagtctccttgtctcccctttaattggccgtttcaggctatggagtattctaggccccctatgggcttgcagtttgggaaagggccctgatgctggtcacataattgtgatttgcccatttcatcccatgcactttaattttccttctgctgcattcttaattctttatcaatctttctgcccaccttatgcttctctgccttatttctttcagctcttggcccagtgaggcagccaaagtactggaaatgaaacagcaactccaaatcattatttcaaattgcattgcaaagcctccatccctgcctaatgccacagattggcaggaattcaccgccaaagagagccagacaaaatctccctaaagacgattacatgggtcccccaacccacccttctggaaggaccgctatgaaagcagcagagtatggaagagtcacaggagaatcgctcaaaagtccaaaaccctacaaaagccaaggctgcactttctctgggacagaactttgggatccacacttggggatgcccaaaaggaaggagccaagattagccaggctggcacctggagagagaatggcctcagagagttgtcctaaagcttctagatttcttacaattacatgacgtttgcttctgtgcctggtgacctggcctttcctaccctcttaacctcatcctcctctttccatcacagaacgcttaatgtccaggagtgcagaattacccaaagtttccccaagtgttatgctctcacaccagtgtgctgttagcatcttccttgattagaagtcaacccccaccctacccctcacatgcccagccccatgaggatgacacttttttctacaaggcttacctaaaagtaaccttctcctcgaaaagatccttgactgccctgcaactcaggctaagcccagcttagttactcccctctcaacccctgggcatgctgacatcagcattaaccacaccgtcaggtggcctggccccctacgcagcaagttctctgacagcaggactcctagcatgcaccttgctgctgataccaatgggtgctcactccaggcttgctgaattatctcaaccatctggttatgaccataagtgaaaggaactctgaaaacccaggttgtgggtttgtggcaaaaagcaccctctaacaacaagagtttcatatagtgggaagtggggtgctggaaaaaggctgttttggggcccggatggcagatgcccagacagccttccaccccgtgactcttccctagggccattctctccctcgtcccctggctggctgcttcagcttccccgctctgcactgagagaggcagcactgagtgcagttggcaggtgagctgacaccagggatcccacagccacttcccgcatccaaaggaaagagaggtgagtgtcctagcagaaagtcagaaaaagatattcagatggtccatcattttctcaagttctaaaacggtccagggagtagacagtattcctcagagcaatggaaccttctcaaaatgctggcatcagagaataaaaatccccctaacatatgatgtaattgtgaaacagggagagacagacactacccaatgttagagagtgtcacaaaacaccatccctaccaaaaaagtaagtgtctcttaaggacaaggctctatgcttggtgctgggtactcacgcgttccatctttaaaacacagtctagtggagtgaatctgacatacgtaaatattggcgagatgctagcttcattgatcgtttacatttcaaaagtaatatgattctagcacatagaagaataattaaaaggcagaaatcaaggttattggcaatcagaaaaacatgaagaaatacaatattcactgtatgtgaataatattacattattgctaataaacagaggactgataaattcttatctcaggataatgaacagtaaaaggcaggaggacatacttttaaagacttcagtgccattggattctctttttcttttcaacttgactaatagaaagtgaatttgacctcacagtcacatagatgagcagtcagagagaggaaaccaatttggaattaaagcaaaataaaataaacaagcaaaaaaaacactaacacccaaggagtaaagccaatcataggttgaatttgttggctgtgtcaggttcattcaggaagctaggtcccagcctgtgttaccaggaaaatgatgctgaatctaatcctcaaaactacagatatattaattacaaatcacaaaatatggaggtgtcctgtttttaatcatttatcaaatgcatgaagggcaaccaaagaggaaatggaacattagaagttagcttcttagagtgtaatttcctagaagagaaatttatggcctgtacttattctccattagagcacgtctaacctcttttattagtttattcatcaagacagccttggtttcaggccagctctgcaagccggcaggtcatcaggaaagggatcctctgggggcttttcctcctggtccagttgtgttttccagatcataacgcagttaacagaagtattcatggtgcattcggcaggaggtttgtaggttttcccccaaaaggcaattcacagagaaagccccaagggctatacggatataaagtgaacatctaaaatgtgctttgaaatgaaatgattttctgtttgccgtatgaggtttgtgattgcctctcacagcattgcttctattgcctttacgactgggttcaatttcttatttagtgatgtaataaaggggcgatttagaatctggcagcaaggacttcccaatcaatgagcaaatctatccctcattcactgtgcacctttccccttgacaccgtggctcttatctgggcaaccccactgggcacacagatatcagctatgtgtccctaaaagtgtccctacttccctgcatgcacagctatttctctcttttcaccacatagttccctggccctgcagaagagagcaactcaaaccctactctggttttctctccctctctgtgttagatcactctttctgtgaataatataactattaataatgtcattgtgatgaaagcaagcacacctgatatttgcaacttggcataggggactggaatgaaaaaaatatgacgaagaacatcttaccttgttttaagaatattcagaaactgcaaaatttctgaaaactgtatcagtctcagagctcttaaaaatctcaaacctggaaaaaagaatgaaatagagatgcattattttcaatgtgtgattttaatgttcacagtctgccatttgatttacagttcccaagggtcgaagggatgggaagttcttgcagaagataaaccagctggtacctcagacatattccttcattctgattcttgactggtttaatctcgactgggaaatggactttctctttataaaggtggcctgtttggaacctctttagaggaagggctcatggggagaagccaggttaatgagacttttcatttggtgatctctgattgaaagcactgtttctaagttacctagttatctggcaggattttgtctctgaaaaatcctaggaattgtgatagctcagggtaacccttgtgctaagagcagattgagaataaatcggataaccttatgtctttgatggattttattttttatctttatcttcagccctgataaaatgaagagtacagcccacagtgttatctgttttctacaaacttctatattttcctcccaataaaaaaaaaaaaaagatcagtgagatatcacaccccacaacttcaggattcaaaatttatatagttccccttttattaagtgttaagataaatggtttgtcctttctaaatcaacaacctctcttgaatgaaaaagaagcatcagtgtttaggtggcagaagagagatggagaaggaaaacacatcaaggacattttaaaaatgcaaattattatgttttaatagctaagagtgaattatatttctgttcaggtgaaattcatggtcaaaacattcagtcagtcctgggctataataatttggctatcatgcaagggaattacttacaaaatgctggtttgtcaccgctttgagacacattgaatgtcacacccactcccaaggggattttcttttgcagactttctagaagcattttattaagcaccgccacgtgccaaaggcagtgcgaagccctccagtgcactgagttgacagacaactccacgcccgtgggtggggctttgttctcccacgcccgtgagccagtaaagggcagcctagggcacagtggtgggaaggaatccttactaccttctacttgaatgaggagtacactaactgcacgcaacgtggagctgtttaggtaataagggaaaattaacttaaagttcatggggtgggggaaaatctgtacaaggaaagagggagaaaaggattggctcaaaaaaataatttctcatctgaaaaggattaaccatcatgaacagaagactttttttgaaaacattctccttctatgctaaataatacttatataacttttattaaataattgcagagatgagacgggatgttgatgaaataaaaaggctcacggccaaaagcacagttgtaactgagctgatgaaaggctgacttagcaccgctgaaaaccgaccacggcgcagagtacaaaactaagaagtcacctcagaaagcagagaaaatatgagaaagggagaaaaaaaaaagatgaaacttcagaaaatagaaacacagtagaaatcacagagatccaacccatggataaaatgtgttggccaaagggaagtcaaaacatcacattgatcataagcaaaggccaggacataacagaaaagaacttttgagatatgaaaaaatgactggagactaaaaggtaaaatgaaggatcagttcttagagaccaatgccaagaagcatctggcttttcattttcacatttcaagtattaaaatcaagcaataaaaataaaccaccagtgttgatggggttatttaccgttaatgtaactaagatcattatatttaacaaaaagtgttggccgggcacggtggctcatgcctgtaatcccagcactttgggaggccgaggcgggaggatcacgaggtcaggagatcgagaccatcctggctaacacagtgaaaccccgtctctactaaaaaacacaaaaaaattagccgggcgtggtggcgggcgcctgtagtcccagctacgcgggaggctgaggcaggagaatggcgtgtacccgggaggcggagcttgcagtaagccgagatcgcgccactgcactccagcctgggcgacagagcgagactccgtctcaaaaaaaaaaaaaaaaaaaaaaaaaaaaaaaaaaaagtgttaaacagcaattgggcaattttcagaatttttagacaaacagaatttgacccaagatttttatacccagtcaagtggttgttcaagaataaaagtaacaaaaaaaatttcaaattctaaggtctcaaaaaatacattgtttgctcagtgtgtgcataaagtttccaaagaggttcacaagacttgctaaatcagaatgggagggggcaagggctggaaattaaatttataacagactctactgctggtcctaaccttccagcccaacctagactgttatctcataccagtatcactgtcgcatattgctgagctaaaacgacaaatgtagaaacgtggagtagaaggcgactggcagttagcactgaaactatgaaagataacaacactcttccatgttccttgagggatacattccaagacctcccagtggatgcctgaaacctcagatagtgccaaatcctatatgcattatatacacacacctacggtaaaatttaacttataaattagcacaggaagggattaacaatggcaataataaaatagaacaattatgacaatatgtaccagcatcactatacttgcgctttggggccgttattaagtaaaataagggttagttgaacacaggtaacatgggttacagcaagacatcggtctgcccactgaagtgccctgagagactaatggccagggagtgcagatggcacggatgtgctggacaaagggaggattcttgtcccagatggaaccaagcaggacagcatgcaacttaaacattatgaattgtttatttctagaatttcctatttaatattttcagactacggttgcctggggataactgaaacctcaggaagcaaaaccatagataagaggcactcctgtagaaatacatgctagcaatgtattagccatttagtgtttaatcctgaacattctgtgtgtgcatagatatgcttttatttatggaactaaaaatagaatacaaacaacctgaacttcaaactggatttcttctttttatctttaaacgatggtgtttgtatcgtatatccattgctgattggcagcttgccacatttgagtgagttacacaaatatagtagaataaaagcttttcttttaattaaggtgcatgaaagtaagggcaggaaagaaatgaatgcagaggccacaaggtcctatactcttgctagacacaaactgcagatctagctctgagcaccttcttaacaaaagcaagcaggcagacaggataagatcaatagtgtatacatatgagagaaaaacaaactggcttgcaggagaatcatttatttttcccaacatggagaccagagggaaatatctccttgcaaaagggacccagggtgatgcaggagcaagacccctgtgggctgaacaagggtggcctttgcttatttgactgcctcatactgggcatttttatggcactgagtttcactaatgcaaatgagccaatgaagttctccataggttaaaaaagtcagtctacatttcatcctcagatcaagccagactatctggagaaatggttggtctttcaggaatcattcacaatagcttccgtattagtccgttctcactctgctaataaagacatacccgagactgggtaatttataaaggaaagaggtttaattgactcaattccacagggctggagaagcctcaggaaacttacagtcatggcagaaggggaagcaaacacatcctacttcacatggtggcaggaaggagaagtgttgagcataagagggaaaagccccttataaaaccatcagatttcgtgagaactcactatcacgagaacagcagcatgggggtaactgcccccatgattcaattaccttccacagggcccctcctacaacataggggtattatgggaactacaattcaagatgagatttgggtagggacacagccaaaccatatcagcttcctaaccgctttctgccctggaccccttgtgttctctgctcagaagcctccaatgccacccattccacacagagtaaaagtcaaagtctttcaaaggcctaaagcaacaccatcccaccaccagcactatctccttttggatctgatggcttcctactgtcactcctactactgtccgctgatctggcagatgtcttcagtgacacttgaacacacaggtatgctactgccccagggcctctgcacatgcagcctctctgcctggaatgctgtttgccagatgcccacatggcatactccctcacctcctttgggttcttactcaatgtcccttgatcagcgtgactttccctggctacccgacctaaacatgcaactcctcccacaccacccgtgcaactccctatcctctttcctgcttcacttttctcctcagcatgaagcactagcacctcggttatgtggttactttctgccttcctctctttagcatcagctctatgaggggaggagctgatgtctgttttgttcagggctatatttccagcattgaacatagtgtctggcataaggtgaaggctcaataaatccttgtttgaactgaatgagtgaatcaaagttttgagaaataattagacggcggagttaaaggttagataatccacattcagaattctgagactatatgttgcctactaaagggaaaagccagaagccctgcggggtcccctgagagaggtcagggctgcactcttgggaagtagaaagtagcctcatcagggaaaagccttaacgaatgaccactctggctatacccagaaagagcccagaagactacagacagcgacttcaggctaagagaggagaccaagataagagaggtgagagggggaactctttggtgacaattattcatcttctctattttataatatcttttattatttttattctataaaatctctgaaataaatgattttctaaggtaacacaaaatagctataatagagttgtgaagaagaaaatgtgtatataccaaaagccaggaattacatgccctccccaaaagcttccaggttcagagagttttacaagtgagatttttacagtttcaaaaaatagtaacttctctatctattctctattatatgatcaattcttaaaaatggacttatctgtgtttttccatgctctgtattggtttagaaagttggcattacctggacacaagttcccttgcattttttcttaaatggcaagcttatcacactaatgactaacaacaataatcctaaataaaatactagggtatcatatccaagactgcattaaatgaataaaagacatgagctatagcagatgctgtagggtacagcccaaatcccctcttcagggaccttatttgtcctgggctcttgaagagtgacctgctaaaggctcagagctagtcccttcatgagaactgccctctgctacaaggagctgcctcacctggggctacatcccctgtcagtggtggtgccccccacccccccaccccccccccaccaccacacacaaatgctggctgatgtagggacaaaggtcagctgccttgcctcaatttgggatactttttcctgtgggatgggttgaggcttcccaggcagctgcagccagcctgagttctccacccttattccctcacaggcatgggcattaaatcctaccctggtgatctgcataccagaagaccgagcattctaagagtccatgtgggcatactggaggcactcagtaaatggtaatttcatcatatgaagaattacaatagcgtaggagtgtacacacgccacagaaaagtcatcaaactggactagaaagcccagaaacacacacacaaacacacacacacacacacacacacacacacacacacacacacacacacagagtacatatagtgttactattattttaaattactggtgaaatgatgatgttgacaatgacattaatctattattattgatgatatctagtatgtttatttacttacacacactaaaacttctaactatatcttttttaaaaaatacgtacacagaagaaaatagctaaggagacacaaatgagacagtgtatccagcatagtttgaaagcaacagagccaagtttcaccacaaatgtgacaaactccacaaagcccaagcttctagccactgccctgtacagacttcagccagtcatttccaattcagacattaggactcaagcacacactttcaagacttgtgatacatcttaccaacttgtcctcacaatttgcattcccttcagtatgcaaatgctcttttgcctgtattcccactggattgagtacagtgatagagaaaataggaaggaaggaaggaaggaaggaaagaaggcatgaaggcaagaagggagagaaggagagaaggcaggaaggcaggaaggcaggaggggaaagggagagaacgagggtaagaatcccaatttgaggtcgggcatggtggctcatgcctgttatcccagcactttgggaggctgaggtggactgatcacttgaggtcaggagttcgagaccagcctggccaacatggtaaaaccccgcctctaccaaaaatacaaaaaattaaccaagtgtggtggtatgtgcctgtaatcccagctacttgggaggctgaggcaggagaatcacttgaacctgggaggtggaagttgcagtgagccgagatctcgccactgcactccagcctgggctacagagtgagagtccatctcaaaaaaattaaaaatttaaaaattaaaaaaaaaatcctaatttgatagaccccaaataagagctcatggctgttttattttgcttttctatcttaacaaatgaagctaattattttttcatataattattagtcattttattttcttctctaaagtgctttagagtggcctttgccagtctgcctgtgtatttatcttaattgtagtaatacaattatgttctcatataaagaagattttgtataccatatattatctcccaccgttcgtcattcttctcaatttggcttaaagtatttttcctactgtcaaattttacttaaggtgggtttctttccccatgaattctaaaatatatcaatctttctaccatgttccctttttttaaaatttttttggccatccccatcatatagataatttttttttttttttttttactgcatctatttttttttctttgtacttttggggcactggttctggactttgactgtacatttaaatcacctgggaaacttttagaattgttgacacctgggtctcagcaccccctacctgcattctgatttaatgggcgtggggtacattcaggcagagggagtattaaggctccagagtgattctaatgagccatccaggttaagaagcattgcaaactttttctataaatgaacatatagtaaatattaataaatattttaggctgtcacaacgactcaactttgctgtaaataataggaaaacaaataggtgtgaccatattccagtaaaatgttattcatataaataggccatggacactaattttctacacttgctttggaggcatgggattcaaatccattgtgcacatgaatcacctggcatttgtaaacatccagattctgactcagtgggtctccgatggggcctgatactgtgcatttctaacaagctctaagctatcgtcaatgctgttggtcagaagaccacactttgggaaaacaaggctgcaaggcagtggtccccagatttctctgccattgcaatcacccgaggattttaaagcaatactgaggcctgcttcccaccagattcaacgggtctgggatacaagctgggcatcagaatttttataaattctgattcgagtgtgcagccaagtttgggaaccagtggttcagaatatattttcttttctctaacctttaatttgttaatctgttttgatgtatttatttattttggttaacagtgcaccaaaaggaccaagctttatttttctaatcaagaagattctaatgtacagccagatgatggatgaggatgagtccagtgtacagccaagtttgggaatcactgctttagagtatcttttattttctttttttaacctctaacttgttaatccatcaggatgtatttatttattttggctagtagtatgccaaaaggagaatgctttattttttctccaaatagcaaatttccgttaatccgagtaatcacttgagtaatttaaaaccagtaatctaccctctaagcacactaccagtctatttaaatcaattttaaagaacatactggctaactagaagttaaatcaataatacaataaaagattatttataaaacaaagcattcagcttaagattttgggggaaaagtagtcttgacaataggagaaagctgattttttagttcagtgtttatgactaaataaccagaaaaccaataaatatgaaaaaaaattttaaaaatctgtagaattttatgggagcaaacaatggcaacaagaaaacaaacaaaataaagttctggctgatccaataaaaaaagaaaaaaattatccacaatgatattctaataaatctgtgaaaaacctcagtgagagggatgactttctgaaaaatataaacttcgaaacttgatacacacaaaaaagaaatccattataggataacaattgagatatacattgaaatatatagtaacagcttcccttacagactctgcacccatatataatttatgattaaattattgcacatacattttattaaaattctaaactgttccataatacaaaacgagatctaaagctactaacttatattataaaataaacataaactgaggaccaaaaactgactctcaaagcacaaaaataaagtagaaatggccctcaacttacaatggttcaacttaatgattttctgacttttcagtggtgcaaaagtgatacctattcaccttaaaccatactctaagtattcacacaaccattctgtttttcactttcagtacagtattcaatacattacactaaattttcagcactttattataaaatatgctttgcgttagatgattttgcccaacagtaggtaatgtaagtgttctgagcatgtttaagatagggtaggctcagctgtgatgtttggtaggtgaggggtattaaatgcattctcaaacttaaaatattttcagtttatgatgggtttgtgaggatgtaactccatggttaaattgagaagcatctgtattctaatatcactaagatcatagatgccaaaattctgtatataataccaacataaattattcatcaatgaattaaaatgataatccagagcattctagttaaacatagcagatggatcacaatggtttatgtctgccccctctcaaaacttcactaaactaatacaaatgttgagggggtaggaaacagcagaatcccacaagaacaaaaagaatggaagaggagattacaacacagaacagacgaacacaaaatgtgggtagatactctgttagaaactgacttggcatacatatatatgtatttatttatatttatataaacatatacatatattttccatgtatatatttccataatgagaaagaaagacatatacacacacatatgtctatctccacaatgataaacagaatattaaaaatgtctttggtcaatacataaagactgaggttgatgggggggtggttgggatgcagagatcacagtgaagaagaaaacaaccatccaaaaggtgaaatgaagtggctgaccctgggaagaaggaggctgtgacaataacactgattgactggggtgccaaacaggagtagtcactacatggcagcaagtgcatacacttgaggtgttaaaatagagcaatatcctgagtaaactgtaactcttggaagaaacacactgtctctacagctgtaagaccagttaccgaatagaaacacacagtagcatatctcagtactccccagacaaactgcaacacacaaagacagcattcacatataggctaacagaagatctcaaatgcaaagataagcacaaaacaggccaagcacggtggctcatgcccgtcatctcagaactttgggaggctgagcaagactccatctccaaacaaaaaaacactgtcaagtacatctacatataaccacatggatgaatcacacaggcgtaacactgagagaacaaggcctgacacagagtcattctatataacccagttatatgaagttcaaaactgggcaaaactgatatatggtcaggagagtggttacctttgtggggtgtagtgactagaaggttgccaggagaagggactagggggtgacaggcaataatgactgtttcttgagctgagcgttggcttctcaaatgcattctcttcgtgaaaatttatccagctgttgccaggcacggtggctcatgcctgtaatcctagcactttgggaggctgaggcaggcggatcacttgaggtcaggagttcgagaccagcctggccaatatgatgaaaccccatctctactaaaaattcaaaaattagctgggcatggaggcaggcacctgtaatcccagctacttgggaggctgaggcaggagaatcgcttgaacccgggaggcaggggttgcagtgagctgagatcgcgccactgcactccaacctgggcaacagagcaagactcggtctcaaaaaaaaaaaaaaaaaagaaaagaaaagggaagaaaagaactaaagaattgccaaacatttgaggaaaggcaactttccttcaagaaatgcacatattacacttcaggccaactgacccttaaggatacaacattaacaaagcattaaacaaaaaatgctttagaaaaatatttgaaaaatataaagagttgtgaaaaactatctcaactcaaaaaatcaactaaatatcttagcaattaaaattttgaacatcaaaatcttaaaaggccagcttaatagaagaatgggcatagccacacagcaaagtagagggctgaactatcacacagccatcttcatacaaaggggcacaggaatgaaaagtgcaaaagaaaaactaagagacccagaaaacaggaataaagttttccacatccatgtaattgagctgccagaaggaaaaaatgaaggaaatagagaacaggaaacatttaaaataacattaaagtgtcctagaccgaaagaatgacctgtatcctcagattggaaaggtcttttaagtgtccagcaggttaaattttttttttttttttttttgagatggagtctggcactgttgcccaggctggagtgcagtggcgcgatctcggctcactgcaagctccgccccacggccagcagattacattttcaaagacctaaatccaagcatattgtggataaattttataacatcaatgtgaagaaataaatcccttcaaagcaacaagagtcaaattattgtcacaattctcctggcttcactggttgcaagaaaacaaaagaaggatatctttacaattctcaggacagattaatttgaaccaagtaatatatacttagccagttgaaagaaaaataaatccaaaagaagcaagatacaagaagcaacatggaaaagataaaagtaatggattcatttatgtgttgactgagtatgttttaaatgaataaataataacaatgatccaaaattaaaatctctggaaataaatggaagatggaggtgtgaaggagagagggcaatgggaaaaagaaaggtgtgcagaaattcttgtcttgataggatacaatcaatcatatatattaacagaaaaaaattaaagtatgtgtatcaaaaccttaaggatataaattccatagcctagagaaaaaaaaaaggacaaaggaatttaatcaaatggagaaaagaaaaaaagaacaaaaacttcagcccatccaatgaaaagaaaaaaaaaataaaaggtatattaatcagaaaacatagttacaatagcaaaagagtccaaatatatttgtaatcataataaaattaaattaaaattactttcacctatggaaagacagagattcacatgatatgaaaacaacaacaataataaattccaggcgcatgctatttaaaagacatacactgcaaacaagacatacagaaaagttagaaatgaaagaatggaaattatgtgcctggcaaatgctgagaaaagaggaacaaatagagcaatgactatatcaaataaagtggcagctactgcaaaaagttatataaaaattatatataaacattatattaaaaagaataaaaagtaatatctcatattgataaaagaaacaatccacaaagaatgtgtaacaaaaaaaaactttatacacctaaaagtattcctttgagataaataaagcaaatatgacaagaatgcacaaatataggacatttaagtagcatttaatcccttgggatatattcgtatctatatgtatctgaatggatgggcagaaagacacacacatatattagtaaactaggaacacacattctttaataacagccatgagcagtctcaaaaactgaccacatattaggccacaaagaaatttcatcaaaatctaaaatgcaaaaatcatctaagtcacatttaccacaaagcaatagaataagaaagtaataagagcatggcaacaatgactaagcagtagagaaatagactctattttatcagaagaattttacagacaataaagaggtcatcacaaatcaaaaggaagacaggcatcatgcaatgatggacctcataccataatggaaataagtttgagatgaattaaaaattaaatatagataataagggacagaaaaattgaggaaaatataggtatatattattagccctctgaaaagaagaatttctaatttcatgtgtaaaaggagtcatacaatctttgaaatacaggctctgccaccaccataaaaacgtcaaaattctgcatgtttaaaatcataataaacacaatatccaatgaaaaaataatcaaatatgatacaataaggataaattctttgtaatgtcaaaagcatgtatgtaaaatactttatcattagttgataagtaggcaaaaatcaaacagctacatcatgaagtagataatataactagtgaataatcattaaataaattaattaaatgaaactattttatcttaacttggttcaaataaaaaaaatgtgcaccatatacaaaaaccaactcacaatgaattaatgacttaagatccaaaactgtgaaactactagaagaaagtattgagaaagagccccatgacaacggtcagggcaataattttttggaaatgacccctaaaacacaggcaataaaagcaaaaatggacaaagaggattacatcaaactaaaaagcttggcccaacaaaagaaagaatcaaccgagtgaagagaggcggggcgcagtggctcacgcctgtaatcccagcactttgggaggccaaggcaggtggatcacaagatcaggagatcgagaccatcctggctaatacggtgaaaccccgtctctactaaaaatataaaaaattagccgggtgtggtggtgggcacctgtagtcccagctactcggcaggctgaggcaggagaatggcgtgaacccgggaggtggagattgcagtgagctgagatcatgccaccgcactccagcctgggagacagagcaagactctgtctcaaaaaaaaaaaaaaaaaaaaaaaaaaaaaaaggaagaaagaatcaacggagtgaagagacaacctacagaatgggagaaaaatatttgaaaactatacatctgataagggcttaatattcaaaatatatagagaacacatctcaatagcaagaaagcaaatagcccaattaagaaatgggcaaaggacctgaatagacatttcgcaaaagaagaaatgcaaatagccaacagtaaatgtttaaaatgtttgacatcactatttatcagggaagtgcaaattaaaactacaatgaactatcacttcacatctgttagaagggttattatcgaaaagacaaaaggttaagtgttggtgaggatgtgggaaaaaggaacccttgcatactgttgatgggaaggtaaattagtactattttccattatggaaaaaggtaaaaagtttccacaaaaacccaaaaatagaactaccatacaatcaagcaacctcaccactgggtatatattcagaggaaatgaaatcaacgtgctgaagagatgtctgcactcccatgttctttgcagcactattcacaatagccaaggtatgaaatcaaccgcagtgtccatcaacagatgaatgaagaaaatgtgatatatatacacaatggcatattattcagccaagaaaagaataaatcctttcatttgcaacaatgtggatgaacctaaagtttatattaagttaaataagccatgcacagaatgacaaacatcacgtgatctcactcatataaaacagctgatctcatagaaagaggggctggggcggttggagggaagggtggttgggtagatgttggtcaaaggatacaaaatttcagttaaataagagaaataagtttaagatatctactgtattacatggtgactatagttaataaccatatagtattcttgaaaaatgctttaaaaaattaaaagaaatgcaaattaaacaaaaataagtaagcactgtatttattctacttaatagcaacatatttgagcttcacctagtggagatgactctacaatgaaatagtcttataattccattgtggaattataaactgataaaaccttttcagaaagtaattcagcattattaatcaaagtaattccatttctgggaatatagcctaagaaaatataacaaaatatggaaatatgctacagaaacaaagatgctcattgcaaaattgttcattaagcaagaaaaatagaaagcagcttaaaatccaaaaataggtcttacgtctgatacatcttctttataggatattatatatgctcaaagattgtaacaaggaaaatttttgacataatgttaagttaaagaagtagaatgtcgaaattaaaatagcgattaccaggagctgaggggagaggaaaaattatttgtttaatgggtttagagtttcaactttgcaagatcaaaaagtactggagctctgttttgcaacaataggatatacttaacattactgaactgtacactaaaaataattaaaatggtaaattttatgttatgtgtttttcaccacaattttttaaaaatagcaaattggaaatgctgaaaaaaaaaaaaaagaagtaaaagatgaagtgcatggtccctatgataaaactatgaaaactataggtatgtgtaaaatgaaaaagtagaagaaaagcataaaatgatgacagtggccatgttacaaaggcagacattttggatttctttaatattcttgagttttttaatttttttgtaatatttatatcaaaatttctatttttatgcataattacttattgctgtagtcataaagtcagtggcaagtcaggactggaatacaggttttcctggctccgagccctgtactcacatgcaagattcagtcacatgagaccattggctccaggtgaggaggaccccctgccagagctttcccttcgaaacttgctgcccagggcctgaacaactaggtgaggctcctcctgagaactattgctgtggaattttagcaatgaccagacagattaagggatcttgaactcccttctcagataaaagcagagttactgtactgacagaaattgagggataaacaggtaaatgataactcattcactgcttcagggttcctgtgatccccagagagaaaagactctggagattcatacatgtgaggtctcgggagaggacaagacagaaaacacaacagcaaacacatccaagcccataccagaaagcctgccagggttttccaatttgctattttccattccctttcactccttaatctttaaatccaaaaagctgaaaggttccaataaacgtctgtcgtttccaatctctgcagccccacgcaaatcctgaagagcaattatttttgtggtgtctgacaaggtcattgttatctggccttgcagctcagagggatcaaactgagggcaggcatatcagggtaaacagaggatgcccaggagcatggggaggcttcttcagggtggtcccctgcacccttctgccatcacaggtcccacctcccatccccagcttggtcactgtgaggaccacctgcttcttagccccagcacagagtgaatctgagcctctccttcccagctggagaaaaaggactgtctcgcttcctctcaaatgcccctgggcttttgttcccacagtcagaatgtgtgttctataaacagttcttgcttgtctgaccttttcaccatcctttcctttggtaattgttcaggttgttttgctccctacttttttaaaaaaattttttgagacagggtcttactttgtcacccatgctggagtgcagtggcacgatcacagctcactacagcctcgacctcctgggctcaagtgatcctcccgcctcagccccccaagtagccagccaccatgcccagctaattttttctatttttttagtgacacagtttcaccatgttgccaatcctggctccctaccttaacccagtcctggttcctgttctgatagatgctcaacatcagttgatattcagactgggattgtcgcccattcattcattcattcattcacccacacacatgcacagagtcactgcttccaccaccccttgtggttccagatgctgcagcacaggggtgaggctcctgcttccaggtcttctatttgaatagaggagccagtaagtagagaaacacattttttaaaagtaaacaaataggacttactcactttacctctttactttgttttaaaattattgaattttttaagagacagtgtctcatggtcacccatcctggggtgcatgatcatagctcactggagtcttgacctcatgggctcaaatgatcctctcacctcagcctcccaacatgctgggattataggcataagccattttgcctggtctgactttacatcttaaatatatgtgaaataacttatcttttccctctccactgccagaaccatggttcacactgctgttacctccatctggaccaagagccccacacgggtcttcctgcttcacttctctaccccagtccccccaggccccaccagcattctccagaaagcagccagcatggtcttttcaaatatccatcagattacattgctccctgccaaaagccattacatggcatccatctcactaaaattactttcagattccttatctcgctctggaaggctctccatggtttctgctcatttcatcaccactctccatgtcctcacgccctgcacacagtgtctctgctccagaaacatttcccagttcgtcctcagctctgagtcttcccttctgtttcttttcttgggaatgttcttcccccagatcattgcaaggttggctaatggaggtcttctctgaccacccgatctggagcccagtccttcgccgccattatccattcttctttatagggtttaccacaatctaaaatgatctcatttgcttgttcaggtgcctgcctcctgcccgttcctcagcagactatctgctctattggggcaggtgtctcactcactggctcactaccaagtgcaccctcttctagaacagtgatgactggtacatagtgagtactcactactgaaaattaataaatgcattaatcctttcaaaggaaaagtaagaagggtattggatactaagttaaacccatggttttactcaattattcaacgttttctcaggaagtagtgtatgtgcccttagcttaataattccatcatttggtctcttctctctagtggctttaatcctgattctctccaaggccagatgttacagtacagagcagctcttctctgtgatgaagggagaggaaatataacaatctggccagctaattctagggttatagacacagaagcatgaatatttagattccaggcatttcagctgacagaaacattttatatcagttctaatgaaaaggattgactaggtttcacttattgcttgccaactggaattttgttaggcacaattacataatgcagaagtatttgagctgtgcctacccacatcagaatcctaaactaggtttcaaagggactacattccattttaaagaaattcctagtactgctaactttcctggaaataaaagctatccctccctaagactgacatttttatggccagaaatgtacatttaatctatttgttttaaactgtaatatattatggatgcctaaataaagccaaatgcctatcagaaagcagttgagaaaagaaaatctgcctagaaaactattcttatgatctctgctgggtaagaataaaaaagtaccacccaagacaggcaagaccacgctcccatggtcaaatgtaaggacagaaaatgagccacaactcgcactgtagcccctgaaaaaaaaattatcgataggtccaaatgcctcttccaaaaatgctgactcactgaaaattattgccatttaataaataggaagcaagctattacatcgtttgccaaactttctcccacatttctgaaatatattctttaatagctcaataacattcaggagcactagaggccagttaaattcatctaaaaaggaaggacgagatttctgcctcacccagcacatctgcgttgggtgggtatgccaagaaaacaggaatcaaggtggctatcacctctccactagacagttccccaaatccagcctagacggaaagcactttttttcccaggcagcctccaggaatacggaatacttttgggaggagaagagccatggacgggtgagtccttaccccaggatgcacaaacaccacagcaagacaccaatgactgccggaagttcggcggttcctccttctccggagcagcaggcccagacttcacccggtagccattatggaacaggtcccccagggacttcttgcggcgcctgccgggtctgtaaagctctgtgccggttctgctggatgggtggcggtacaccagaatcttactggggatcatggtagaaggagggagatgggctaggctttcggctcccttccattcacttcttgcaggagtcaatgctctggaaagacctggaggagcctgtgttcctctgacccgtgctgcaaacaggtcctcctgtccagcgcagtgtgggtcaccagcatctatgtcctggtggagccaatagacactctctcctccctcaccctccagtccctcttgcaagaaccccggcatgctctgggcactggatgcacgcagccacatcagaaaggcggttaagaggggcgggggaagcactctgatccacgatgtcctgcgagctgatcaatcagcttcacgctggaaataaccatgtaagctcctttggacatggtttagggggatagaaagagaaaaggctataattcctcaaatcaagtggtatagaatagagtgtgagagaggctgcagtttggggcccactaagtcgtttcttttattttagtaatcctgcttaacaactgaggactcataaggaggattcccttagaggatgtgatgcccaacaagaaagaaaaactgaattgtcctactcctcctgtcgtggccacctcccaccactaacataacccaaatacgcaaatcctctgctaatcctacatacaggactgaggaagaagagggattctgggctatccagaggaagatgggaggagacactcattagagctccttggcccaccccctgcttctttgtcccattgttttcagcatcttctctcattaccaaccccagccccctcttagttctctgttacaggctacattatggacccccatccctgccaaagtcgtaggttgaagcccaaaccccaatgtgatggtatttggagatgaggtactttagggagtgattaggtttagacaagatcatgaggatagggccctcatgatgagattagtgccattataagaagagagaccagagagtttgctctttctccctctctgccatgtcaggacacagtgagagggcagccgcctgcaagccagaaagagagccctcaccagaacctgaccatgctggaatgctgatctcagatgtccagctttcagaactgtgagaaaataaatctctgttatttcagccacccagtttttgatatcttgttaaggcagcccagagtgactatgaaagtctcccttcccagggtactgagtgtaaacaaaaatatgacacagacagagagaggggaaacattaaaaatataaacaggaaaatatccacattccacaagttgttagctgaggctcctcataatttaatccccacctattttttcagacctctagcaaggctaaaattattggtagaattttcaaagcataacatttcttctcaatgtggattagttcattcacctgaccatgacgtattgagcatctattatgtgccaagcgttttgctgggtactgggtatttgctgattaacaggaacaatgcacaagtccagccttggtggcatttatagtataatcagagagtgaaacaatatatcataactgtaattaacaatttggttaaagtgctgtaaagaaaaaccctaagtaggccgggcgcagtggctcatgcctgtaatcccagcactttgggaggccgaggcaggcggatcacaaggtcaggagatcgagaccattctggctaacacggtgaaaccctgtctctactaaaaaatacaaaaaaaaattagccgggcgtggtggcaggtgcctgtagtcccagctactcaggaggctgaggcaggagaatggcatgaacctgggaggtggagcttgcagtaagccaagatagtgccactgcactccagcctgggtgacagagggagactccatttaaaaaaaaaaaaagaaaagaaaagaaaaaaagaaaacaaaaaagaaaaaggaaaaaccccaagtagttatctgagtatgtgtatgtgtatgttacataaatgtgtatctgagtgaatgtgtatggaaaatgtgacatacatacgcaaaagggcttcacaataattctatatcctaatgatatagtagcagacagccaggtaaaaaaattatggtgatggcaatttttttaggccgagggaacagcatgacgaatatcttgaagagggaagtagatggcctggtcctgacttgaaagaaactcaatgtgtttaaaaagaaattggtgagaaactaactctccaacacctaaagttgtctggaaatgatagacagaactacaggtcctacaaacactaagaggataattttaaagtattaggaataatattatgtctccaaaacttgacaccctgatgaaatgaacaaattcctttaaaaatacaattttctccaactgacacaagaaaaaatagaaaatgtaaacagctacatatctgttaaataaatggaaacttcaatgaaaaacattcccacaaagaaaatttcaggttcaggcagtttccactgcagaattctaccaaatatttatggtggaaataataccaatattacacaaactctttcagggactggaggaaaagagaacccaacttgatttataatgccagaataatcatgacattgaaacctaataagagtattatgaaaagaaaaaaaattacagaaaaatatatgtcatcaacatagacacaacaatccttaaataaatactagtcaaatgaatccagcagtatataaaaagaataatactttagaatcgagtaaatagagtttatcccatgagtaaaagattggtttaaaaaatgaaaattaattaatgtaattcaccacattgaaaaattaaaagacaaatcatatgatcattttaataggcatcaaaaaataatgaaactatgttgtgttaagataatgtgtcgtgccccccaaaaagacaagttgattaatgaaacagagtccagaaatagacccatatatatacaatcaattgatttacaacaaaagcaccaatacaactcaatgagaaaaataaagtcatcgccacaaatggaaggaaaaatggatatctacaaagggaaagaaatcagtctcaactcttacctaacacaatctacaaaattagtttgagatggatcactgacttcaatgtaaaagctaaatctgaagcctctataaacaaacacagcagagtgtcttgaggacactcggataagcaaaggcttcttagataggacacaaaaggcactcacatttttaaaaagactgataaattaaatatcagtaaaataaaaaacttctcataaaaagacaataaattaaaagataagccacagattaagaggaaacacttgcagtacatttatatgacaaagaacttacagaaataaaaattaaaactacaacaagatggcaccacaaatccattagaatggctaaaatttaaaagttgacattatcaagtgttggtgaagaaacaaagcagctggcaccctcacacgttgctagtagaagtgtaaaatggtgtatcttcctttggaaaactggcagtttcttgtaatgttaaacatgcatctatcctatgacccagagactcaatttctaagtatttacccaagaaaaaaaaatatatgtccacaaaatcatttgtacaaggatgttcataacagctttattcaaaataagccaaagttggaaacaacctaatggccatcaacagggtggtttgataaacaaattgtggtatatcccataatggaatattagcagcaataaaatggaagaaattattaatatatacaacaatatatacaaatatcaaaaaccttattttgaaggaaaggagctagttagaaaagtgaataccctgcatgattccattcatacaaaaattgagagcagacaagactaatctatagtgattgaagccaagatagtgatttttttatgttcaagggaggagagagcagatattgacagaaatgagcataaagaaacattccaggatagtaaaaatgttctctatgttgatatggatgacagaccattttacagtggtgcatatctctgtcagaactcactgaatgcaccctcaggatctatgcattttattgcatgtataatatacttattaaaaacattgagatgggctgccatgttagatggtatctccctgtcaacagagatactcaaacagagtctgcttgtaccaatttagggaacactaaagtttcacctgatgcctaaacagagatcatctgctgtaaccctgtaaattccctcccaacttccagtgggcagtatggcatgaaacccctgcaactcagagatggctggtttaattggagaagtgaaggatttgtattcaggctctgccaccagcagctgcacatctgagtaagttatgtaactcctagcctcatttcctcatctccgaaatagggattatgacatctacttcacagacgaactatccagattaaagaaaacgatgtttgcaaagctctgcacagggtctgacactcagcaaattctcctccaaaaatctgccaaagcactagggcccagtcaaactggtctatattctgccatcgaatgccccatcatcactgggcaatctggtctcctactgtaaataaaaaccccacctatctccatggggcacatctgccagcctcttcctaggaccctgtaggtgtggcaataaatgtggtccctggaaccagcagcaggggatttggttcctggcatctccacatacgagccacatgctcttggaagttattccaaccctgcctcaagtctctgacttttaaaatgggaaacacttttcaagataaatctgttcatcacaagaaaggatttcttataaatttgaaatatttaaaagagaattctatgcaaacgtatgcacacatacaagtgaatgtgggcccatttctctggacatgtgtctattccaaaaaaaactgtcataaactgtatcctcattttgcactcctcccaccagtgtgtcccatggtgccacctggtattgtctgcctgaaagaattctaggagggcttcatttgtctctgaagtcatagatcttcatctaccaatactgggaaaactcccttgctcctcttcctctgcattaggcttgtttttctgagacagaagtggtcagagaaaaaggacactggaatccattcattcatttaaaaatattgaccaagaaatgaactcagacgaaattgacctcttcagtgaagtcatatctaattccctcaaccctgtacaaagtaatagtacatttattcaacaacatattttcatggagtacctatttagaaaagagacggaatctgggcccagtgttataggattcaaatcccagctctgccattaattgggagtgagcattagcaagttccttcaactcaaagtatctcagtttccccaactataaaatgggaacagtaatagtaacctacctcatggggttattgtgaggaatgaattaatatctataacggttaaaattgtccttggcacataggaaatgttcagtcagtgcttgctataattattactaggagccagatactgggctaaccatattggggatacaaatgtgatttgctctaaatctatcctcaaaaaatgtacagtcttgaggagctgtttacaatctacatttgtatttagctaagataggaaagatgactatctacataattttaggggacgatccaccagcccccaaaagaaattagccttcttctcttccttgtttattgatgcctaaaattcccccataagacagcagcattacccagtaagaaaaaactgtgccttgggttcaaatggatgtaagttttgaccctggctctgctcctgatgcactgagagaccctggctgcttatatgaaacctgaatgtctatgactgcatgtaaaaaataaagatgagaagctgggcgcggtggctcatgcctgtaatcccagcactttgggaggccaaggcaggcagataggttgaggccaggagtttgagaccagcctagtcaacatggcaaaacttcgtctcttctaaaaaatacaaaaattagccaggcgtggtggcctgcacctgtagtcccagctactggggaggctgaagcaggagaatcacttgaacccaggaggtggaggttgcagtgagcggagatggtgccactacactccagcctgggtgacagagcaagacttcatctcaaaaaaaaaaaaaaaaaaaaaaaaaaaaagaaagaaagaaggaaagaaaaaagatgagaattatgcctctcaggggctgtgacaataaattgatctacgtgtgttttaaaatgcctttcacacagaatatgctacataatcactcattcctggtctcctccagaagtccctgcacttggcctctctctctcgggtgtaatggattggtccccattgaaatacatttccttttcagagtcatttatccctcagttagaaagaagtattgaccatggggaagggggactgtgaagccacctgggcatggcagagggggccaggcacagaggagggagcacaaaagaacgaacaatgaagcacatagagaaataaaacctaactcgacttgcaagccagtgatggccctatttttagctgacaagtgagtaatctgatgtgtgtgacttgaaacagggaacataaacatcaaggctgaatctataaccagccacatataacttgtactataacttattcccagaattctagactgtttgaattaagtgtctgcaggtctcttcttcacgcacttactcttattaagtttgggaactagaagcctgtgtcatttgcacaggtctcaagttacaagggaaaaagatgctttgcttggtctctggtttgactattccaaagaatctttcctaatctccaattcgtctttgtctcccaccccaccagcctccctccctccttcccttccccctgaaagctaaccatcagaggggtggaatagcctctaattcagcccattcttccctcatccctttccctttcatcatcagctagcagtgaaagtcaccatcctcttggacctcccatttctgaggcattgtctgtcccagaaccccatgcaggacattggagacaagtgaatctaacctcgtccaatctccctcttcttcccgtagataaaaacctgaactcaaagaagagaactggaataatcctcccttatcccacttcccatggtgagccccagctgggacgctgacacatggccccaacttttcctcctgcctgatgtctggacccacaggggacagatggtggtccctggtcactgaagtacccacaggtttgattattgagacttttatctctgttgactacagggaggacctgaatcagtttacatggttaaaataaaagcgccatatacaaggataaagcaggacagggcccccaccatctaaaagtagaagggatggggattgccaggcagcacctgccaccaccaagaaaagactgagaaagggacacttcaggcacaacatgtaaggaggtgctccttttgggactgaccctgcctttgcatagccctgggaatgagccaccctcatgtttgcacccaggcctctctcttgcctcatcctgcacctgccatgagtttactactgagctcacttctgaaattggctctgcattgcctgtcacctatggcaagagagaaacaactaggttatgactattgtgaactgagaaaacctataaagccaattcagagatcaaatctatcctaaaattaaattcaagcagaatttttgtgccagcggctttgaataaagactgaagaacacggtgagttatatcttcaattacagtttacaaagaacagaggtactccttccaaaaggggactcttgatttagctctctgtaaggacagaaagcataacactgaatcttgggtcagcaaaaacattttcacaagggcctcaggtatcatgagatttagctctgtttaattctgatgctcaacattaatttaaggaaaatgaagtacttgttttgggggggattaatttgctaccaggcacacctcagctgtgttttattctgaagctctaaattagcaccaggatcaacctggataatctaaatcaggggttgccaatttttttctgtaaagggccagatcataaatattttgggctttgtaagctgcacaatctctattgcaagtgctcaatgcggccattggagtgagaaaactagccacagatgatacaaaaatgaatgagcttggcctcgttccagtaaaactttccttacaaaaataggtgatggaccagatgtagcctgtaggccatagttggtcaacctctgatgtagctgacatcttgaaatgaggaaggaatgtttaatttgagaacaggtacttctacatttcacaaggtagaaatctgtaaataacaacatttggaagttccttctgtttcctgcaacactcactttagaacctaatatcatgctatttttattgctctggcttaattcagttatatagaaatcatttctattcaaatagacgatgaaatccttgaggtcaaggtctctgtccaacttctttgggtataatccatcgtgcctagcacagctgggaactttgcacttgcttaaagtgttttcttccctttctgaaggacagtgattcacatctctgcttttgacatgcaaggacttgacgatctatttaacctaaggggagaagagtctctttcaaagaatggattgtcatccccttctccctgcccctgccatgtacattatgcttctaatcagtctggaataaagcgatgtcatgggcataaactaatttcttccaatccaaaacaagttagcaagtctcattttgtaattctaaagtcttcagctcatgtatttatttcaacatttttttcctataaataaatggctgtgtgacttgtctccttctttgtgttcatatcccaatgtccagtgtagagtggccttcactaaatatgtgtagaaggaatgaggaaatgaatgcaagatgggcttagctcataaaccctttgttttgttagagacttttgccaactcttttaggcagttacaatattttgatgggcaagacctgtgctgttgggctgcctggtcaaacccatgcatagtgaaataatccgtctccaatctcagcctgcatcctaaccccaatttgtccctgagtgcaaggtcactgatctgaatttgaatggcaggctttgttgacctaacaactctgttaggctcacccatttctgcatactactggtgagtgacagaggatggacactgaaatctccatcttttcatagaacccatgcaagaggcacaaaaccatctgcttagtggtcatgtggcagcagacagtatctcagaagtcctcgcagcatatgacttcactgatgaagatggatcacacttgagcagggattcttgatctctgcaaaacagctcatacacaacaggaacaatctcacagataagaaaaactccagaagttggtctcgggctatgaaaatttctgccacaatatgatttatatgaaaataaataaagtgggtctactactttatcattagcaataagtggattctttcttcctgccacagacaaactgaggatgtaaatgaacaccatactcgcattgttgcttatgctgttgttcttcacccactgcctgaggtgtaggtttgcaaataaaatcaaaccatcattattctggactgattatccaattagagaatgaaataggccagccctgtcttccttcttcttccatcaaatgccattcttgtagccatttcactgacaacatgaggggccaacagaagaaataaacaggcataaatttcaaacccaggaaatttatgtgagcaaagggaaagaatccagatatataaaatgaattaatcatcaataagtcaccacatccctattacatggtaagttcttttctgggagctgttagggccagaaagggactgtaagacacagtccctgctttaaagaagtacaaacaatcaccaaaaataaaagcaaaactgaaaaacagcaaataaataatcatttatcagaaccaactatggactatggatagtttaaaagtgctgagagcatagcccacatggcagaagtgcataaataatgcaaaaccttacattggctgacaatttaaacttcccttcatgatcattcttctgtcagaaccgctgagagagataaagaagataataataacaaaagaacttcaagtttctggtgattctaagtaggttctagtttcaggagtattccaacacactatgttaccttagacaagtcatgttctctctttgtgattaggtttctcatcaaaaggaaggaaagaaggaagggaggaagaagggactgggagtgttggtaatagataacccttaatatcccattcagatcaaatttctataattataatgtggctctctgcctctggaggtcactcagtaacaaagaaatataactttaaaaatagccaaagtaggaaaaataacaatcattctcataaatctgcagtttctttctttctttctctctctctcttttcttctctctctcttctcttccttcctttctttcttctttctttctttcttttcttttctttctttctttcctttctttctttccctgtctctctctctctctttctttctttccttctttctttctctttcttcctttctgatggagtcttgctctgtcaccaggtgggagtgcagtggtgccagatcagctcactgcaacctccacctcctgggttcaagtgattcccgggcctcagcctccccaagtagctagggactcaggtgagagtcaccaggcccagctaatttttgtatttttagtagagatggagtttcaccatgttggtcaggatggtctcgatctcttgaccttgtgatctgcccccccttgcccttctgaagtgctgggattacaggcatgagccaccacacctggccataaatctgcagtttctacagctactttgcaactatgaacaaatgctagtgtacacagaaaactccctccctcctgtaagcttcttatgcatgccacagactctggcctcccagctgggccagatacatttgaatgctggagcactcagctgattaagatacctaatttctgaatgatcccactcacaccaggaggacagtgtttagagcaagatgttacatctcagttgactcaccttgtgcaatgatttctttttataaatgctaattgcaactcactaattaagagagatgttacactgggcaggaaaatcattgagtcaggaaatcttgcaattttctctagcatatttcatgaatcaaaagtcttgatctgatgcagttttttcatggcctagagggcagaataggagctgaataccacagcttctcttcataagggtggtatggaaatggactcccagtttaaaagagagtcaaatgtccatcctgggagaattagcagagtattgtggttaagggcagaggctttgaagacaggcctggactaatttatttttgcctatggtttaggacagagggtccaagactgtctttttcatcttgtcatctcagcatttaggatagcaaggggtacatagcaggtgctaaataaatgtgttgtgaaatttaagtcctggttctaccatgcataagctgtttcctagggcaccttccataacctcttggagactcttctgtttttttgcttttgtgtgtgtgtgtgtgtgtgtgtgtgtgtgttgttgctgttgtcattattttgtaaaatgggatgtctcagttggggttcctctgcaggagaacctgagaaaaggatttgattacaaatagttaacttgggaagtgatctcaggaaacaccagtaagggaacaggaaagtggggaggagatgggaaagcatccataaagagtttgttatcaagcatttatcactgtgggcaactaaaggaaaatcccactggggtactctggcagccaggatctacacatggctttatgtgtaaacagaagagccttgcgaccaaggggtgagggggctggggcattgatccaacacctcctgttggtcactggttgaggaggcattaagtccctagcacttacgacctgtagacaggcccacaagcaagcttcagtgactggagaaagtcctctggcaaagaaatgcagatgctggcaattcaaaatctagccacctgcactacaggtaagggcaagcgggtctgggttgcggtgacaggcaccaacagggccagcctcccaggaataataaaacctatgtcttaggttgatgtgaggcttaaatgaagcggcggatggaaaggactgattgcgaccctgcacactgtacctccattcactgagggcttcctgctgtcatgagaacatggaaaatgtggcgctccccactaaggcccctggagccatgcatcaggtagaatacagtctcaagggcatcttgagaccttatagatccagagaaatgccacttcctagccttggaaactgacaatgcacattagcatatggaaggctctgaggattcttatggttaagaaactctttaattaaatgaggatttcccaaacttactggagcacagagttctctttccaaataatgtatgccaactttcagtgtaatccaacactccatgaagcacattttgggaaaagaaggcctgagactggtgaattttacccagaaaagcattccataatttccagctcacccccaaaattctgctgacaaatatgtttccttaactacacccaaatcttctgatttcatcttctttttttctttttctttttgttttttgagacaaggtctggccctattgcccaggctggagtccagtggcaccatcttggctcactgcaacctcagtctccagggctcaaaggatcctttcacctcagcgtcctgcatagctgggactacaggcatgcacctctacatccagctaattttttgtattttttctagagatgggtttcaccatgttgcccaggctggtctcaaactcacaagctcaagcaccttggcctcccaaagtgctggattacaggcatgagccaccatgcccagcctcacctccttttttaatgaacccaaacccaccctgatgatttttttattctgcatttctcagattcataatggttttcacgtgtgatttgaaatcatttatgggagctgcatgagcaacttacatcctggagtttacaggtgttgcaccctgcccaaagttgctgagtgctcaccaagtcctgcttctctcagaggcagcattacctaatggacaggagtctccgggcccagctctgttgcttattaactttcccaacgtcatttgtaaaatgagaaaatgtctgttgttcacaggtgatatagttaggctctgtgtccccatccaaaatctcatcttgaattgtaatccctataatctccacctgtcaagggtgggaccaggtggaggtaattggatcacgggggcggtttccctcatgcttttctcgtgatagtgagtaagtctcaagaaagctgatggttttataagcatctggcatttcccctgcttgaactcactctgtcctgccaccctgtgaagaaggtgccttcttctcctttgccttccaccgtgattgtaagtttcctgaggcctccccaggcatgcggaactgtgagtcaattcaacctctttcctttataaattacccggtctggaggattccttcatagtagtgtaagaatggactaataccacaggttactatagaaattaaatgaattacagcacaaaacatccagcactgtgcagccaccaactaatgctcaatgaatgtcgcttgcctttcaaatttcttcctctaaccacccctagccctgattccaattcttcattacttagataattgtcatataaagagaaaatagaatgatgaaatggaaagactgttgcctgaataattcaggccacttagtgagtatctatatccatatagacagctgtgtagctacctctctacaggtaggtaccttaatatgcaatgtccatctgtatctatatagagatacagatatatagaggcagagatatttcatgcaataaatatttattaagcacctgctggtgcctggcattgctctgtgttggatgaaaatactgaataagacagacatgatccctgctcacaagtaggttacggcctagtagtacagacaagtcacatcaagaaacaactaaacaatgaagcaaacaaacaactaattacaaattgcttcaagcaaatgcttgtataaattgctataaaacacacaaattccagtgagggacactttagactgtgtggccacagaggcctttctaatgaggtgatagatcagtggagaactgaagggagagagtgggccatcaggggacgcaggggcaagtgccatccaaaggagcgggttgctgcctgccattgctgaggcagggagaagaagcctggggggtgcaggagaaggcagaagctctaaggccatggcaggctttatgggccgtaaggaggtcttggtttccatctaagaagaaggaaaaagtttaaagaggtgggccacaaaagcagattgaaaaagggttgacattttaaaagatccctgcaaacaactaaagaaaggagatgactgtgagattctcagagaattctttcctgcctgctattgatctccaaaaagtgtgattctataacaagagcaaacattgacagtgagtcagatacctctgtaatcatttttaaatcactcattttattcccacaacaccttacatgcggtggccatggttgtccccattttacagatgtggcagcagttgaggcacagagagcttaaacatcttgccgaagctcacctagcaatgagatgatggagccgcggttgaaatttaggcagtggaactccagatgtgtgctcaccctgccctgttctgcctccctggaagcacgctcagccatggctctggctgcctctcccatgctgcccccgagatttcattccctgtatgcctgaacgtcaacacaagtgtctttcttctcagtcccatggaaacggttcctccaccattacgatctgaactaaaacaataagaagatgctatgcaaaaaatgaacctgggtgagtactgaacactttaaaatgcaagactttactaaggctaaatagaattgaaagctatagcctcagaagagaatgtcacaaaaccctgacacagtgaaacaattacataactaagaagtgaggggaaaggatgggggagaaaatgaaatgtcattttctcttctttcacagcagaaagttcatctgttttacaccaaattaaaaaacaaagttggccgggcatggtggctcacgcctgtaatcccagcactttgggaggccaaggtgggtggatcacgaggttaggagatcgagaccatcctggctaacagggtgaaactccgtctgtactaaaaatacaaaaaaattagccaggcacggtggcaggcacctgtagtcccagctacttgggagactgaggcaggagaatggcatgaacctgggaggcagagtttgcagtgagccaagatcacaccactgcactccagcctgggtgacagagcgagactccatcttaaaaaaaaaaaaaaaaaaaaaaaaaaaagttaaatgaaaacatgactctaccttcatcttttctcctaattgctttctcatattcatatcagcatgtcttaggaggtaaaagttacaaagtttagcgattgcttcatttttctccaatttttctacattcaagtgaaatcacctttgcaaaattatgacaacaagagaaatctgacagagctgactccctcttgcttccaacttccaagctacccttagtcattcctgggcataggccaagctaactttgggaggaatttatagtttaacctttaagcaaggacagtaatagcccttcccaaaactaaattgtccttgtaaaactaacgaaaggccataaggttagggttataagaggtgcctgaattctgctaacacataagcgcagttaaatgataaccagccattgttctggaggtcacagatttgtaacttcctcaattactcttgtaaataacatcactactgtagaactgaagactggccctgggagatgtttttcagacttctggcatttctggcgagtgactgaccccacctggacccaagactcatgactcagccagtcctgtggtccccacccagaggactcaacacgagtggactgttttccatacgcttgtggttttacccccaagcaatcaacattccctgttccctagccccctgcccaccaaaccatcctgaaaaactcctaacctcctagcctttggggagactgatttgaaggataaccctagtcctccagggtggccagactcacattaattaaactctttctttacagcaatactgccatctcactgaattacttttgtctgtgcagcagacagggaaaatccactgggtgactacacaaataagcttaaacttaacagttttattttttaaaaaaacatgtaggccaggcacagtggctcatgcctataaccccagcactatgggaggctgaggcaggcgggtcccgaggtcaggaattcaaaaccatcctggccaacatggtgaaaccctgtctctgctaaaaaatacaaaaaattagccgggcatggtggcaagtgcctgtaatcccagctactcgggaggctagtacaagttcattttatataaatttctgtttgtctaacttatttacttatctactgtacagaaaaatatctagaatgatctttatccaatgtgatcaaatgttttatgatatttgctttggtttgttggacacattcttcttggcattttctgtgttgcttccatttctcttaaatgaatatgttgagttttttaaataataaaataattattttgaaaatacataaggaagacgtccagacttgctttacttgatcatatgaaataaactcctcttcacgctggagcaaaataagagcactcttatcttgggggttttggaagtatttctgtggtttctgggatgcaatatctcagccagaaaaataagcccttcatcctgccttcagcgaggcgagccccacagcaagggccaaagtctaggaggcctgagcatgaggctgcagtgtctccaagccccactgcctttaatgggaacagcgtcctggcaccctctccaggatcacagcagtgagctctgtcctctggtcacctgcgccaccaacaccctgacaaggtcctcctcctccttagcgatgggctgcctcctttcccacagcttctggtgcccccatgggttgggggcagggagggaagtagcaaagaattaagaatcagatccagagaagcatgtggtcatatcaaagaaggagtgtaaatagctcctatacaatgaggtgatcagatctctaagaggctcagggaaaataatcaggaataagtggaaagacagaaatgaaactgaacaaaagaaaacacttttagggagaaggaagtttgaggcaggtcatcatcctcaagaatcttctttgaggcaaaagagctgtatgccatgaggagaaaatgatacaggcagagcaagagaaaaataatgacctagtcattggctcaagattaaaagctataatagaccctttgatcctcacagtaactcctttaggtagtgaaggcaagagctcatctccttattataggtgagggtgataggattcagagactatagcttgttgctcaaggtcaagcagactggtgcaggtgcagcctggaccacaaggaggtctctggacctgatcactcggccatgggagtctcctctctctccccttcccccttttcatggaagtgagagttgtgtgaatctgatattccccatagtccccccctccatgattcctagtttgctcccagctcctctcccctctctagctccataactggggtcaaagccaggctaacttgagaagctgagtggaaatctcatttttggcttgctaagaagttgtcttgagacccctttgtttcatagggaggaaggtttcccagcagaggttaagttttgtgctcaggtttaaggcatgagtcaaggtcaagcttcggtagttgcccaggttttatttcaagggaagaaggagttcaaggtgatagctctctttgagggagggaggaagggaggactgtgtagttgtggatatggtagcctggccagccaatgcgtaagtgtaataagtaatcctcatactctcaccccatgctgcaagaactgtggtaataaccttgagcaacggcacacccttcctcctaacaacacaggtttaggctaaagacattatccattaaaaataaccacattttataaactttgtgttgtgtgagttttttccccattcttttttgaagcaactggcttggtacataaattacactgtgtgctagagaatatatgacacggctgtgaattacaaggtcataattttaccagcaattttagatgctgccataaaccatccaatgtctgagagagctctaatacattttgatttttttcctaagcccccagaatggcattctaggccagctcttaaaagatgcttcatttcttgcttttgttttaggaaaacaatagccaagtaacatcatccgctcctttctttcttttcttccctatagtatcgttgccttttatttttttgttaaattactagcatctatcttagatagatgttccctcagccttcttatgggaaagatgggcttatgtagggctttgagtgagcaaagttcccagagccacaccattttggcccagggcttgcctaaagacataacgaagtgaccttggaccaggtggttctgttcagtctcaggtggaaatgttttccctggtcttctgtccttaccttcttctccacttcaacttaagttacacctacatccttgcttttcccctaattttcaggcctttgttcatttgcaaacacttgccctcagtttgacctgcctattcccccctcctgtagctaacaaatttctacttcagactccaggaaccagccagaacaccacctccttttggaaagtcttccctgggacacgtcaggctgtctcttttctgcctgttcccccagcactctcctgccatattcaatgcaacacactggaattctttacttacttccttctcccccatgaatgagctcaccagcccttgtcccttttcttttgttcattcattcatgtctaaattcacaaaacattcattgagggttccttttagtaacttcagtaagacttgacacagtgcctagaatgtggtaatgggaatgtctgttgaatgaaacaaaatgagctaaaaagaaataagtggatggaggtggatgaatcccaactactgtgcatctgcaggacacggtcaaagagaaggtccctaacagggtaactgggaaggctctcctcctgttcccctgctcttctccaagggtgtcaacggagtaagtcctgccccagagtaaatccactccagttactataaccacgcactgaggatccctcagctgcctccctatatgatcactctgaaatattcacaccagtccacttcctggctccccaaagaaggatgcaaattcctccccctgctcacctttttctcttgtctggaatgctcttggccctccactccacttagttaaggcttttccatgttttaagactcaactcaagtccagctcccccagcaagtccctatggctacaggcacatctgcctacttttaacttatagcatatactacatgtggttcctaatcagaacataactcatcccatctgaatacaggcctaactaattggcgtgcactgagggagcaggggcagaccatagttctcactgctgagggggaatgtgactggttaaaagacctctaagtctagcccaggctatgctatttactacttgtgtgacactgcagacctcttggaacatccttgcccatatctgccaattcagagataacaataacatccatctcacagagtttatcaaatacagtaatgcttacaaaaggttttcacatagttgaacagctgtggaaatgtcatgtcttataaatgcacctaagtaaactcaggcaaccctaataggccctggttttgttagtcattgaggccactccttccatatgttatgttcccttggcactgagcttcctttcaaattaagaattgaattgattcatgcaggtgactcaacaactcataatttagatctgctttcactctcaccatgaaatacacacagacagctgacaccatgctcttgacttacgagcctatttttctaaaaggcccagtccctccaaggctctttcatccactcaatatggtcagccacaggcttggtttgaactgcctgttgatagaaacattgtctgtcggctccatggtccttgaccacatgacagccttcaaggacagatgtgggataaggaaataaataacagctgttttactgacacttgtactcattcattcaggccaaggtgagaaggatgggtaggattcttcatatggactcactggtatatcctagtgagttttgtttaagagacagggtctctgtgtttgtcacccaggctggggtacagcggcatgattatggctctgagcagcctcaacctctttgcctcaagcgatcctcctgcctcagcttcccaagtagttaggactacaggcataagccaccacgcccaactactttttttttttgtagggatggggtctcactatgttgcccaagctggtcttcaacccctgggctcaagcaatcttcctgccctggcctcccaagctgctgagattacaggtgtgagccaccatgcctgatggagttttaatagtagttactgcattgcaccagccagatatttcatctgagaaaagtcaggcacactaggttccatcattcaattactatcctattaagctgaattcagttatgagtgtgtttagagatgtgcatgtatcttgtagtcaacgcatggataacatgtgaattctatccaaagcaataagtgctctgcatacatttaaatgcatgtcttctcatgtttactcttctgtagtattatttaactatttattcatcttttgttatattgacttatgaaagactttgaactcttgttgtagaaaaggtatttggaattcccatatctataactagattaagctactctaggctgaaattgtgtcttacatttcacagtataccatgcacaacaagcagagtgctatgatccatatgtatctattgagtgaatcatttattaatctcaaattacatccccaaatcctgttctttccttcctttgcctttttttcctagatatcaagaagcacactgattctagttaagtagttattactttgagctcagttaaagatactaaatattggcactcttggtggcccccattccaagcatccttttatgtaaaagaactgtaatcctatgagcaaagacctgtaaaactgactgcagctaagggaattatgcccccatgcagataatgctgtggaccaaacagttccgataagcaaacaaaatctctcagacaattatgttcttgtttaaggccgtttgccttggaattcccaaaaggattctggaggattgcaaatttgctggggatgaagaaagaaagtactagctagagtttaatagattattggattaagacaggccagaaacagtcaaacaagaaaagtattatgcaaaaccttctaaggttctaatctcaccttatttctattttgattaatattttcctgggaaagaaaagatgggggtttttgttgttctctgactacaatccagagataacatctttgcctccagttttcatcaagataaagacctggaagacccgagccaaaaggaaggagctggaattttttttaaatctttctttctggtctttaaggaagttatctgaaaacccactggtactctccaatgggtaaagaatgagacagaactagcagaaagtgttaaagcattagacaggcaaattaacttagagacagtgggagaatgattccatctccattgattttccagtctgtaaatatgaaatgctggaaggatacttgtgacatttggaaagttttatctagaaatctccaattaattttagagtgcatagcatacatcaattaaacagactgcggggttcatatttcctacacggtcgtgactcatcctcggaagatctgacccatcaaggataatgatttcatcttgatattggtgactaatatttctgtttgtatgtccagtgtctgctacagagcctgacatagagtaagtaaatgctcaaacatatggataaatgaatcaattaaaaacctcataaaatctttaccctattaatcttcctcctatagcaggggttggtaaactacagcctgtgagacaaatctggccaccaccagttcttgcacaggacaccagctaaaaatgttttccccctacattttaaaacagctaaaaaaattagaatattttatggaatatgaaaattgtatgaaattcaaatttcagtgtcccgaatacaattttattgggacacagctatgtccactcttttacctattgcctatggctgctttcatgccacagaggcagagttgaatggtggtggtggagatcatacagcccctgaagccaaaaacattgactatcaggccctttatggaagaattttgctgacccttattctatagaatggaacttgggaacccttatcatttgtcattcattccattgttcactcagtggctatttactgagtatctcccatgcgtgcagtgctctgtcccattctggggataaaacagagagctgagaaagatccctgccttgatggaactcacagtctgggtctggagcagcagaaagaggctcatcaagtaaccttccaagcacctttgcaatcacaacagtgaggagagctaagaaatggtacatggggtaagcttccatgatgtactgatggttatgctaattactaaagactgtcaaatcaggacccaaattgtctagtgccaaggtggatgtctttgctccttcctttttctgccctgagacactcttcattctcagttgggtttcccttttagaatgacctgtgacatgtgtcttctcctcatgtgacactcttcctctttctaaccccagcacctagaacaaagcctgacacacgggagacactcagggcatcactgttgaacaaatgaaagaattaattcattaggagaagaaatgtaagcaaattcctgggcatccccaggccccagttttctcatcagtagaataagaaggatatgatgtactcaagcctcccagctcggcattctgcaatttgtcatgtcctgagagctggactcatctggctttctgattcactcctctctgtggacataaggcagactccctctgactcagcagcctgatgcatcttcctgagtgacacatgaactctgcccaaggcaaggcggccagccccaatccattccacggatcactgctgacagtgaatgggagtatacctgggggttttagccaaggtctgctcaaggtctttggcataaagggaggccaggttgaacacacaccagcaggaagagagatgaccttgacttcataaattggccataaattagagctaagaatcaggaagattctccttccatgcacatttctaaatggcagtttcaaggcaggtggctattttaaaacacagacacaaactcataattcaccctctttgtcccccaccctcctacatgccattgatctttcttttttttttttggaatcctgaaacatgatctttaagaaaagacaactggactccaggattacttcctagctcttcctcctctagaagccaccatttctcttcgctatctagaccccagggaagtggctttggcaaaagcacatttgcacccatggatcatttggttttcttgtcctgttaactgcctggttctgcagcacccagagccagataatagaggtgttccttcaccagccacagctactatcaggatccctcttagtccggaggtaacagaagcaactggttgaacgtgtttcctcctgggaaatcctaaatgttccatatggcaatagggaatctagagttgtgtttctccttgtattagggatattttccctctttcagtttcttcccattttttcccatctaaaatatgttttttccactttgctgagatgaagaccagccagagagtcaaaggaaatgacagacatgccataatagaaagaaaaaaatacagacttctgaagaatgagttgattcatgccatgaaaactcacgataaaaatattcactacttttttttggccacttgtcatagtgtgctgcctctgctaggcagctgaaagtgtctcatatgaaaagctctattatcctccacagaaatgacctttgggacccacccaacggtagtcaatggtaatattatactaacttgccccccaagaggaaagaatgaaataataatacttaaaatatgaatgcagagaagtcctcacttaaacacagtacttctggttcataaatcagttctgacacattgaagtacacatatgatgactagacgcaagtttattaacacattttctttctttttaggtctgagaaacatatctattcagaatccatacatttgttcattttttgaagctgacagcttgataggcaaaaagtaaagtgacagatcatttcaatatttcttttaaattcaaaaccaattcagtcaaaagaccgaaggaaaatattctacggagataaaatgataatgcaaacaattgaagacagtcctttattttagtgaaaacaggtaatgtctgtactctggagtcgggctgacttcctcctcttaacctgccctgcaagtccaattagaatggttttctgcggggagttgttttccatttatacttagcccgaacacgtatacctacttttcaaactcttagctattcacttgacatttgtcttcttcagtcttcactaaatagtctttggaccctttgggagtcttataagagttattttctgaaagttaaaaacgtaggaccttatttcggcagaggttaactaaaccaggcttcaaagaggattctgagggcgacagccactataatgtccattcctactttccttcactaggtggcagcacgtcacaacacatttttcagaacagtctggggaaaatgcagttgagctaaagtgaggttggggagtctctgcgggctatgggaggaggatacacattagggcaggtcagtgcatggaaaagctggcgacacttgtgtttcctataggtcccctttgttcccagtggagctggggcccttcgtctctaacaaaccagaagtacttgtactaatggaagggaggctatttatttcataaaataaatataaacaaacaagaaaattgaaataagaagtcctctgaccatgtgcacgttgctccagacaccaaaacatgagaaagcacttctgacccagtttgtaaattcgagttatagtattttacgtttgctaaaatattcacctaccacagtaagaatttttgtttatctgatgcaacctgtttggtgttataggcagatgctaagttacaggctttgtggtggatactgggcaacagatgtggtaagaaggggagcagcccaagatgaaatttcctccaaaacaccagaggttcctgtctcaagcagagaaatcataatactgcaacacatactagtttgcaaagggcaagtcgctatggccaaaaatgattgattcagaggaagaggaagggaaggaagaagaaagagaggaagaggaggggaaggacatggaggagggaaaagaaaaggagaaggagggagagggagaggagaaggaggaagaggatgaagaggaagaagaaaagaaggaggggaggaggagttttaactgaatactgtatttttgccttaatgtaggaaagatgaaggggagaaggaggtaactgctagtggacattgagaagctgtcaatacagcaagaccttgccaaaggttgatcaatagcctctttttaaaattaatacatagtagatggatgtattttcagtgtctatgtgataatttgatacatccatattgtcaaactagggtaactgggacatccatcaccttaaaatatttatcttttctacatgctaggaacattgaaattattcttttgtagctattttgaaatgtacaattgattcatgttaacttgtcaccctaatgttaactggtcaccctactgatctatcaaacaccaagtcttatttcttctatctaagtgtatatttattcccattaatcaacctctcttcatcctcccctccttcctacccttccctgcctcagataactaccaatctactctctatcttcatgagatccccttttttttagctcccacatgtgaatgagaacacgcaatatttgtctttctgtgcttggattatttcacttaacacaacgacctccagttccatccacggtgccacaaatgacagggtttcattctttttcatggaacagccttcctttgaagagagacattcactctcctgctagagacagcctccacctggcctgcttcacccatttgttatcttcttgtccctgtaagcatttgtgtttgcaatctggggtttatagattcatctttcctatagtagggctaaaatatcttagtttaaactccaagcctaggacaacagctggcacattacacttgttttaaggtttgttgagtgaatgatgataataataaagatgatgataataatgaaaccggcaatatttatgaagtttcttaaccagggcagagactagggtaagacagtgatgcatccagggaacaaaattgaaaggcacgctcattttctttttctttctttcttttttttttttaattttgagacaggggctgactctgtccccaggctggagtgcaatggcatgatcttgtctcactgcagcctcgacttcctcgagcaatccttccacctcagcccccaaatagcaggaacttcaaacatgcagcatcatgtctggctaatttttgtattttttgtagagatggggtctcaccatgttgcccaggctggtctcaaactccaggactcaagcgatcctcccacctcagcttcccaaattgctgggattacaggcatgagctgctgcacccagctgaggccctcgctttcagggtcacttgcttcatcttgctcctagcctatttataacataggccagttttctttacatgatttatctcattggtagggcttttaaacatttctgtctctcatcacatgtatgagttactactaaaccgtgggtatatagtagtaattaaaagctcaggcgctgagatcacaaagatgtgagttcgaattcttgctgtatcacttgctgaagtcatacagcaagtaagacaggtcacacaggtcacctctccaagttccaagttcctctacctgtgtgttaggattaaatgagataggccggtaaagagctttgtccaatacctgccacaaaatatagtcatgcattgcttaatgacagggatgtgtcattaggcaattttgtcattgagcaaacatcataaagtacacttagacaaacctagattgtatagcctcctacacacctaggctatatggtatagcctattgctcctaagctacaaatttgtacagcattactgtactgaatactgcaagcaactgtaacacaatggtaagttttgtgcatctaaacatataaaagatacagtaaaaatacatattataagcttatgggaccaccattgcatatgggaattgttgctgacagaaacattatgtagcaggactgtacatagcagctataataataataacaataacaagagcaaaaataacttattttattcctattacatttataaggatttcagagaaaaattcatgttcaggtcatcaaaattgattagtagctattgtatgcaaaacatagtgccagacatttagaggaatataaaagaatatataacatagctgcaaatctagaccagggatcagcaaactttctctaaaaagaaagataataattttttaaggcttttttgggtcctatcttcttcatgtcattgccataaacaatatgtgaacgaatgaacatggctatgttccaagaaaactttatttacaaaaacaggcagtaggccagagtggctaactcctgatctagttgatgagtcaggacaggtacatgttacttataaaaacacaaccacatcagaagatcacccatgatcaaaagagtggctcagactatagtggttttggaagaggcaagtaacaggataataactggttgagtgcaggtaagcagagaagacaagaaagcagctgctagacaagaaactaccaaaaccatggcgatggaacatatctgagattgggtaggagtggttggtaagtaggctggctagagtgaaaatgggagaaattcacaaaaatgcaaacagggctggagaagaaggctaggtgagaatataaagaaggaagaccatgagactgagttttttgtttgtttaatttaatttaattttttatttttattttttttttaagatgggatttcactgtattgcccaggctggagtacagtagcacaaccacagctcactgtagcttcaacctccaaggctcaagcaatcctcccacctcagcctcctgagtagctgggaccacaggtatgtgccaccatgccgggctaattttttaaaaaaatttttgtagagacagggtctcactgtgttgcctaggctggcctcaaacgatcctcttgccttgggctctcaaagtgctgggattacaggagtgagccaccacactcagccaagtttttacaaaaaggaagtatctgctgtgctcccaatctggccagtgaggtttgcaatccactcaggaaataataagctaattttaccctttatgagctgggttgctaaattcctacctggccttaaaggggtaagtcgaatttagtgattgtgatatgggagcaaagtgtcaccacactagtgtttggcatttatttcgagtgatatagtgtgtcttatgaaaaatgggccaggcacagtggctcacacctgtatcccagtactttgggagaccgaggtgggcagatcacttgaggtcaggtgttcaagaccagcctgtccaacatggtgaaaccccatctctactaaaaatacaaaaattagctgggcgtggtggtgggcacctgtaatcccagctacttgggaggctgaggcaggagaatcacttgaacccaggaggcggaggttgcagtgagccaagattgtgccactgcactccagcctgggcaacaatgcaagacccaatctaaaaaataataataaaaataaatttaaaaaaaagaaaaatggagctctgctcaccacctatcatctgttcttactctcatgagcaggcttgggcccaggcctgggcatctcagtgtctgcaagtgagatgactgggaaagaagatttgttcaaataagtcaccctgctattggagagaggctggaccctaagagagcccttccctcgaggagcgggctgagatactgtatccctgggagaaggttggaggtgaggctccatccctgggagaaggtcggaggtgaggctccatccctgggagaaggtcagaggtgaggctccatccctgggagaaggtcagaggtgaggctccatccctgggagaaggtcagaggtgaggctccatccctgggagaacatcggaggtgagactctagggatgagttagaaatttggcctgggacctccctccgcccctctccttccctaatctccaacacaccctgtatctattttcctgaatgagttgaccctatcctaatttcagagagtttaggaagcgatatcaaccaaattggctctagacaaaatactagtgactaataaagtcaagcaaaggtgctcattcttactagtaaccaaggacttggaataccttagaaggggattacaagtggaagatccaagagctatgggaaaagggttctgctgttcaagttgaaattgtaatatggaatatcataggatgagtatatctcaagatgtaaatgactcagattttaatctcaaaaacatatgaaataaaggattacattaataagaatactgatatttaggagcacaaaatagcaaggtttactctaataccagaatcctggaaacttgcatagcagctacaactagaattcaagttcagcctcaccgtgggctggaccagcagatctcaaagtgtggcccccagatcagcagcagcagcatcacttgggaatgtgttagccatgcagatcctcaggccccatcccaggtgtactgaatctgaaactctggggatggaacaccccaaatctgtaatttaaccagacctctaggtgactctggtgcactcaaagtttgagaaccactggtctatctagaatacatagtgtgcttgttccaaagcaattgtccttaccacgacccaaagagcctcacagaatagatttcggaaagtacgtgtgcgtgtgtgtgtgtgcgtgtgtgtgtgtgtgtgtgtgtgtgtgtgtgtgtgtgtgtgttgaagtttctcaggtattcaggtatgttcctctggtttaagaaccaccactgtgccaggcctctcaacagtggctgcacaagtgaaattattcagagaacttgaaaacattctggtgactgagttcatccccaattctcatatgcttggttagaaatacagtctggccaggaggacgtgtcagagttcctgggtgattctaacatactgccaagatcatttagcccatagaagaatcaccaggagaatttgttaaaacagattcctcagccctacctttcagagattctccaggtttagggttgaactccaacatttttatttctattaagctcccaggccatgtgctggcttgcagaccgcacctcgagtagtcctgctctaggagaaacatgtttatattttagatacctgaaatcttctttgggctgggatggccaactttcctccatctgttcctcctctaaattcctataaacttactgttctttctagaggacactccaattaagttattaacatcttatagaggcaagatctatgttttccccatctttgggtcactcctagcacctagggatttgcacacagtaggtgttcagctgaataatgcagtcgaatccctgagctggtttcaggtgttcattttctccctatctgatctgctagccaggtcaatccattatggccctggtctcatggaaaagaatcaaggcatctattttttgaagatgatgtgaaggtaaatatacgtccagtcctagagatttaggttgctgaggaggctgttccaataataccccagatgaagtacagccatctggagaggttttggcatccatgcaaacctactgctgaattcgttccttgaagacattcattttaggatggtatttccaatttggcatataacagagccatgcaaatcaatgaggatttagaatctctacttacggagggcatcttatttaaagcgtgtccctgacaaagcaatatcaagggaacacaattggaaatctcttggagaggagtaatttctctagaagcagttttagctatagcagcgaccggaacagcaatgagctccctgaaatacatccaaatttttagtattccacttggctgggctgccttcttcagagcccaatcatagggacagaacttaataatgagttcatttttcttgtcacactagagcaattcagttgcaatgctattcataaggtgtatgttgccattgaattctttctcaaaaaaaaacaaaaaaaaaaaagctcaagccaagagtagagccccatgtcagtctatatgcgctaacaaaataccttagactgggtaatttataaacaacagcaattgattgctcacagttctaaaggccggaatgtcccagatcaaggcgacaacagattcagcatctggggagggttttttctctgctccatagatggcactttcttgtttccctgcatggtgggagggacaaacagcctcccaagggcttctttcataagggcaccaataccattcctgagggctccaccctcatgatctaatcatctcccagaggccccatctccaacacgacggcattgggatttcatttcaacacatacatttggggcagatacaaacattcagaccatagcagcccataacatctagcatgatactatttcaacatggactaatggtaaaaacatggattgtttttatttatttggctacttgtatagaatgggtcaagaagctcagaagaggggactggtgaacatgggggaaaaaagtagtttggaggctggtaagttattaaaaatgtgttaacttgtagcttgagagacagcatagtatcatatcaagtaacatggactttggaggtagattgcctgagatcaaagctgagctctaccatttactcactaggtgactctcagcaatttatttaaccttctgaagcctcagtttccccatctgtaatatgggcccccaaatgacacctatttcatagtactgtttggaagagcacttgagacaattatatactgtatgtacatacacatacatacatatatatacacatatatgtaatatgtgtaatatgaacacatctaactttattctagttatggaagcacttttcttttggatttctctttctctcaaaccccccaacccccactctcctaaggacacctggcccaaaaagggaaatcatactttttcttttctttatttcactattcttattctaaagaaacccacagactacagacagcagtttacttagaaggctctgggcttcagggaatctagatgtccaagttgaaagtcagctgcctggaacatggagtgggtgacctctgggggcactcaggggcccttccttccaggcttcgggcactgtcactgagaagcaactcccttgggggaggggtgcttttggtcatagcggttgagtcaagttatcagatgtcaaatagcttataggagttcaaagtgagcctatctccaccactgctaaccacgaactgcccatctgagcatgatgaaattggcccccttcccctctccccttgctacttaattgctcacaaatccagcaaattgcaggaccagcctctagggggcaccagagacctttcctttcagagcccaaaatgccatttcagtagcagcagagtagtgtgtcctggagctggagcatggtccagtgtctcttgtgctttttggcctactgagtccttaagtatatttaatttaatttgggtagggtggtagagggttccttttaacagtgtattcatgatttctctagcatttcttcaggaaagttatttatttcttttagatatagaatttttaccattggtccattcactcaaaatcacttcaaaaaacatttgctaagcttccactatgtgcaagagtgtcctgggcatacaaaaagtaaaaagccatggtgtgtgctgtcacagactcattctagagcagcgtggtcccacagaactgtctatgatgatggaatgttccacatctgtgctgtccagctccgcagccaatgagccacatggggctcttgagtacctgaaaaacagctggtaggatggaggaactgagcttttaaataggcaaatgtggctaggagctaccatactggacagcacagtgtattagtttggtgcaaaagtaattgtggttttggccatttttaagtggattggtaagcctggctatttaaagtgtggtccacagagcaggagaatcactacacctgagagctggtggaaatgtagatctctgacgttagcataggcttcctaaatcagaaactgcattctaacaagatctcctggtgcttctcatgcacagtaaagtttagaaagttaggagatgcatacaagtggttctcatcctgactgcacttcagacacaactgagaaacattaaaagaagctgagcctaggtcacaccctccacccagagattcttaggttaatggtttaaaggcttggcctgaacatgaagagttttaaaagcactctgggggattctaataaaaattcgagaaccatcccagcataagtcagtacggtggctccaaaactggagatcaccaggagtgcttgttaaaacacagactgctggctccaactcgcggtttctgatccctgggtctcggttgagctctaagaaccctcatgtgtaacaagtccccagtaacgctgatgctgctgatccaggaaccacactttgagaaccactggtctaatcattttaaaagatgggctccagaattggactaacctgagtcttggacctgccacttacttagaccctgaacctcagtttcccaaactgtaaacttgggctatgaatatttactcatcgagttattgtgaatattaactcagagaatgactgtgagatgctgggcatagtgcctacttttaataagcaatcaataactgttccttactatcatgatcctaagaagactcactcattcattcattcaacaagtatgaactatgtgtcaggcactgttccaggtactagggacatagcgaaaaacaagggggccacagtccctgccacattgctatcatggaagctgcagtcctacctgtcagtacaaagcaggctgcgtatggtgctcctatagcacgaatcctaacagcacaatacaaaggtcagagaggaattcattccaatggatgagaatgggaaagctgcacacaggagctggagtcagagctgtgccttaatggggagaaggattacaacctgcagagtcagggcaggaacttactcatgaccaggcacagggcagagacagcaagaagatgcagctagcagcctagtggagctggggcaggaagtacagggaaaggggaggcaggaggcagggctgtgcatatggggatgccaaccagggtctgcctccactctctggccaaaccatactatttgtgtttgtttaaatcccaaacactgaaaattactgatgtcaggaaactgaaaccaggccacagctttcattcttgattattcttaccaaatgcagaggccagtcaacagaaggtccagagattcacagaatcatcctgaccctgcctgaaggtggggcggggctcttcagccaagcaggtggccttgggcccagatgctccattgaagcagaggaacagagagatgcttgagacttcagctgagccctgggtggggtaaccattaaaaggaagagtggtgtgctgaccccatccaccgcttcccttaggaaaatggtggcctaccaccacaactctttggtctcatttgggtttctctgtaaactccagaaagcaataaagcatgattcctaaaaaagagggctactaggtggaggttatgcagacctaatatgttcccctcagtcactgcagctgcacaggaaggggcacccaaacctcagagtaagttgcgtaagaacaacagacaacaggcaagtctgtctagtaactcacctgttcccatgaaaagaaaaaaaaatgtcactccatgcaaatgaggggtgtgggagggtgttgagcttcaataaggctctccccaacggtctcctccctaacaggctgtaaaataacatgaagcatggccccaaagggccgtgaatgacccctggagcaaaggactccaaaaggctctgcagagcttttggcacatctgaacaggggcccggatcccagcgcaccctcttctgggctctgactttggcaagttactcaacccctcagagcctcagattcctctttggaaataataatgggaataataatatgccccttttggtaggcagaacgatgaccctcaaagatgtctgtgttaatcttgggacctgtgaatatggtcatctacatgccagaaggaaatgaacgcagcaggcaaattaaggttgctgataggctgacctggagatgggaagagtatcctggagtatccaggtgggcccaatgtaatcacaagagtccttaaaagtagaagaaggaggcaaagaagagatggcaggaagcaagatcagagtgatgcaaggtggggatgcacccttagttgctggctgtgaaggtggagaaaggggccatgagccaaggggtgtaggtggcctctagaagctggaaaaggcaaggacatggaatcttccctagagcctctggagagacccatgttggacttctcacccacagaactgcttggaaatagaaaacttctacaccattttgcaaggttgtgaggctgatgcttggcactcagcaaggcctctctctttcttccttccttcctttcttccttccttctttcctttcttccttccttctttccttccttctttcttttctttccttccttttattttccttccttcctttcttccttcctttccttccttgcttcctttcttccttccttcactttcttccttctttccttccttccttctttcctctttccttccttccttctttccttttcttttccttcctctttctctgtttctctttctctctttctgactttctttcttttcttttcttttcttttttcttttctttagcagggtcttactatgttgcccaggttggtctcaaacacctgagctcaggggtcctcctgcctcatcctccccagtagcaaggccactttcttctctaggctgttattagcttctgtgggtacacaccatgctccacacatactaggcttcattctccctgtcttagcccatcattgcagcctccactgagccccagcctctcacagaagcctatcctcattctcccacccacatgagctctcactcctctgaactcccatggcctttacagcctgtaccttgcaattacgggcttaattatatagtgggtagtgttacctgctgtcactgcatgtgtgtttattttggttccaaaatgagattgaaactttagtctcaaacaggaacaatgttttgtccttttgttgttgttgtttttaagcacctgtgctttttttatataatcctgtttttattgccttctgacacaaaaaaaggactattttgggcatatatttataagcagataccctacatcattgcaactgccctgtgattgggcattaactcatttttctattttctagcagagtttactgaaggttttaaggtttaaggtctaaggccagttctgatacagacaatagaatcaagtttatagttttccaatcatggttccaatgaccatggtcccttatcatatgccgatttcatcagtcaaagaacaggggatggtgttggaaatcacagtaccagtaggatacagggtggcccggcatgtgttcctctcatcccagtgctgagcacacagtaggtaataaaaatgggctagaaaactggctggtgagtgcatcattactttcctcctactcccttctttaaatcctacaagatcaccctcaacaaaaacatacacacaggcaaggtgcagtggctcacacttgtaatcccagcactttgggaggctgaggcgggtagatcacctgaggtcaggagtttgagaccagcctggccaacatggcgatcccgtctctactaaaaatacaaacattagctgggtgtggtggcaagtgcctgtaatctgagctatcggggaggctgaggcaggagaatcgcttgaacccaggaggcagaggttgcagcgagccaatatcgcaccactgcactccagcctgggcaacaagggcgaaactccaaaacacaaaaacaaaaacaaaaaaacatacacacaaacagaggcagcacagcccattgacctaccttggggatacattcccaaaagagaatgagacagacggacatatgagttctccttggagcatgttattcaaatctcaaaataagataaagctctcatttcaaggtgcatttattttagtgaggtttggatttgtaagggaaacaaaatgaataagttggtgggtggggacaggaattaaaataagcagcgtcttgctgcttgccgacatgactgtcctcacatccgctgccttattttttattctgttctggtttgttttctcctgcggtgctttaaaatatgatgggtaggttagaaagagagaccgaggtaatcctggcttctgttcattaagctcgtatgaagtacgtgctgtgctactcacattacctcggtgaatccctatgaggtgggtgctgtaattagcccattgtacaggtgagataactgagcctgaggcagataaaatgctcatgctgagcgacccatcagcaaacagtttagccaagatgtggactgagttggtggagctcagagctgagctttaatctactctgcgccaatatccggggtgttcttaagccccagtctctctgtcccagatggagcaggtcggatctccaagctgctgaggggcactaggactcgggagacaccaggctagctctgcattcttctggtcctcctggcatttctagaaactggaggtgggcaaggaggagggggaaagaggagccaggagaacacggagtcttaaataagatctcttccctctcttcctgcctggagtgaagccctttatgagtaagcaccgatggagggatgccaacacaacacagcaaaactagccctgtcattcccaacccaggcctcacaactccaaatcattcaaggggtaaggacacagaaagaagagcagaggaagagtgtggacataaagtcagaccacatactggggaatgcacccctcccaccactcccaggagatgtgaccttggacaagataatctctcttagcctcagtttcttcatctgtaaatggggaaatgacaagtcctgcctcataggtttgctctgaggattaagtgagtccgtgtctgtgaggggctttccagagtgcccatcacacagtaggagctgactacatagtagtgtctctatgagtacaccgttacatgcactaggatgatctgcacaatgaatatattctgtactatacaacacgcaatcatatgccgacaattgaaaactaaacacggtgtggggagcgttctgggacaggtaagggcagggaccctgcattcactctggtttttatctcccacagagccagctaccgcacagtcctgtaccctcagcagggccaggaaagtttgtgcaggagaatggggatagacttcggtttcctgcatcttatcccaaacctcagccagaaaaggcagcacccttccactttccaggagaagggcagccatgcctgaaatgcccctatttaatgggattatttcttctcctttataagtcatatctcatgggaatgttcattttctctctggaagctcattggtacaatggttgtttcacaatgtaataacccatgtattaagtcagatgagaacctccttgaaatattattgtactgaattctcttccataacagggagatcagttttagatttcacccaaggagatttcgctaccaaagaacctaaagcatttcattaaaggtgctttctcctacaagaggaaagaggtttttttatttttgttattattatttcatatcccaaaaggttattgttctatgtgttcaatttcaatagtacttatgcttcctaaccataccgtatcatttacttccttattaggttcagtgtttcctgctttcccaacactgcagtataggagggtagggggataggactctatttcttcactgttgtttcccaatcatctggaatggtacctgacatatagtagatgctcaataaatattaatatacaaatggaagcacatttagagcacatttcttttggaaagcgaccacagttgatacaaagatgtatctcattagaaattcatttccacctcttttatttcctattcaatttttttcacccccattctgtgtttgtgccaatagattttttatgagatcacaacatatctccaaaaatcagaattaaatcatccacaggaaggctatggatttcaaagcataccagaactcctggccctaaaatgcttcagggaacgtgtcactcaccacaaggaagctgggctccacacttttaccgggggcatgttctgctcactgcagaggaggatgtctccaccacagtcaccagggagcccttccatcacccaggcccacaggggaccaagagacaatggacactggcagaaagtgcagattcatgaagtgtgaggactagaaggtaatttcatttaaacccccattcttcagatgagaaaactgaggatccagaaaagcaaagtggttgttcgagtgcacagggtaattaagcacagctcagtgaagaaggcagatcccacctctccccttccccatcgatttccctgtgtgtgcatgggtatgtgtttgaactcttagcaacaagatgttttaaaaggagtccctgttaacaactcatccataattttgactcaggggtgctgctgatagaattctactagcttccctgtccaccccaatgacctagatcccaaatttcccattaatgacccaagaaccttaaagactttctgagctaaaagattcttcgaagtcatctagccaaatctttatcttacagatgaaaaacaacaggctaggtaaagaaaattgagctcccaggtcacaaagccagttagcagtgaagctacagcagctgggactgctggcacccagggccacgtaagttacactgaggacacttctcagatttgtgtgtgactctactagcctcatcaggataaggagaaaataaggaggaatcaggatacgatacggagaaaataaggaggaatcaggatacgataagcaaaaaatccagtctaaccaagcatatctcaggtccaaaacaaaaacttttccttagagcaagagaatataattctaatgagaaaactgtagcaaaagaaatctttttaggatatggacacatacatatatatatatatgcatgcacacgtgtatgtgcatataatatagagattaccacacatactatattaagaagatgcttattttttaaaaaaatacttgacactaggtatataataaattcccagtgctagcaatggcatcaaaatggattgctagcggaagcctatcttgacacaacattttttaagttatccatcaatgtctgcacaaaagaaaatacacatattctttgaaccagcagttcctcttccaggaacctggaactattgatagaattagaattatacaaatatatgaataacagtgtttattaaaccattgtttctagcagcaataaaaggaaaaggaaaacattcaggtggtctatcattagggttatggctgaatatactgcgatacaaacaaattatggaattttatgcaactcttacaaaatgagttatcacagagctgacggaatgtccatcatgattagttaggaagccaaattgtggtgcaatgtaattatttgaaacaatttcttatacaaacaccaccatctctaaaacactatcatgtgtgcacatgtgaaggcctgggaaccgtgggtgtctaaaggaggaggcagtgatggaggcaaggggaaaagatgatgaatgctctcttcacacatctttgttttcattgattacaatgcatgcatattactttttaaataattaagccaaaaatcctaaaaataaggacagaaggaacccacaaatagtcctccaggttctgtttcggcctgccttcttccctagtagaccccatgacagcaggaatactctgaattcagggaaaaaatgaaatcaacgcagcaatgagaaacttgaagctgtctctctaagccctgggcttccatgactatcctctggtcaagttactttctccactaaagtgttctagtcctggtccaggaggtgccctgtacagtacagcccagcagcactctccccttaacacagaaagggacctcagtctcctgtaaggtgagagatgactcaagaagcttcatctctccctgccctacaaagaaccttgtacctataaatagaccatgcagaacccactttttggaagcagaccaaagctaactttggcaggcaggcctctggggtacctgagccagccactcggaaagttggccttacccccatgggcttcttaatccagtcctgactctaagttcctgaatgaaaagtgacagaaccatgaacataaaggccctggctgtgacagtgatgaccactaggctttgacaatgataaaactgcactgcctgaagcgcaaactgtgcaaaccctttggggctagtgctccaaagagagctgccaccatcaacttctaaaactccaagagcccgttgttcacattaatacatacaacattgtttgtagggagacagccccctcatccactgcaaattctgtccttcagccatgactcaggaaccaggaaggagaaggaaagagaggctgacttaccaagccaacttctgtttaagtacacagacacaaacacggggggcaccgtgaagaaatccactacagagttcacttccagccagaaccacaatttatcgttggctgcaataaactgggggaaagaagaaataagaaagagaaaaaacatgagaagcatggtgctggcatccaatgtacactcttttgtcaaagggtaagttttgagttttcatagggccaccacgcccggctaatttttgtatttttagtaaagatgggatttcaccatgttggccaggctggtctcgagctcctgacatcaggtgatccactcgcctcagcctcccaaagtgctgggattacaggcatgagtcactgcactcggcctatttctatttaatttttaaggtctggagggagacattatgtccttctcatatctacacaaagcacatgcttttatgattggacacacacgttttctagtgccccatagagagccctatatagactaactatatgctatgctagtcttaagagaaagatcaggcagtgtatttttctgtggttcccaacagcttcatagggaagattgggtgattttacttgtattagactcattcatgtaaatataactataaataaagcacatatgtacgcattcacacacacacacacacacacacacacaaaattccatccatctactctcctcaccttcctttcattcatactcacaactgctctctcagggctcagctaagtgaacactgctaaacgtaattttaagagctgaagaggtttatttctatttacttttgttttgttttatttttttgagatggagtcttactctgttgcccaggctggagtgcagtggcgtgatttcagctcactgcaacctctgcctcccaggttcaagcaattctcctgtctcagcctcctgagtagctgggattacagatgcccgccgccacgcctggctaacttttgtatttttagtagagatgggatttcaccaggttggtcaggctggtctcgaactcctgacctcaggtgattcacccgcctcagcctcccaaagctgggattacaggcgtgagccaccacactcagcctatttctatttaatttttaagggaacagggcattatgtgaatagagagatgagaaacaatccaccggtggatacatcatcatttttcttcaatccctatttctcccccttgaaacaaaactgatgtgaattccagaaaatgcttagctaaggagagggctctctctcagactgaaaatcagaatgcgggtgcgctgtttctcctggaaatatcttgactgcgagagcagaggctgagggggatgatccctgggtcccagactgaaacaccccattgtgatactgaacaatgttgcacaaacttacccgcaagccgaagtagagaaggaagaacacgttgaaagccatgtcgatctgtaatgtgaaatctttgtagaaattctggcaggattctattgggctattagacaggaagaagaaaaagcaagaggtaaatgacaggtagtatcatcctgtctcccacgatgctgagaagtggtagtgcttagggtagacgatgaaatgaatattcataaaagaaaacatttggtctttctgcctcctgggatcatcaagcaagcattgccaaggggtctttccattcaaccattcaggaactactgttcttttatttattgttttcgaaattattatatactatcattttttatcatcattcagcagttgaactaagaatctaaagaggatcatgcagataccctggaggaaggacaagcaggagaggcctccaaattccttaatttcatattaacccttaaagaacttctttctttctttgagaggacacatactaaagctaaaacacagttcctcatgccctccaacgcattggcagtggggcctgttttcaattaaacacagtggttgtgttttggaccttttaaaaaccattagttgattaataaattcaggacccaggagcatctcaagaaagctagagaggagaggatcctgggtgaggttctggctagattaagcacagactttctgtgcaggactcggatctggggaaagaagcattgtccgaccagtcaaattcagaccattaaaccaaaaggttgaagcagtactctaagggttaattttttttttttttggcatgcatgctaattgacttggtgtgtgtgtcgagcagccaatgcaaacccctagcacactctacttcaagagtcgccagttcaaaagggtactactatacaaactggtacaagacttctgtgtgctttcctgtgtcaaactgatcagaggatcagtgtgtggaaagtcccaaggtttgggctgggtgggaagtaggaaagcctcataaacactcaaagctgtgaatggaaattcacatagtattctgtgatcagtaggtaaatagtaacacccaggccaggaacgtgaaggtgaagtgaggtgagggaaaggagacagaataccaagagaagcaaaacactttagctaaagggaagcgacagacctcctccctccaggagagggccagcttgagaaatggaagatgaaggatttcctagtagtgccactttggaaatcactgtgtgcaataccagttagtatagttgcacttctgtaaggacaacgcttggctgttcaacaggcaggaatctgtgcagtagaggaactcggggcccacttagaggcagggtaagttagtctgtgggaatctccgatcatgttccatgcactggatttatccattcttcatctctgctacaagtcaaacatgccctatatcatctcccaaatcacgtggaaaaatctccagacaagcattaagagtaacctttatttgcattcacaaactaggtggactgaacaaaaaacaacactgaaaaacagttcaaaaaaaaacaaaaaacaaaaaaaaacgacaattgccaggttttcactaaggtagggaattgggtagaaagacagcatggaatttggttagtccaatgctgaaaggagacacaagcaaggaagccaaatatcacagcctgccatggctctaggcctgctctcctacacaggtactaatttcgatgaaaaaaggaaaatccaggctacagtgaatcggtgatacttctgcaattctcaggccatgggggtgcttgtttttgtttcaaaaacaagacccaaaggtccatgggtgtcagagttcccagccactctagttgcagtgaaaaatgtacaggaactaggttgaccagaaatcctatagactccagggttgaagagacaatgcatctctgcaggatacgttactaaagagtaaatgtgtgtgtgtgtgtgtgtgtgtgtgtgtgtgtgtgtgtgtcagagaataagcaagcaaggatggggagatctgtaggtaactactgtactcaggtgctcacttgtgccagcggggactcacatagctgtgcattataaactcacagtcatcaagattgatgtatacgcagtcaaggggagagaaaaaaagggcttggtttccaagactatcatggaaaactgactattgtttcaccaaggccaaaaccttacagttgccctcacagtcgttattggtggagttactggtggcatatttggggccatcatgagttccctagctcctattaatcccgtggcctctgtggttaatttggtggtaacctagaaatacagctaattggaaaagtatttgctaggctgtggtagaaaatggaatagttgggggagagatgtgagctgaatgccacagaggatacttggattcaacataaatggaaacaggtattgagaagagcataaggaattggctgcagtgacttctccactgtttcttaccttcctggtcctttctgtcatccctcctcataatgcttatgttcaatggccacagtgagagggcttgaagctagaggacatgggtgttgaaaaacgcaccttaacaacacccctggtttacaggaaaccatgttgaagccatacaagaccttttccttttctctaatcctttcaaaaaatttagaaccgatttcatcatgtttcattatcattccttgcgtactagacttggagctgaaatactaaaggaagtaaatgatgccgctggcgcgggtggcttttcctctggctggagctggcaggtaatatgagcatacctcaataatatgagggggcagggggcaggcagagaagcaggaaactctgggacaaaagacccatataggatgagtgatcgggcaatgtactttctatcccttttagctatttcctgcttgccactacagccccaggagaaatgtcctgcctgatttttttcaagtggcaacagaactgtttatcagatcccctctgagataagtcctctgagtgcctgtagtttacggactcgcacaatcagagaccacagagtggagcttccaaatccccattatttcattccccaaatggaaacaacccatggagaagttcaatgatcctttaaaaaaagaatacatatttcaacaacaaaagagttggccatatcaaccaggatttattttcctcccaaagagacttcatcttaatgattaatgcacattataggatggagaatgaaatacaaacacctctcccttcttgtgtaaagtaggaggagtttccttgtctagatacacagaaacttcaaaagctagcaaagaaattgtgctttaaagaaaaaaaaactacaaaggaaagtgactctggatcacacacagacttagatttccagtctgatgaggcatatccacctcagaaggatttacatgggcatatgttgccaacaggaaaaaaaaaaaagtggagttttatgaactgaaataacactagttctgcctctggtagtagaaaactgacttaccctaaattgctacgggttaactaacttaacttatatcctcttaataattagagaatataagatacttggtaagtggcagactattcatttctaggctcccataatccatgaaacaagtgtgatactaaaaccacaggcaaatttagcatgttgaccaggactccatgactgagcaccttcaaaagagcctcagtaaagagttgattcttatggagtaaatgttcagttgtagggtagaggttgaaatacaaactcctatttcctcttggccatcaagtaagtacatcctcagcatttagatgcctctacagaggaaaatgagactcacccaaagtgggaaatgtttctctttcctcatctacttagtcatagaattttcaaaaagactcttgagcaggatgatccaacagaccttcccaaagactgacttaagaacttatcttttcagagcacaaggcaagtgagggctacccaggttttttttcagagggcaggagctctcagcacaaaatctcactgctagcagttgttcctctgggcatcttcctcatctccaagagggaaggatcacccgctcctcacagcctctaaacttccctgggtttcctgcagtctgttttcccacctccctgagtctggctgccgaaccctgtgaagctacttctccagggtagtggttctcaaactttggcatgcagttggagggcttgttaaaatcttgctgggctccatccccagtttctgatttagtaggtttggggtgggggccctagattttgcatttcttacagtttcccagataatggggatgctgcttatctgggaacaccgctttgagacctgccactcccaaaaaacctttcttgcaactacacactaattataggtgttgctgctcgagaagcttcccattcagacctgaacagagatgattcagtgtttgagccagcccccagataaccagctgcctaccacttagctaattgctgggatcaaggggttgaacagacattttctgtttcagatgcgaacaagggggtgaaaaaattaaaaagatacagggaagcaattgcaatgccactgtgcaagcttcaccagtggacgttccaattaacaatcagagagtacctgctgagcacattttagattaagattaaaaggaaaaatgatgaagtacagatggggaggggttacggagaccatcatttacaagggataaagaaatggtaagtagcttaagaatgacaacaacaataacacacacccaagatgatttactagggacgggactggctgaggaacaagatatcattttgtgaaataatttccaacgttcaaattctcctcactcttgtggctagtccctttctaaattgaatggggccctctcaattcccaccaggattatggacaggcagagttcaggcccacagcaccacagacatgagtcaatgcaataagcctaatgattctagactcttttcctagtctcacctctgcaatgttgccaaattaatttaattaaaaatgtcattcatccaccatcacggtccctgcctgtttcatatagtaactctaagcctggctaggaagaatttctaaaacctaaactcattctacatctcttactttattttctactatgtttcagtccaaacccttgccttcattatttcatgaatgtgacccatgtattccctaattttaaatctatgccttctctgtggcctcttcaactgctgattactctttgtgttcaaaccttgggcagtcttcgaggccaacctccaggcttgattcagcaaactacttgtgccctcattgacctctcccatctctgaattcccatgctactgggaggaaaaaaattctaaactgcctcattatgttcatattcaattattcttcaattcaatgtaataatacctgacaattgtataaaatttacatatgctattgcatttggtcctcacaaaatggcagaataaagtagatattgtactataatccccattttacagacagagaagcagaggctcagatatccaatcaagaccctgcagctatgtggtagagttaggatagagacccactagccttgtgccataccacttcctctccagatggagtgcagccttcttggagaggaagaggaagcataagacatagtgtctgctatctacagagcctcgcctggggctcatgcaaaaatgatgggggttgactgattcataaatccttcatagaggaggacaaactgccctagaaaataactgatgtgtctgttgggtggtctaggaaaatgcagaggaagcagatgtattcaacctgtacctaaccctaaccctgctctgtagagactgtcatgtgggacactaataatccccagaagtcctctctgggaccccgtgtggggtggtggtatcaggaagactgatcccatcggctgaggggaagttcttctgcttatagagggataactcctagttatccaactgattaaagatgaatgacccttcaagtggcccaattttccctcaccctctcctattctaggagaacaaggatgaagataatgaaagctgataatacttagacactctgaagactcttaattatgaactagatgattaataagctttgcatcccatttgatccaatcaaaataaataaaaaagatgatatcatatggatatggatttttatggaatctatctataaccaagagagtaggtctaagtgatttgaagctttcctggctacctctggatatcctggataaactgcctacactggaataaaagcatctagccagccagaatattatgagacagactaattttaaaaggaggcaagtctttgcaatgtacttcaaattagaaactgatattattattcataaaatttaagatcacagaaaaatattttgtgagctaataacaataatggatttagtgtgaatgacatgatatgaattcatcattgagaaagcaataatatttatatagaacattttctcctgaacttgggacaacaccccaagactgccctgaacctgacgggatccaagctgaaagctttgtattcttttggttttcttcatgctgccattttacttatcttatcagagctgtgtacctaagagtttatctttctaatatcgattcttctcatgtttacactggacggggcatgtgtgttcaataagttgtgtagtttttagttttaccaaacagaataaagcctcttcactttatcccagacatcatggaatagttatcttctaagatgtggtcacctttgatgggtcagtttgtggtcaatcatccatcaatagtaatgatgataacatcaaaatgggccccccttttttaatcttaaaacatttttcttagaccttgaaatgactctaatgtaaatagaaaacagtttttgttactctgcagtactgatcgattatgatcccatgccagctggttgtttaactggctttactgggaagtcatcagttatgggtttgtatcaacaggactattaatccttttgatggcagcaggcttctaattatagctctgctcagttgaagagatgtgatccaatagccacaaatatatgtattccatgttgaaatgaattggagcataccggaaagtagtataaaaaccctaacaactctttagcatccatatacactctgtattcttgagctttgagtaatatggagactcctgaaacaatgatagcagttgacttcagagcagttgtaaggctcaggatgtctacctgaataattattcctaagagtaaaacattcttctaggagacaaagaaaatgacatagattgctaacagagagaatggaatatgtcaattctttataaatttctcaataaaacacacacagatcatttgctttcaagaaactcaggtggcgagaacccttttgtttgttatgaagttcttttaaattttatctaacaagacttcaatattatatctgaactaagagtctcctttcccatcttcattccatatttcttatccacgatagacctagataggtatagcaaaagcaaaatacgggcattacaagttgacctcaaaagtggttggcagctaggtagttttagaattcaatggaagagctaaagttccagccctatcacctcctagctataggatcttaagcaaataatttgacctcttcaagtctttgttttctcttctgtaaactggggataaggttacgaattcccaacgttgttctaagactgaatcagatgactcagcactcaaaagtgatagtaatttccaaaactaaggtaataataatagtgataatagtaactgtttgtagaaaatgcccccaaaaggcaatcattcaactgaacaaaaactgataggatcaattgtttctatttttttcatttgtatctgctttactgcctctttatctggtgttgcactgtaatccaaatgcccaacaggctgtgcattgggctactgtaagatttcacaaatgcctagtataattctatagagtattaaagaagaaaaagtgaaaattatatttccatgaaggcagccacacagtctcataaatgctaaataattagccaagatttcttgacagagaaagccataagtcactttaatgagtggccacaggagtttgttattctccttttttcctagtttttttttttagagatgagagctttccttgcctggttggcttagcacggatctacataagaggcagagatctgaaccagtcatatgtcttgtaaatatctcttgtaagttttcttctctaagagcacgtactttttcactgttacacttttggaatgatgtccaagacaacctacccactaatgcttgttttctccagcttatctgcagactacaattatttcaatcacagttgttaccagagtagaattagtgttcatatttgccagcaacttctatgtaataaatcagagctaagctactacataaaacagagtctttccaaacaagtattgcttgattttagttttcactaaactgtcttaggaatcatgactgaccaattctactcactcgttccactccctccactgattctagccatcccttttttttagggaacccttatttatctagaaaaggaatgggatggagtaggtgattcaaatagcactaaatgcatatgcacttatgcacatataccagaagacagagtgaaagttcttcgagggcagggtcaatgagccatgtataggtatggagtggttcatgtgggtgggcacccacacaacgtgtacacacaaacatccccagcctcccagcacaaatatatgctctccatccaaccccaaccccactctgggaccactcacaaaacaggacagcctagatgaggtgattagaaatgggggaaaggaaagagaagagaagtcccaggtctgaatggagagctgagaatctagacacaaatgctggcatggggaatggaacctctgacccctggatccatactcctctcacatctacaggaatttagtcctagggaaacaagaatagactattcatgtaaccactacattctgcttcctatgccttttttttctggatattaaaattgccacctatgtgctaggaggctgataaacaataatctataaccagggatagccaacaacccctagccattggggagcaacagcctggagctcacatttctgaaagagagggcatcctagagaaagtagctcagggtacagtttcaaggcacttcatatcaaggcttcccaaataagaagccctcatattcatacaggggatggcagaggctcctaagagaaaagaagagctctctatttgccaaaggctggccaatcagggcacggttgggcaggtaggctggtactcccatagcataacagactgtcaaatcactgtgggacttctttgggctgttactagatgcagacttcaaaattctgtctgagccttctccagatgtttgccttggactctttgggcctcccctggtcatctcaccagtcccctatttaacttatgccttatactcccttttcttgccctcctacctggctttgacatagtcctgtcatacctggatggcatgaccctggcaatggcaccttgctatgggtctacctgtaaggatttggagtacagaagctaaaactattgaatcgacagctagaaccagcctgttctgagttccggactgacagttgcggataatgagatgcctgagacgtatctctttcttattctgaaccttagtatttcagccagtagcctaagaggtctattacagttccaactcttgtacctcttggcacatctgcactcaagcagaatggcacacaagcccctcagcagggcactcaaggtctacactaacaaagagtaccaatgctgaagacttgctgatcctgaatgtaggaagcctgagaacatctggaaaaaaaaataattatgtttaaaaaacagttgttccatttatctgctgcttcactttgacgaacagaaaacaatgtcacataacatagatagtcaccacaaggacaccagcttgtttaaagttacacatgaatttatatgtgatgctgaaggataattataatggcttatatctatttctaacatcttgaagttttgttgttgttgttgttgttattgttgttgttgttgttgaggattttttttaagaacacacagagaaagacctggtagaagtctttctgacatctggcatagaagacaattatacctttattgcacaaggaaataaaatagctgtgtcttagctccgtctttggctgacagctaaggcctggaagttttgtaagttttcctatttaggagttttgttgagagcctagcagcctcacagccaaaacggagtgtctgagatgctgctgattagaagtcatgggtctgctgagtacaaggctagagtcactccttaggaatgtcataaaggacctgggcagtagaaaccaacaccaccatggaaaatcagacaggatgagttacctttaaaacaaactgtcatcattaatagggaaaatggcaatgacttattaacccctatgattatacaatcatatcttcaagtatgcacacttttcatttccttcttgacaacttcatgaaagtaatgtctcatctcctggaacatttcttttcctttttttttctttccttcttgcttctaattaacattgaaaatcatttatttatcaaaattaggtttcccctgcccatgtttcagaaataataaatagctggctgagtatggtggctcaagcctgtaatcccagcactttgggaggccgaggcaggtggatcacttaaagtcaggagttcgagaccagcctggccaacatggtgaaaccccacctccactgaaaatacaaaaattagctgggagtggtggtgaacacctgtagtcccagctactcgggaggctgaggcaggagaatggtttgaactcgggtggtagaggttgcagtgagccaagatcataccactgcactccagcctgggcaacggagtgagactgtctcaaaaaaagaaaaataataataaatagctatttccaccatatcaatgacatccactagatttttgggtataaatttggaaagaaatatgatgaattacctgctcagtggggtgaagtgtctttctccttgcttcctcctgcaggcccttcttttaattttattgtcctatctttgaacttctctagagatgttattcctatcattataaaaacatctctgtgagaggcctaggatggccccaggaagccgatttcttaggattttctcttctgtctctgtgaatggatctctgtatccccactttctgttgggcttcagaaatcctttcattttatgaggaatcactgtgtttttctgggaaagaggaatgggtctctgtactgaagaatctcacaaaagagaatcagatgtttccttcgccaagcccccagatgaaaacgttcataaagtgagaatatgccaacgtgctgggcaggatcgcctgcctgcacaggtctgtactgtaattacatttaagctcctttcaaaaagcgaaatgctcccattcaaaggatctttttactggttaccaaaagaacatgttatgaaattctaagcaaagtccatttcaatataatacatgggatatggttaatagaataggaggaaaaaggactgtgggaagagcttcaatctactaagcccccagattgtagaagatcagatttcatgaagaaaacctaaaaataagataagaagcattcggctttgtttcattctgactgcttagtgcctactcttgggctaagggatgctgacaagctagtatcatcaagaattgtctaggaactgttattcctaccctaggattatcacagcttggaatgcctcgcctttcatttttctcagcttacaaccaaggcatgtctaaaatgcaaagtatctatttgaaatgacaaaaaaagaaatgcagtgagaaaacagatcctgacagttgtgttttataaaagtccattctgagaatacaagaaagaagtatacaagtttaaaaaaaataaggaaaagaaagcagttttaaagtaagtcattagacagccctaaggcaaaaaaaaaatatttcaaggagagaaaatgatcacaatttactaatcaatgatgttgaatgcagtgccaacatgctttaacaaatgcgatatttcttcctagtagtaccatttcatttcttttaaagttgaattaatagttttactaaacactatgaaaacgatcaataattgcatttcctgaggcatttagcccaagaagtgcttttaaaaggtatatctttttatttagatatttgttagatctaagcaaaatcaaatcaggtaacattattcagaaagacatgaaagggtatcatcatcctggtcacttggtgcacacccaggtggagtcaggaacatgtaggactgatgatcaggtaggttgttacttggaaaactggtcctagcttctaattatttgtcattagtctttgctcagcataaacctaaaaacgggagatttatctctctcttttccaatgtcctagtcttgaattttcaagggacatggtggcctttgtgatatcacagcaaactgagggcccacagggatgatccaggagaagcctcaggcccagtgcttcagtgtattggaatgctcgctgctttaattcatgcatgcgtccagtgctcaccacgttcagggccatcggggaaagcacgtcaacatgcttgggcagtgcaggaaaagaatctggttaacctggaggcgacaaccgaaagggggaggttgcatcatgcaaatgaaaaccacagcttggccttagctgccatgcagaaaggacctacatcaaagagtctgcagtgcggctcctgggtaagagtcgatatgagagaggtgagttacttcagcaatgagagacacaggcagaaaaatgttcaaaccactctaaacagaacactgtacagagcgctggcattacacgcgagaagaggcagctttggggacgaggaggggcgagacagagggaaggtgaggacagaactggccgttactcaatgaaatggcttccctggccatcctttcatatgcatgtatttttataatgtatttcacttcaacaaataacctcatgagagtttttaacatcaaccataattgttaagatgttgtgaaaattcaggagaaacaaggcatcagttacataaagatacacaccatggtttcctgtagttacagttcattatagaagcagagctgaagcgggtcagataaataagagacagttaagtgccaacatccttaacactttggttacagagctcatgatgactctcaaggcgtaatgtagtgttgaaggaacccaacagtcgtgaaagctcgggtggtgcaagggtagggactctatgcatctatacccctgaaagccatttataaccctgaagttaaccacgctctcaagtgaagccatcttttcttcatctcagcatgaatgacaggtgaacagtgagctcacctcatacatattgaccatttagcagaaccctagttacgagcaagattctcaaaggtatttcttatcaaaatcaattcatcagcaaaaagcatatatatgtgatatatatatatatatatatatatatttcttaacatttctcttaaaggagtaataatactgttttaaattcagtagagattcatcaagcttcgctctaatgtcaaggctacactggatatctaaaaactagtttcctgtaaactccctgcttaatataaggcttgttatcatttttcttgcctcttctgccttttatgatctctggtacattgaacacaactcaaaaaatggtacggtctagtcctaactcacaattcctgcctcctagttctgacaggggaagagcaagccccgtgcttataaattactccttctaaaatgttctccaggagttcagccttctgattccctgcgtgtatgatggaggccttgatagggaacttaggtccagtgtgaatgagcagtgcactgcctcactttccacactcagtgagaccttaacatacccactgaaacttgagcaccacccagaacatgggagtgaatgcaggtagaagcaaaacacaggattcctcccgacactaccttcctcattccttgagatgcagctgtttccacttgatcacaatttattctctcttatagattaaaaactcagaggcttagttgaatgacatcttttcaaaggattatctttttgaacaaaaacataatagtctgtacattcattcaacaaatgtctctgagtttttttctttggtgacaggcactatgctggttttggagacatataattcaataagacatgattcttgctctggagtagttttccatttagcagagaagtctacccagattttaatttctggcagcagatatgcaagagcagcttgtttaaaaattctactgattaccttgtatgaccttggataagatatttaatcatgctgtgcctcagtgtcctcatttataaaatgcaaataatacctacctcctgaggttgttgagagaaataaatgagttagtaaacgtgaactgctttgttagtggccagcacatgatggatgctatgtcagtggtagctattatgatcagtagtactcaaatataagtaagaagcaaaggactctggaagcagaagatcgcctctgcctaacttttgcagtaggccttgagtgaggattagaaactcatcagcgtgagaaggcaggggaagggatggaagcagagggctaagcttgggcagagagacagaagcacagagaacacagtgcattctgggagtggaaggacacctcgtatagagcctaagtagattgtaaggttggcaagaaacaaggccagacaggagacggtgaagcatctgtgtgccctggaagcatgtctgctctttatcctataggaaatagggagctgacagaagtttatttattttttatttttattaaatctagtttttgagacagagtttcactctgtcacccaggctggagtgcagtggtgcgatcttggctctctgcaacctctgcctcccaggttcaagcgattctcctgcctcagcctcccaagtagctgggactacaggcgcctgccaccatggctggctaatttttgtatttttggtagagatagggtttcaccatgttggctaggctggtctcgaactcctgacctcaggtgatccacctgtcttggcctcccaaagtgctgggattacaagtgtgagccaccacgcccagcctgatagaaatttaaatgctggagagtggtaccattatcttgtcttgtagcaagttaattctggggacaatatagagtaggaattggaagcagaaggttgtgaagacagaggtcaattagtcaaattaaatccccacggaaaaaagtaacctatgcacatactaagatgagcatcattgttgccatataattacagtatcttaatatcctgggaaataccccttcttcagggcctgctgctgtcagagttctttaggaagaggggattaggtccacagtatcactgaagcaatttcctaaaccacatggttctctctcctaccacggcccccatgtctattgcaggaatctgtgtcatgaagaaatgacagcacatgtctcttaatcttctggaaaaaaaaaaacccaccctagtaagaagctgttctttctgctatttggagagcagtctctaaattatagttagaatcgacataaaatgaacatatttcagtacctcaaataggggtacctggacatagtagacacatgccaacaattatagacaaattacagataacagattatagacaaattgtatacatgtgatcacacccaggcacatagaaaaattacagtgaacacttctgctgcatccactattaattacctaaagaacttggttagtcataccgtcaagccatcaacttaactgccttttaagtgtccatccaaccctgtgcacagttaggatttcatgagcatgttggactggttttctctcacagaatcctgacctttagatttagatgtccttagtttccagagggctgcctgaaagtatgaattctggggtgtgcagggggtagggggtgaggctttcttttggcaggagttgacaagaggaaagatgccattttcaggtaatgtgctttctctttaaaaagtgaccaagtgtgtttgatactcacttagctcaattttaaccgtggtgggagctctgtaccctatgttggtaaatcagaaacaggaaagttctgtctgtgtgctgctgtgaccatgcggtcatatttgtttggtggatttccatttgttccaagtccattctagtttggagtttccatgaagccaggccaagtgtacaaatgctaacacagggaaaaagaaccctctatacatggacttacggagaagacaatacacactgaacttggaaaaggagcacaggctgagattccctaaagtggcagccaccttgctgcacagcagacactcagggagatgctccaggcagcaattgctcagcaggaaggcatgctggggaaggacctcatttcaaaggagagtagaacaggcctaagtgctgggattacaggcgtgaggcaccgcacccagcctgaaattagtattattttaaagttcacgcatgtgaccttataaaaatgttggtgcttatttttaagttatttctttttctttttaaaatttggtttctcacaagagaatttcattgtgctgatggaagagttctgtatactgactggagaggtaataaaacaaatttatgtgggataaaatgtcttggatctacacagcaaaaaaaaaaaagtgcttgtaaaaactggcaaaacatctgtacttgagtttacagcagtacgccaatatcaatttcctggttttgataacataccatgcatgcctatgtagcatatagcactatcatggggaaagcttggaaaggatacagaaactctgtcctgtttttgcaacttcttgtgaatcttaaactatttcaaaatgaagttctaattttaaaaaacagttattctcctgtttggttttactgtagccagacatcaggctagtggtctatttctggtgatatgtgcctctaaatgtctacagactgatttctttaacaaacatttactcagcacctgttataggtataatactgtgttcaattccaaaagatataaaagagggataagaaaccacagtgatacaaatcaacattaactatcttagttcctttctcaaaggagtgctaattgaggcaaagacatcatttacctactgcacaaattctcagagacaatcccccaagataatcagctgtcaataaatgtaggtcgttaatgtaataagcaagcttctagaattaacccacagtaatctcttcaggtaagcagatatcaggtaacaagctgtgctgaataatgcaactgatgtgataatgactctcttccttcacgtacagttggtgcaggctaagccatccttttccttagtttttcagtccctgttttgtccttcccagaactcagtgctcaccacactgaggagccaacaagtgatacctgcttaatgaaggtgcagggtgacactaagagctacttagattttaagaaacaactgaaaaggcttcaagaatgaatgtctaattggtggaatttcaggtactttgcaagttagaagagatgttttggagtataggagtatttacagcaccctcaaactcacccaaggatggccatctaccacactctctactaaaataagttgtcatgggcaattatattggaagtaaagtcaaggccaaatgaggcaataaggatggatccttagaatgccaaagactttgcaaggaacatgtcaacagtttttatcattctgagaagctgcctctaacaggaacaaaaagaaaacagagaaatgtgcaaagaataaaatctcctggaattgaagcctcagcaaatgaatatccaggaagagccaattcaatccttcctgaaatagaagatgtgtcactgctgttaacctgacaccgttattacctgcaagtggcttgggcttttaagaagtctggaagtaccatctttttcttgctgtttaaaggataaacaactagaacagctcaatccgggaacaaatgaatttttcaaagcattccccaaagaactgggaaactcctgctatgaagaagggtcctatcctaatcacaacaatttttaaagaagttttgtaacagtggaagacagaagactcccagaaatatttgacatctgtaagaatgaacagcagctaagaatggacgggctgctgcattcactcctctgtttcacacccatgctattcccttgcaagctcttactcatccacctttgaacactcaactcagtggctgcctcctccagaaagcctcccctgatcctcctcccacccagaggtaactgaacctttttctaggcttttcttcctgggtgcttctgttgtggcgctcatcactcatgaagtggtaatttatttgtttgtgtatctgtctcccttccctgctagactgtgagctcctgaggggagagccttggtgttttgtgtctgggttcccatcatcatggtacccgcaaaataggccctcaatacatgtttaaggaggaggagaaaaataaatgaattgagggagaaaatagacaaacctggaggaaactgattataattcaacagtaccaagatactagggaagtcccatctcccaacatggtttcaaatggccccatagtcccataccaattcagaacttaaattaggctaggcgtgatggctcacacctgtaatcccagcactttgggaggctgaggcgggcagatcacttgaagtcaggaatccgagaccagtctggccaacatagtgaaacctcatctctaatagaatacaaaaattagctgggcatggtggcgggttcctataatcccagctacttgggagactgagtcaggagaatcacttgaatccatgaggtggaagttgcagcaagccaagatcacatcactgcattccagcctgggggacacagtgagactccctctcaggaaaaaaaaaaaaaagaaagaaagaaaaaagaacttaaattatatgacaattacatcagttacaatattactacaatccctagaggatgaggtgcattcaaaggactgatttgtgtgctcttcccgtgtttcaggggagtttcaggttatctcacctcatgtgtgcaagaagaagaatgggaatgaccttggaggtaacaagattcaccactcagcaaagccatttgacctcactagccatgagaggtccaagacctgagaaggctatgggatagttaaaattccacaggagagtctccccgagggcattcaatttctgtgtcattaggcatcacaaaatctaaatgcctaaaactaaaaaaaagtcattcctctgaaactaatgagtatgcacttttctccttctatgagggttatcttctataactgggaaaccaagattgaaatgaagttgcccctgtaaacattataaaattaatcagggaagaagaaaggggaaaaaataaattaataaaccaagcttgaagcacattcagcattaagcatgaggtcaactcattctctgacctgcttcctcgacatggtttggtgcctattgtcctagaatcatgtagactctgtgataagatgatagttccccttaagtgctctatagataacaacttgaacattaagaaatgttaagctttccccgtgaggtagtctttcaggtcctgcatacgagtgaaactactacatcagctgatctgaatgaaagaccccacgggtgaccccaggaaggtctgaggaacaccacaagaagctgactcaccaaagaacacaatttccacattctgatgatttaatcccccttcccctgatcagtcaacaaccccaattttccagcccatcacgctccatgatgttcttaaaaaccacagcccagagctcctcagaaagatgaatttgaggctctcctcccatctcctcccttggtgccctgagatagttaaacccttctctgctgcaaacctgctgtctcagggtaatgggtctgttactatgcagtgggcacacaaacttattggttctatatcagaaataatacacagaggtgattgaagccccagttcgttcttctctctttgcttcaaatgatatatttttttgtgctctagctcaggaagctggacctaaacttgacacgaagcatactaggagcaaagctaaaaatctagagatgtgtgcatatcaaataggaggaagtcagctcatgtttctcttgctgattcatttctccaggaagccaacccaaggaatcaggtgttcaagcaacaatggaaaaagatgaattaaaatctccacataagaatacatagatgaagaggagtgtgggtgaggattttaacccaaagggtctccttggagagtaacttatcttactggatataaatcaacatgctctaatttttccagtaaggctgaatatatttaaaccttcaaaaaatatagtaatttttaatgcagtcttagattgatgaaggtttcttatagtttttactccatgctgcatatatgatgaagattccattaggaagtccatctgaaccaagtatttaaatcacttaacattaactttcctttgaatttgtcctctcatatcagcctagattttgataacctgctccttctagtcatcactctccctaaatataaaaccattttttaaaaaatcaggacgactttttaaaagtctatgaaattgtaaaaatttgtagagttatcactagcttctgaagtgacacctctgggtaggcaattctacaaagactatttgtaactatatgagctaatagtatagaagcagtgatgtaaaactgtattatttgtttattatgagcaacagaataatggaatgaattaatgcaccaatctcgctctaatgaatctatggacaacatgacagtatggtgtgaacagaacaaaataaaaccattgagtgggtccatttgcaaataagcccatttccccataaggcgagagaacatttgtttaatttaaagcttaagaacaatctctttacatacaaaatactttttctcagttaaaaaattataagtgctaagacaattaaattaatacagcatcaccatttttaaaactgaaaaaaagaggtttaattaatctcattgtgttctaactcactgttaaatcaataaaagagtttgaaaaaaatgtgtcaacctgacgttggattcattgtttttctatttagtagatatgtttaagaattcattgagtggtgttgtggagtttaaatgagttaaaacaggacaagggcttagacagtcactggcactgattaagggctcattaactgttacctgttgtcaaatgtaaagtcatgcgccaaacttctatctgctcttggtttttcgtctaactgggaactggacctcttgcctctacgtaagtctcctaccacccgtattactctctctctttcccactgagctctaaccatactcatcttctttctgtttcttcaactgtccaagtttttggccatctccactggaatgcaaggcccataaaagcagaaaacatgtgtgttttgttcactgtttcaccaaaacctacacaagtgcctgacacagactaagtactcaataaactttgctaaacaagtaaataaataaatggagagccaaaggaaggaataaagggaggcagggagggaggggggggcgggtcttagttcattctcactaagattaagtctatggtcaatactagtttgctagtgtttcctttatcaaaccatgcttgttattaggatcaggctgctcccacctcacttcctatgtctatatgatttttttgtactcacaaaaaggattttcctctcttgcattccaacacaaggagttccttgacaatttaatattatataatatatgcacctggaaagatgtttgacatctaatttttgacttacacttaaccacatatttccgctttcatttgaaggcaaaatggaacattttcttgtcaatttttttttctagattatgtgaagaagaaattaatagtcttgtcccatgttaatctaaagctcttctgattacataaatttaatagaggactctccctaaacaaactttaattccacacttaaagtatctttacaatgacaaaattgttctgcattctatagatattggaatataacacattgcataatttagaggttaagaaaatggactctggattcagaccaggggttcaaactctagttcctattactaaccatgtggacattgaaaccttctgaggtgttctttcttcatcaagcaaataaagaaaatcgtagtagtgctactaagtagaataataagtttgtaaaaggcttatcatggcactttgcacctagtaagtactcaataaatacagaagctgcttgtagacctagagagagcaaactagaactaagatcagaatcccctaatgatagccaggcaagccagtacctgacctattgaacatctggtagagatccactgagtgaacggctgctactggtgactaactgcatgacagcctttccttgtcttcctcgctaatgtctgttcaggttgtgtggcccttcctatactgatgtgatgtattttgtagaatccctctccttgagcctgtgatggccaaaattgcgtgcataccataaatgcttaactaggtaaaatgcctttgtaagactctgatgttagtccctgctgacaactttctacctcactacaatccactttaatctttgcattgacatttctgtttagaagagcaagccaggaatgatggctctgggctgagaatctggaatgcagattataactgctcagcaagttcgcttgctttgtgtaaactggccgcacttcttttgtcctcatttggaaaatagctttggctgcttgatatcgccacatcttccattttacacattctcagtttctgacaagaaaagtagagagtggaatgccacactgttgcaaatctgcggatacgcatcagcttaaccttatttgttctggtggatttttgtagatgagaatgaatatttgggctacaaacttccagcttgattcccttctcttagttccaatttcccagggtttgtttgctcaaatgcccaatgtaagagcactactctattctaggggccaccttccactgctgtgggttgacctcaacaggcattaaacctgtatgcagagccaggcatggtggcacatgcttataatcccggctccttggaggctgaggcgggacgatcacttgagcccagaagtttgagactgcagtaagttatgatcacacaactccagcctgggcaacatagcaagaccttgtctctaaaaataaataataagtaaataaaacgttttaaaaacctgtgcgcagaaatgaaagcccatgaacagcaaaaaaatcaaatgcaatcctggagctatgcataaaccaaaggagagatgaatatgtctagattaaagttctttagcatctactgtccatcttatgggattccatagacaaacatacagtagaaaagctcaaaataaaatggctttattctatatttaaaactacattttttccttatttgtgttattgcagactattagtttttcatgcacaggcaagagctaaacaaatacactgattccccaatgtgaccctctatagcatcaagacctatttttatagcagtgtaagtacatgcaccaactattatgtgttcttatgaagtaatcctcatcctgtcaactgctgtaagatcctggggaacatgctgagcaatgctggtgttctatggttatgcagtacttggccaagctcagtgggtaatttctcctaagtatatatatgcttaaatggcacctaccaattatctctctttggaagagtgcaagtgtagcatgcccactctcccagatgtgtgcacattcccgcctccacagagctgtctcttcgcctctcctctctagaagctctgggttagtcctttctccaggcacagaggcagctgagtgaactcagcctaggggagctatcactgttcttttcttacctctaggagttacaacagagaaaacctgttctccagaaaaagaccaccctctacaatgtcttcataggaaaaaaaatggtcacacctgtgacacagccctaattgaattcttataggcacctcagatcaaagctacccaataacctgaggtaatggaaaagaaaaacaatagagtatgacatttattcatgtaccaaattcttggtttctcacctattaatttttggtcttgcaaattttgctggaacagaacatgatagagtactggctctgaagttctaggttcagataacaaactcaaaaggggtttaggaaactaatccaagggagaatcataaatttgaaccttaacatggactctgttctccacattaaaatatattgtactaccttttttcatataacatatcaaagaaaccaagagttggctcttcgaaagaatatacaagaatgctagacagctggccagattaacaaaaaaagaagattcaaataagtgcaatcagaaatgacacagatgacattacaactgatcccacagaattacaaaagattctcgaagactattatgaatacctctatgcacataaattaggaaatctagaggagatagataaattcctggaaacacacaacctcccaagattgaaccaggaagaaagtgaaaacctgaacagaccaataacaagctctgaaatggaatcagtaatttaaaaaaaacctaccaaccaaaaaaaaaaaaaaaagtcctggaccagatgggttcacaaccaaattctaccagatgtgcaaggaactggtaccaatcctactgcaactatgccaaaacactgaggaggaagggctcctccctgatgcattctatgaagccagcatcatctttataccagaagatggcagagacacaacaaaaaaagaaaaacattaggccaatatccctgatgaacatagatgcaaaaatcctcaataaaatactggcaaatcaaatccagtggcacatcaaaaagttaattcaccacaaaccaagtaggctttatccctgggatgcaaggttggttcagtatatgcaaatcaataaatgcgattagcattataaacagaattaaaagcaaaaacacatgatcatctcaatagcctcagaaaaagattttgattaaatctaacatcccttcatgatagaaactctgaaaagagtaagcatcaaaggaacatacctcaaaataataaaaaccatctatgacaaacccacaaccaacattatactgaatgggcaaagctacaagcattccccttgagaagaggaacaaagcaaagactcccgctctcattactcctattcaatatggcattgcaagtcctagcctgagcaaccaggcaagagaaagaaagaaaaggcaaccaaataggaaaagaagaagtcaaactacctctcttcactgataatattactctttacttagaaaaccctaaagattcttataaaaggctgttataactgatcaatgattttagcaaggtttcagaatacaaaatcaatgtacaaaaatcagtagcatttctacacaccaacaacatccatgctgagagtcaaatcaagaacacagtcccattgacaatagccacacagaaaataaaatacctaggagcacagctaaaaaaggaagtgaaagatctctatgtggagaactacaaaacactgctgaaagaagtcagagacaacacaaataaatggaaaaacatttcatgctcatggataggaagactgaatattgttaaaatggccatactacctaaagcaatttacagattcaacactattcctatcaaactaccaataacattcttcacagaattagaaaaaactattctaaagttcatatgactccataaaagagcctgagtggccaaagcaattctaaacaacaaaaacaaaaacaaaaaaacaaagctggaggcatcaaactaccaacaaagctggaggcatcaaactacctgacttcaaatatactataaggctacagtaaccaaaacagcatggtattggtaaaaaaaacagacatatagatcagtgggactgaacagagaacacagaaataaagccgcacatctagagccatctgattttcaacaaggctgacaaaaacaagcagtggggaagggactctctattaaataaatggtgtgggtataactggctaaccatacgtagaagaatgaaactggactcttacctttcaccatgtacaaaaattaactcaaaatggattaaagatttaaatagaagacctcaaactataaaatctttgaagaaaacctaggaaatacccatctcaacatcagccttggcaaagaattttttactaagttcctaaaagcaactataacaaaaacaaaaattgacaagtgggacctaattaaactaaagagcttttgcacagcaaaagaaactatcaacaaagtaaaaagacaacctatagaatgggagaaaatattcgcaaactatgcatctgacaaaggtctaataactaggatctataaggaacttaaaaaaattgacaagcaaataatcccactaaaaaatggacaaaagacatgaaatgacacttctcaaaagaagacatacaagtggctaacaaacatgaaaaactgctcatcatcactaatcgtcagagaaattcaaatttaaaccacaatgagataccgtctcacaccagttagaatggctattactaaaaaatcaaaaaacaacagatgctggcaaggctgcggagaaaagggaatgtttacacactgttggtgggaatgtaaatttgttcagccaatgtggaaagcagtttggaaatttctcaaaacacttaaatcagagctaccattcaacccaacaatcccactactgggtatatacccaaaggaaactagataattataccaaaaaaacacatgcacctacatgctcattgccatgaaatttcacagtagcaaatacattgaatcaacctaggtgcccatcaatggtggactaaataaagaaaatgtggtacatacacatcatggaatattaaaaagccataaaaaagggtgaaatcaagtcttttgtggtaacgggaatggagctggaggccataatcctaagcaaattaacacaaaaacagaaaaccaaacactgcgtgttctcacttataagtgggagctgagcactgagcacacatggacataaacatgggaacaatatatactatggactactagagaggggagggaaaggaccgtgggttgaaaaactacctattgggtactatgctcgctacctgggtgcaatatattcacataacaaacctgcatatgtaccccctgtatctaaaataaaaactgaaattaaaaatatatatttttaaaagtactgtatgtatactacttttaattatgaaatgccaatttgttatattctctctctctccttctctccctcccctgctcagtgtctcttgctcttttctctctcttgctgtcttctcttccctcttcctcattaagctgtatggttaaggaaatgagagcaatctctgcttcaaggcacagccaagaggaatcagcgctcttgactttgacatcttcaattcctactaccacacttcgtcagagaaaaaaaatgacaggaaacttctagacaagatgattccctgccattatccttaaagatctatccaaatcacatcattcctttcacttgctaattggtttcgtaagccttcttcccttccttatgttttctattcttatttttgggacaattgccgacgtatgcatagttctggattttttttttaagtaatttgtagttgactatcgtttatttctgcaattggtgtaattaaatctaattacataatcggtgaaagactgagtaattacataattagaatgtgcaataataacagttgaaatcctattgttatgacgtgtaatgatacaattatgatgtataacattcacagggtactctgcaacgagcaaaaacggctctaaccctggctgaatggagcacagctaaagttggagacctggaaagtagctttcagcacctatacttggacttgcttatcatccttatccccctaatgtatcctttgacttttatactccacaggaatcaaaggcagtaggcgaggtctaaggaaggtcctcatgagggcaggagcactcacatctccaagaaccaaatcaccaatacaatcagcccttagacagaaaggagcagcaagagatggactcacatttctgaaacagtcactcctgcatgtcagttttaagtttgaaactgtaatcaggagacaaaaagttagggttggagaatgtctggtgatcacacacacaattacaagtgggcctagtgattatggcctgggacatagctcccagctctcagtctgccctctccaccccaactccagtcatcttaatcaccaggacatagaccaaccaccagaagtgctggcctcccaggtccttgctctgctgattgtcggtgaccctttcctttcctccacgccacccacccactcccatgatcttgctctggacccgaagaaagcagcaactatagtgtttctgatatctcggcctcaaacaccccattcatcaacagcaacctctcatccttgtgctcgcctgttcacgtgctccccactgggacccttccccaacctcagagaaatctccaaattctggacacctcccccgacatcccacccctggccagtcatctgctccctgccttgccttgcaacgctccttgtccagcctaattcccatagtccaccattgtcatcacccctgggcagcaccctccttccataacagaagccctcagccctacttcacaccagctctggaaagctgaaagttcctgaataaaaccacacaagggaaatgactggtttcgctttaaattcatgatctcaaactgcaaattgacactccatactgactggcaaactgctatttttcttgaattggtttgctttccaattttccaaggccactatttcacagttttccttctctcctccaacctcccatgttcttttctgcaccatcaggctcagtggatggcctcgcctcatcatgtcattaaaagtcacataaaagaatcaggccagttacactttttttcctaccagcagctctccaacactgcacttacaggcgcccagcacatcctctgcctcttcattcataacacaccatgccctccacagacactctttcagccctgtactgtctaactgtactgtgttgctatagcaagctctcccttgctgctggagctctgctgccaaaatataagcttgctcaactgtcctccatagccaaccacatttccagagactactgcaggctccatcctttagcccactttgatcaggccctccctccactcactagagcttcaatgtcaaagaaaccagcaacatccctgtcacaaactccacagatgaccctagacccttaccttccctctgtctcaacagtgcttggcaattggccactccctctgcctgaaaccctctcctccctaggcttctgccatctccttgccctgtgtgtgcccttcctcagtttcccatccagcctcctcctgctttactcaccctctaaatgttgggcatcctcttgccttcacctggggcaccttctctcctctccctacactctttccccagatggtaccatcaactcacaggcattcaaagtcatctttgtaatttccaaatgtaatatgattcctctcttctgagttctggactcaattatctaccctgctgtttgacatcttctctttcaggtgtcacagacttcttaaactgaacatatccaagatggaaatcctgatttctccctagtgcagcccttagcccccagtgcagcccctcccttcccagtaaatgctaccaccagcgacttgtcattgaagccaaacactagaaggctagaaggaccctgattcctccttccattcactccacatccaattcatcatggagtcctgtccaaaatgtctttctcctctttaatttccctacttcaccaccccactagatcaggccagtgccctcttctgtcgggatggtcttttctttatcttctgaacatgattacagattgcacctgttttgttttgttttgttttgtctgtcttttatttttgcttttttttttttttgcctgtctcctcctctagactgtgttccctgattacatttattgttttacttatttacagtttccagcatagatcaggtaattaactttcattagataaataaataaatgactatggtattggcatctataatatgcagactatgagcctcatggtaaacttataagggccaagatgaaagccagggccagagcagagataataaacttagctgaaagctactcaaaaagttaaacatcgagataccatatcttgatgtgctatgaactggattgcattcccccaaaattcatatgttgaagccccagtccccagtgttatggcatttggaggtggagcctttgggagataattaggtctaatgaggtcatcataagagtggggccttatgatgggattaatgtccttgtaagaacagataccagtgagcagtgagcttgcccctcccccccacctgtctctctctctctcctctctcctctctcctctctctctctctctctctctctgccgtgtgaggacacagcaagaaggtggccatctgcaaccctggaagagagccctcaccagaaattgaccatgctgttgccttgatcttagacttcttagcctctatttctatcttgaaaacatcatgctaattgaaagaaggaagtcacaaaaagccacatattacaaaattcaatttatatgaaatgtctagaacaggcaactctatagagacagaaagtagatgagtagttgcctagggctgagaagactgggggactgggagaatgtggaatgattgccaattgatatagggtttctttcgggggtgttgaaaattttctggaattagattgcagcgatagttgcacaaatctgtgactatactagaaaccactttaaatgagtgaattctatggtatataaaacatatttcaataaaactatgaagaagaaggggggaagaggagaagtgggaaggaagggtgagagaagcgggaggaagagaaggcaaacagcagcagctcaaattagttaacctagctgagttagtctatggaatctaagttgccaccaacaaaaaagtaagccactgctttatatgccaccaagaaagaaaatatttaccaattatagccataagaagtcatgaatgatgagacacttcctgattttggagattttaaactatgaaaaaattgtatcttagaattagtaaaatacagtacacgtagctgttgtcagatctaggtaccagcttctgaaggcttctaaatttgaattacttctttaaagataatttattaaccatgaactcattcattcataagaaaaaattttatcaaatgagtattataagctggatattggctttatatatggttttgactctgtgcacatcattcatttaatcttcaacaactacccttcaagataaacattatattcctcattttatagataagggtgtgggctacagaaaggtcccatagttcttaagtggcacagccaggatcctaagccatgtctccaggtctctgctctgtccctgtgttatgaatgaacagttcagatgcagaaaccttgtgagcaaaaactgaatttttggccaggtgcaatcttaatcgctcacgcttttaatcccagcactttgggaggctgaggcgggcggatcacctgaggtcaggagattgagaccagcttggccaacatgatgaaatcccatctctactaaaaatacaaaaattagctaggcatggtggcaggtgcctgtggtcccacctactcgggaggctgaggcaggagaatcgcttgaacctagaaggtggagattgcagtgagctgagatcatgccactgcactccaacctgggtgactctgtctcaaaaaaaaaaaaagaaactaaacaaacaaacaaaaaaaaactaaatttttttctaagccaaatgtttcctctgtcagctttagagatgtagatgcccatcaatcccatcatctcaggccttacttctcacatggccaacttctcccaacatcaactggtatgtattaaaggaataggaattacagtacatttctggagaatattcttggccaccctggaatttcctgcattcaatatgttggtttgccatgaagtctccaggagctgccgaatgaaaacatggagatacttacagatgacacagacagaacaaagtggaaaatgagaaacaaaaggagaaaaaaagtggtatgaagtgcagttgcacctcaatttatgctgcagatgctttcttgaaaattatgtgtagatcaaattgatttatgaactaaaccctatcataaattcaacaaaagcattgtgatggaaacttttgtaatcagaaaaatttatttgtgctgagaatagttgattctcagcctctcttttgaatttacttgttattcttctcaaggggagcctacctgcacataaaagttcgataaccaccagggattcttgatgtgcaggaatgtcatgagaccaaaatgctttacaaaggcttaaaaatataaactatctatgccatttataatagccatttccataatactttaaatatatatctcaacataatgggagggttgagaagatccttctcagggatggaattctaggaccactattgaaggagattatttgcgtgggtggggaagttcagaggagataagtatctcccctgggtaaccaaaagccctgaacccttctctcttgacagttgagagggagggagaagttgaaggagtccagcactccatttccaaatgactcccatggcctccttgcaaattacaacgtcactagctccctggtcttccatagccaaaggttacaaaatggccacccatacaggccatttaaaccatttaaaccatttaaaccatttaaaaccatacaggttttaaaaatcaagtgttacatttcttaaaatggatttgcagaattacttgaatgaataaaagatctgcaagacatgctccatattcccactggggaataactcactggagctgggtagatgctcctgaagacgtgtctcctggtccccactacttcttaagccttgcatccagcctggctcctgcaggcattttcacttgcaccccagtagaagtctcctctgagctaagggtcaccaccacacgactcacccaatcccatgtagagcccgcaaatatccatgatcccaagagcatcctttctttaatgtggtctcatttcaaaatatatgagactgttggatttatttatttactgatttatttatttattgagacagagtctcactccatcgaccaggctggagtgcagtggtgcaatctcggctcactgcaacctccgcttcctgggttcaagtgattctcctgcctcagcctcacaagtagctgggatcacaggtgcacgccaccatatccggctaatttttgttttttgggtagagatgggatttcatcatgttggccaggctgatctcaaactgttggcctcaagtgatctgcccgcctcggcctcccaaagtgctgggattacaggcataagctactgcgcctggccttattttttttattatttaataaattttttagagctagcccaaattctttcagatcctctgttcttgaagtgccctcctggttcatttcgtctagtgacaaatatgactccatatcaccactttcccagagaatcagcacagcagccatgcctccagagcttttgcttcacagacatgcttaataaattcactttaccctttagaccacagggcttagaaaggaatgttgtttttgttgttgttgttattgttctgctttccatcagcttaatacaatcgtgacgacatgcttctaagaaggatcctaagacgttcatttctttgaagcactattaccagtggagctgacaacaaaaagttaatagacataggactcaggcactcaggctcactctgcttaaactagcggagtggggaagaagagagacgtgtacattccatatccataccagcctggggtcttgggttctaagaggggtggtggcttttccctgagccctaaacccagcagctgcagttagtgccaaagattatgagggtacagaaagtaaagaaagatcagtgttttaaagtctccacccaccatatgatttctcagaaacctcaaatgtcctttgttgttgttgttcgttttgttttgttttgtttttgagatggagttttgctctgtcgcccaggctggagtgcagtggcgcgatcttggctcactgcaagctctgcctcccgggttcaagcaattctcttgcctcagcctcccaagtagctgggactacaggcacccaccaccacacctggctaatttagcaacctcaagtcttaatccatataggaactgtaagaagactactggtttgtttctcatcactaacatggtaactcatgattgccgaacactggctgagcagtcatgctctgcccagtggcattgttttctaagaacttaagtgtatcttctcattatcctcataaaatccccattatcagctccattccacaagtggagaccttgaaacttagagagcttaaataataataataactaaaattcatgaagggtgcccttctagcccactacacataccaggcactgttctgagtgtttttatctgttgactcaattaatcctcataacaccctttttgtgttactatttatgttgtcttcatattacaaatgaagaaactgaggcacagggaagaggtgaaataagatcacttagctggtgagtaattaggcagaacttgaacttgggcagcttgacaccaaagctgtgcttttactgctaggctgatttgctcaaagtcacaccactggttaaggctggagtttgagtctactccatgtggtcagaatctagagccacaggggcagccatgtgctctgcggcctgcttagatgttcatggggtcagatttcctctgcagtggctccaacggctggcagcagggtctgggatggatgtactgcctttctcagagctaggctgggaaaaacatttccttgtcatttattttttaaatgtcaggagattttaaaacttctaggagagcagataagtgataagaagaaaatctgggtcgtttttgtgcatacaaaggggccattctaatagtggtttcaaggggtcttttctagacaaaaggggaggagattgttttagtagccctctcttcctttcctggggagtttgaaactatctagttttgaaatctaaaaatccccaagctcttggatctggtcctttttacccccttagccatatattccagtttctgctaaaaaaagtctgcctcaagatataagtgacatccaactgttggggctgttttctcttttcatagaaaccagagcttctggggttctgagatgtctctagcggtcactgacctaaccattagcaactgggttctacaaataatgtccctggggaactcaataaaattatcaatcgctagcccccacaggtcttaatagagagtggataggtggaaggtttataaatcaggatgagtcatttgattcaccaagggaaaagataaataaaccaacactccaattaattttaacctgaaaagaaactgctagtgaatggtgcgttagccaagtccgtagggtcttaacaaccttaattattcacaaatgcaaattgcttttactgcttgctaatttcttcatgtcttccatccagttcctcttcccctcaccatcctcctctctcctcacccagtctctttattcctgaagagccaaaaggaaatttctggaaatgaccttctaatcactcaagctttttctctaaaaaaatttaacgaatcttcccaagaccctaattagcttaacctgggatccaaggactgccctaggcctaaataatccatagatgcgcttcagggaccccatgagctagctgaaattatatgcaaaattgtgggggtgggtgcaaaaaaaatcagaaagaatgaataagacctactatttgatagcacaagagggtgactatagtcaatagtaacttaattgtaccttttaaaattaactgcaagagtgtaattggattgtttgcaacacaaacgataagtgctctaggggatggataccccattctccatgatgtgattattacataataagtgcctgtatcaaaacaggtcatgtatgccacagatatatacacttgctatatacccgcaaaaattaaaaattaaaaacaaacaaaaaattgtgagggtagggtacttcctggctccctgcccacccaagaggtccaattttcatcaaattctcaagaaagtctatgttctccccaaccccctaaaacagcattaagcattaaaggactagactgtacccacctaaacactgcatcacaaggaatatttatgatgcagagtgagacagcccaggcttaggagccagacagatgcaggttcaaatcccagctctgtcacttacgagctgcatgaatttagacaaatgtcaaattctctgagcctatttcatcatctgtaaaatggtgatcataactccttcagtacaggattattgggtgactatacaaaataatacgagaaagcacaaagcatttgtacatagaaagggcaaaatgaaaatcctccctacaagagagagaaaaaaaggcagatctaggctcaggagtagagacgctgctctcccatctttgggaactgcatttctggctttgctaaagatgaaggtcactgtactacaaagacaatcagattgggatcacccctgggaaatccataagaatcagattggaagagcactctttatgagcatcatattagattataaacctttttatagatcttatagtgacatgcccaatctgatttaaaataagcctctaaccctctattctcctactgtctctacctactactcccaacataatgtgataagcaaagcctaaacatttcaatcatgtacaatgtgaagttgcaccacagtaagggcactgaaatgacctcaggaagcccgcatagccagatgtctgcagtccttctgcaagatcccaatattttcaggttctacctgggtcagttcgctgctctggggtaaatatcaattagaggcttctagatcctttggctgttgggacttccagaacagcatcaatgacttcaaaaacatcctgaagtcgattaatctgctcctgttgtatgggctagattcctgattccagagaacaggccaacagaacgcaggccaagaggaccccacctttgcatttctatttctcatggcaaggttgcctcactcccagaaaaaagaactttagctttattatctgagacaggcagaggattgaagctgattgccattctctacatatctgattttatattatgattgtattgtggggcatgctactgcagagtttaactgcattgaaatcattatatcatttctctttggctataaagaattttaatttggggctgggcgtggtagctcacacatgtaatctcagcactttgggaggctgaggcaggcagatcacaaggtcaggagttcgagaccagcctggccaacatggtgaaaccccgtctctactaaaaatacaaaaacttaaccgggcatggtggcaggcacctgtagtcccagctactcgggaggctgaggcaggagaattgcttgaacccgggaggcaggggttgcagtgcgctgagatcatgccattgcactccagctctgggtgacagagcaagtttccatctcagaaaaaaaaaaaaagaattttaatttggaagccattcatagtggttgtagtttttgctcagaccatgttgtgacacacagtgtattggcttttcagatgacattaacccagccacctgctcatcttggtcctgctcagttaacctgcacatctgtatttttgtctttaaagtctttattatcaacctcactccccagctataaaagctgtttgtcccccaaacaagttgaaaagaaagtgcagaataatcagagtgtatctagaatgaataaaaaatgagaatcccatgacatccaagatgggatacagtcttgattggacatacagacagacatggtgacagaaaactcagaagccgggagggtcagagcgatggagcttactagaacacaagttcattttctcaaatgtgagtgttttgccctctctgattggcatgccttttttccttcctcaattgtggggcactgtcctctaaccacagatgacttctttacaccgcacggttgcagatagcacagtttcaaggagggtgtgcttggatctggtagaggtcatggacgaagtgaagacaaaagtgaagtcttggtggtactggttcacgcaaggaatcaaacagcccaatgagtcagagatctgctaagtatatggaagccttcatgacttaaaatatccaactgccacgagagaagttccagaacagaggagcctcttccagcatggacccagcagctacaggagggctcagattgcttgctctgccacgcctctgccatctgccccctgctgaagtcaggccagggaagaggtgctgcccatgagtcagccattctcaactgctgcttctgccttctcactttgccatatttgctccctatctgggatggtacagttccacagaccctgatacacctggggttcagcagacctaattagccttacatgtgtctgctcccaaaatagagagtcatttattccagtttctgtcctgatcagcaaggtgtgacctaggcccatggcccatagccccagactgggagaggagccacattccttctgaacagtttctaaaaaactttcagtcccaaatgagtgactttagaagtggagttttgaggatggagctgagcacgtggatttcacatcttctcctcttttcagtatagctctcaagccccctggatgcaaaggcaggaccctgatgaacttgccttttctatgacagtctttacactacaagaaaggggctgcaggacaatcccagctcccaaagacccagcccagagctcaggaaagccaggctgcttctcaccaaaactgaaaaccaggacaccttgggaacactcaggaccccactcaggcaccagctccttccggcagctcttccttaccctgctgaagtgctgaccatccctgcccttgactcactcccattgcagtgccaactcagagcatctatccccaaagccagagtttctgggattcagatcttggaggtgtcacccattccctatgtgactctgtgggagctacttagttaatctgcaccctaatgtcctcatccatcaaatgtcgatgatgacagcacccatctcacagacttgggtaaggctcagaagagctaatataaagaaaatgcttagaacgtggactagaatagtaagcactcaacatacttcccatgctgttgttggcgccgctgctcccacttgtcagataccatgtgagaccaggagccccttgaaggtgggaaactttttctgtttacttctatggtcccagcacccagcacagagcatggtgcagaaaaggctcaaaatgttttatgagtgaatgaataaagcgaatccagttggcaatgctggactatatacagcttgacttggtgatggttaccttacagactcctcccctgcaatgttctgaaagagggcagaatgtcaacgggcaggcacactggccagagagaaactgagcaatgtgagaatggccaggggagactgggcattacagcaaaaaagactggcattgaagctcaccaactgggttgtcttgagcacatccatttcctcttgggcttcagtctggccatctgtgtgtctaaacaaaggcaggaactactagaaagatggggtatcatttcagcaagaacaggtggagaggtgaaacatgactcatctttctccacctgccccaggggactcccc[450 bp omitted]ctctgagtaaacaatccaatgatgctacccacaaaggccgcagatccaagcttaggaggcatcttcccgtcaatgccctgggggcccctgttgccaagtgacatgtgtctgtgattgcagaaggccctattctcccagaatctaggggaggaagggggactttatgcagctggaaaaggcaaattctaacagtcctttgtgattttagacatggtatttaatctcttttgaaatgccaaataatattaaaagagggcatgctgcttttatgatttttcaggaagggtcatggactaataacaggttgcaaacattgcaacattgctgggagggttcttgcccttgctgtaggtacatattgctgttctatttataaccaacatgaaaacaatgtaataatcagaactaagagatgtatacatccctttagcctacctatttttcttggatctggaatattttgggcctcacttgttgatttttagcagcagttgaaaggagctgaccaaatgcacattaacgagacgacattcctgtctctttctgtcttcactgggagacgtcctatttgagccatcctggtttgagatcccagcctcccacccctcaagcatgagacagccacgagaaggccccctgcagccacaaacatttgtcagagtgatttggtgaagttcagcagtgaaagcaatttcttactcggaaaatcatttatcatggatagcctgtcgaaaacaatctcatttcaaacccttcccagggagaaaagaactgacaactggcactaagtaatctacaacagagccatgggagtcattcatctttcctttgcccagcccaggacttgatgctttcagaagagaagtggaatcaatcataactgctctgaggggcttcaggtaaaagaggagggggctaccgggacagccacatactcctgagtgcacaatgggagattgttcagtctctattttactaatagccaaaaaccagaagagtagttgtaggggtctttgagggaggtgtgcctccttcattacaaaacatgttctttttgtacttttagctcatcttaaatgccagaatcctccttcttagggagcaattaaggaaaagcttattgcttttttatataagctgacttcccctttgcctggggcagtcttttctttgccagaccatagcatggagcttgtggcatagtagataatgattctgtgcatgccatttccactgacatcaacaccctggaaacagaatatctagcaatttgaggctcatggagaaaagcagaagagggaaaatttttccccattaagttccctgcttttttaaaaatacaattagttacagataggaaaagcaattgatcactttccttactgaatgtctgattaaacccaggttctggttttgaggttcaccaagccccagaagaagctaatgaatttcagggctccatcattctcatgttttggcattaaccagtgactcagaaggtactgccagatgcaaattatgacatcaatgctatactccctgggaaccaaataaaacagaaccacctttgtagatgggtagctcccaccagttcccagaaatatttatattatggatattagtacttcattagtacttcattattataccaatcttaactcagaaataaatcaccaggtttagcacatatgatgctttaagataaaactgtcctcaaactgctttcatttctctgtcattatcaggggtctgaaatcctgactattttggaaagaagtgttatgctattttgcccaagccaaatgcaggcattaacggtaaagttctgggataaaatgctccatttgaactgaattgttcacataaaatggctaatttctattagccatttgggagtacttctgccacttcccagctgtcactttaagcaagatactttagcctctctgtgccttggtcttctcatctgtaagaagggggtaatactgctacctaccctgtaagatgttatgaggattaaatgaggtgatacttacaagggccacagcgcctgccaaaaagcaagcatttaatttaatttttttttttttttttgagacggagttttgttcttgtcgcccagactggagtgcagtggcgcaatcttggctcactggaacctccacctccagggttcaagtgattctcctgcttcagcctcctgagtagctgggattacaggcacgtgccaccacgcctggctaatttttatatttttcgtagagacggggtttcaccatgttggccaggctggtttcgaactcctgacctcaggtgatccacttgcctcggcctcccaaagtgctgggattacaggcgtgagccaccacacccggcctaatttaaaatatcttttagaaaactctcagccagagatgaattagggggtaagccaaccactcggtttcctggtagccaatctataaagtccccaggagatcactggaaaagtaacaagatggaaaaatgagattttcagggtgagcactcactatacatgatcgagaagagcactataaaaagccaggtgtgaggaggtaaagctcccataaggacaagatcagagataaacaaagagtctctgaactgctaaagaggcttgccagggtccctgagccacctctacaacagttttcttcctcctccgcttccccaacacaaaggttagtttctctgctaaataaatattgaatacttacataacaaatatcaatttgaaggcacataaaattatgagcctgcccaagtgtcttcttggcctaccatgctctgagctaactggggcactgagtgtaaacactctcccggctactgctttgctctttccctccctcattattcaccacattcagtgaacagaaattccagcttgagccacctgtagtcatgtggcattggtccaaagccctcactaccatgggcgccaaccctaaggggaggtatcctcagcactcactacgtgaaaacctactttgcttgggaccaagaaaagaataattcagcatgaatacgacatcactggaacttgttagtgttatttgaaagatgtggctgaagttttacatagggaatgtgtgcttccatcacaagtaacacagtgtatacaaaactaacaaagcagtttgtggccaagaggtttttgttttctaggatgaataagaagtccatgttcttgaaggaacttgaggaacaatgactacttcaagtccaccctgaaatatggacacgatggaaaagcaaaggtgggtcatccacctgggaatctctagttcaatggttagctcagtaaatcttcccaatttaccatgcagatccatctcccttaaccccataaactgggctaaagaataaacatattgcaatttgggtattaatttaatcaggcatgattttgcagagaagcccatggcaaaaaaaaaaaaaaaaaaaactttctataatgaggtccaataccaaaaatagtagtaacaataatttaaaagcagattgtttaaaatccatctcttcctctctgtttctatccataattgaggaggaagagcatttgttcagcctactgtctgccaggcatgtgccaggagcttcactcatctcttcaccccagtatattattgctgttgtatggatggagaaaccaagatttgcagagattatcacctgcccaaggctaccttcctgggaagagggagatctggatttgaaccccacctcggtctgagtccaaagcctgtgctcttcccacattgtgctgctggccatccctgaagctgccgctgtaggtggagcatactccctgagacgaaccaagggagtagtggctatatatatatatatatgtacacacacacaaagcaaacaaacaaaaacaaaataagttggcgaggatgtggacaaattgcaacccccgcatgttgttggtggaaatgtaaaatggtacagccattgtggaaaatagtttagtgattcatcaaaaagctaaacattgaattcctaaatgaccctgcaattccactcctatgcatataagaattgaaaacaggaattcaaacagatacttgtgcacaactgtttattggagcattattcacaatagccaaaaggtagaaacaatctacatgttcattgacaaatgaatggataaacaaaatgtgtggcagacataaaatggaatattattcagccatcaaagggaattaagtactgatacgtgctacaacgtggatgaaccttgaaagcattatgtcaatgaaggaagccagacacaaaggtcgcaaatatatgattccatttagatgaaacatctagaagaggtaaatccatagagacagaaagcagatcagtggttgtcagggcctaggaggacagaggaatggggagtgactctgatgagtatggggtttccttttgggtttacagaaatgtcttgactaaatagaagtgatggttgcataacattgtgaaggtacgaatcaccactgtatcgtacacattaaaatggctaatagttacttttatgctctgtgaattttgccaggattaagaaaacaaaagagtggtaaagttagaagatatttcacaagttctctattgcactgcattctttgtggatgaggaaaatgagctgtcagtctgtccagtgcggaattacatagctaaagtttgccggtgaagttggggttagaagtcaaccctctgtcaattaatttatcagagcttgcacccaggctcacactggggctctggaggaaaagaagaacaatattgagagaaataattctttctcaagtgtaactgagagcctcccagttcctgcctctttggctcaaagctcatattcctgggaagtcatcctcccttccactccagggaaaatggcttcctacttttatgtgaaaaggagccacaaagaattcagcatcatgaaacacccttagctctatcaatagagaaatttctgtcttcaagggaagtccacttgatttgcttctgcttgaagtgaagcagataacctcaatcaacatctgattacttctttaatttccagagcttgctcattaccgaagccacactgtctctagagaaggacctagagtaactcagattttaacacacctgggctgacaagttacttagcttgggctttaattgagaaatcagttattttacccattattttgctaacattatcaaaatcctgtgatactcaaggccctgaaatgacattttcctctcctttatcatttgtacatgtgactaggagaaaattatgtgtgatggacatgtcgaagatacataagttcttgaagagattctttcctacttgctctactcactgatccgtttccactgaacaaattgagtatcagcatgagaagtcacaaggcagggggttcattctttcttccctggcttggctttctaaagcgtgtgagttttatattgttgcttttcaagatgtgaagttgtgtgtaaatttgtgtgcatgtatgatgaatatttttccctgctaaaaggtacaatgaaattgatagtgaaactttgcaaaccaactctccgataagcttctagtgtttttcttttttttaggtttgccactaatcctcccagcatttctgcagattgtaactgaagctcagcttttctaggaggaaaatacctgttatggtcaacaacctaagagtcactcttgattcctctccattttcaactaaacagctgctctgtctgtgacgcctccagcatgtgctcacaccccaatggcctcggacctctcccaaggcagcatcctctcagttgagacctaagaaaactgcctcccaaatattttccttgcttttgtctttccctgaactctattctccacatcacagtcattatttgctaatggctttattgagttctagtttctacaccatacaattcacccatttgaggtttaaaattcaatgggacaatcaattttaaaacactttcatcacctcaaaaagaagccctgtagccttcagctatcaacccccaatctccccacaagcaaggagtcagtaatctattctctgactctatatatttgcctattcttgacattttacacaagtgaagtcatatactgtgtgatcttttgtgactagtttcttccacttagcataatgctttcaaggtacacatatgttgtggcatgtttcagttctccattcctttttatagccaaatggtattccactgcataagcacatcacattttgttaatccagtcatctgttgatgggcatttagattgtttcgctgttatgaatgttcaagcgcaagttttgtgtggacatgtattttcatttctgttgggtaaatacctaggagtggaatgtacatgtcatggtagctctgtctttcagtttttcaggaattgccaggctgttttccaaagctacagcaccattctacatcatccccacgagcagccacaagggttgcaatttatccatatccttgtcaacacttgttatgatctgtcttttcaagtatagccatccaaatgggtgtaaagtggtatctcaccatggttttgatttgcatttctctgatgactaaggtgttgaacatcttttcatgtgcttcttgactatttgtatatcttctttagagagagatgtattcataaactgaccatttttaaactgggctgtcatttcactttctttgtaatgtccttccattgaaacacaaatgtttttaattttgatgaggtccaatttatctactttttcttttgttgcttttgtgtttggtatcatatttaagaattcatggctaaatccaatgtcacaaaggtctaccccgtcttctctcctaaaagtttaaatgtttttgctctcacatgtagatctttgatctattttgagttaattgatgtgaagagtccaattttattattttgcatgtgcctatctagttatcccagcaccattttttttttttttttttgagacagggtctcactctgtcacccagactggagtgcagtggcacaatcacaactcactgcagcctccacctctcaggctcaagtgatcctctcatctcagcctctcaagtagctgggttcacaagcgtgtgccaccatacctggctaatgtttaaaaaagaaatttgtagagacagagtctcactatgttgcccacactggacagcatcattaattggaaaaactattctttcctcattaaatggtcttggtattattctcaaaaattagttgactataaaaactggatgtatttctggactctcaattctattccactgatctatatgtccagaatgactgtttaaaagtggaaattgcattattactctttctaaagtaatagcctaatgcccaatacaagtcattctctatcccaaggattcttcacttggggccatatacttccaagaggtccttgtgcagtactcagggagtccatgatttggaccaaaaaaattacatctttatttttattaacctctaattcaaatttggcatttcctttaattatgaatatagcaataaactgtagggagccaaaggcccatgggacatgaccaactcagcattccactggaggctatatgatcaaacagcaaactgtttatcgtgaatgcagaatgtgagcaaactcaggactgcgcatgcctccaggaggtttgctaagggccaggaggtttgctgggctccttaaagttatctactgggaaatctagtgcctattgtttgaagaatgcagtcttgcaagcctgctgtgattcaaactgctggccgacaaccacctgcccctttctcgttatctcttttacctaataaattcggaggaccgaaacagctcagggcccttgtccactagaggcgaggtgcccccaaccccttcttccaaatatactctcttgtctttgacttttattccccagttagccccactttgttcagtccaccagggatcatggcaggttacaagtggcaccccgaacagtgacagaatcaggtgttctacaataaattagaacagtattaatgacacttgtaactttttttagcaacagaaatctcagatatttacatataagattacaattgttacaggtatctcaaagtattacttatattaatcctactttaaaatgatggtggtatattagaattattgctggatcttcataaaaatgccctaatcaagaagcaagcagactttatcataatttgttttttataatctgataactgattttaacataatctattttcttataatccaatgtttttatattatgcctttataaataatatttttctgagaaaggggtcatagtcttcaccagactgccaaagaagtcctcagcacaaaacatttaagaaaccctgctttttccattaccagttttattttcttcccagcacatggcatcaactgaatttatcttatttacttgtcaacttgtttacggtctgtctctttctgatactggaatgtaagtgcttagggcttaaaatagtgtcaggcacataatagccattcaataaatatttattgagttaattacggaatcagcagcaattttctaaacaagagctaaatcattggcttaatgaaaataaagactactgataccaaattagtgacatgtaatccatactgaaaattattttacatttatgccatcatcatcattagatttaataaatgccagcatgtcctatgtgctgtattaagtgcttgatgcacagtatctcattcactattctccatactaacaaccaagaatatcattaaccatacttacagttaagggaactaagcctcagagaggttaatttctcactcaagttcacatagctaacaaatgacagagttgggatttgcaaccaagcctacctgccttcagagtattgatttttaactacaataaaacacttctaagagaggaggaattttcttcctgttcaactgagaaagctaagatcctgtgaagttaagaaatgtggcccagaacgcagagttcagcagagatttccaataaaatgttctttccactgttctccttatgagccacagcaggaaaaccccttagcagaactgggtgctatcaggttgcctcctacgagaagatgaattttggaagaagcataattaatactagcaggcattaactgaagcctgttcttttctttcctggggtccagtctgcttctctaaatattagggcttggcctcattcagggcattaaggacttcattaggctgaaatccaagttaatttgattgcacaattataaactgtccctggctggaggttgtctcatttgccaggttgcaagggggcagcatggctggatgacatgcttttgatccccagcttgaagtttcagtgctttctggctttgacctcatcaagttttacagaaaggaagttaaattggagcagggagacagatattctccttactaaagttgtcacgggcacacagaggaccattcatcaggtctgcaaagaaacaaggcacaggaaaagtcctggtcacccggaggtggcagcaaatgagatctaaccaaaggtccattatgcccaaggtcactcacccacatggcaagcatacatccaggctgacccctttcctctttcctgtgcctcattttccccttactggctaacaggttattcagcccgggtatgcagaggagccaagggaaggaataaatcgcttcgttttcaacagggattttgttgacattagtagaatctggaagcatccacttcatggagtagcattttcctctcctctgctattcatgcaagtgatcaaaggacccacttccagccttcctcaagagaggcctctcctccagccaacaaagtcccttcactgactatttttgtaaagacattaactttgcccaaagagaggcctggccttgtcctgagcttctgggaggcaatgtctaagcccttggagtgtcatgcctgataaaagtgtcttttccaggggtcttgggctggccagatagtaacagtgttattttgggtaggggctgaccatgccagaaagtctaacaatgtcatttatgatggaggctttgggttacatggtatccatccacctccaggggagcaggggactgaggctggccatgagggcagtcattcaagtttacatgatccagtcccagtaaaaactttgaactccgaggcccgggcgaactttctcgattgacagtactccttgcgtgtagtcacacattgatgctgggaggtaacacgatccatgactccacatggaggagataatgaaagcaccatatttggatctttcccagactctggcctatgtactttgtcctttggttgattttaatctgtatcttttccctgtaataaattgtaaccgtgagtataatagccttcagtgagctctgcagtcctatgcattatcgaacctgaaggtgacttggggaacgtgccaaacctgcagttgatgtcagagggaggatggtcttggggactgctcaccccatgcccctcttctgcagcatccaaattctacccatgccttgggacccaactctagcctgccatccttccttaaagttccctggattactgcaaccagcaagtatgctggcttctacactaaaagctagtgtttcttaaacgctttttagcaaattccacagtaagaaacagagtttacgtcacaaatcagtacatttatacagtatacatacgtttatacagtatatatacatttatacagtacatagatctatatatgtaatggaaacaaaagtttcataaaatcaaattgaacttctctagctatatttccatcttgggctgatcaatctcatgttttatttatttatgtatgtacttttagagacaaggtcccactctgtttcccaggctgatctcaaactcttggcctcaagccatactcttgactcagcctcctgagtagctgggattataggtaaaagccaccatgcccagctgtgtcatcttttttaaatgcttgtttttcctttcacaaaccatgaatgagttgagattgcagttttcagaagcacaggtctcgtccattattctgataaccgatctctttactgccttacaatacatcttattttgtttcttaacttcactgtgtttatatctcatctctctcaagacctgattaaaagtttcaaaacagacctcaaaaagaacaataccaataatatctaatactttttttggtcatgttcaagctgggcactgtactaagagcctttccatgcagtgtctaattgtttccacacactactatcaggtaggtattatccactatgacatctctcatcaccactttcaccccatgtgacaaaggaaagacttcatagcttggaaaggttaactggcttgcccaggacagctacaaagtagtagagccaagtaagccaagaaggtctggtctgattccaaaccctggtgttcaccactaggctccttcctccccactttctttttgcaaaattgtttttttaaagacagggtctcactctgtccctcaggctggaacacagtggtgcaaccagggctcacttctgcctcaaactcctgtgctgaagccatgctcccacctcaggctcttgagtagctgagactataggcacataccaccatgaccagctaatctttaaaacattttccagggcctcactacattgcccaggctggtcttgaactcctgggctcaagtgatcctcttacctcatgtgagccaccctgcccagctacattcccacccattttcattccccgccagagctgcccagcagacctttttgccccagagtggaaagggcacagatgacaaatatgaatatacaattctggcccagtgggctcaaagaggagggagttggcaatgtttcctcttcagccagcattcttttcaagcaaagctctgtgaccttctacccgaaggcagcgctctcaggcctgtctgttgcggttcccctcactcatctcaggagagtctccttccagaatgccaggcacccctgcctgcctccccactgcctcgccttccctgcaccaattaaactgtcacagtcggctggcttggaggcaggtgaggtcaggaagaaatctgaaggaagctgggaattcagatgagatgaggcctccttgtgctgaagctcctcttctgttttctgtcaaactggtctgaagactgattggatgagcccatagagatccctggcgactctctacactcacctcttcctctccaatggagggtgagaaatacggccttgtacagaagtggcagcttttgcatctgtttgggtacccagtggtccctagttcctggtgcaacagcagtgggtctcgggtggaatgattttggctggagattgtttgcatcctggaatcattgcctaaagaggaatttgtcctctacaaacaagtgctaacccacaatacacaagagaagcaaatcaaagagctcttaggcttggcctaatagatgcatcttgtcttacctaccccttttagtgttgtctgttattggaggaagaggtaggaagcccagggcctccctcccagagtttccttagcatcacctgtcattgttgagattttgaatgcattgcaggttaagggacacttgatcaagaagggaaaacacagcagagactttcacttagacatgttttgtatgtcatgcagggaaaagttcccagtcaacctctgcttaaccttcgggtttgaagatggccctctggcagtcacctgatcttcatggcagaagaaacaggagtgaatgagcagatgaatccatcttaagagaatagaaatccttagtttgggtttcattgaccaactatagggtacctggcaggcaaaatttttgcagctttcatccaattcccaaatgggtgtttgacccacaaaagaaccaccaccagtctacatggtaatatacatacattgccttctataattttacttgctgtagctgccaaatcttattcatacttcctccaagcataagcacatgcatgcacacagacacagccgccaaatgcaccctccttgtctactcctcagcctcacctcgtacctgataacagattgtactcaaaggcactggaagaccacatggctgcctggagcacctttcaattattaatgctgttctttaaaggccttgccttattatttctactcatgctattatgaagagggcaaactccttaatgcactcctgtgccacttcctcccactgctagaggaaaagcacatgctaggtacagtcatctaatagcatccacgttattttcaccttctctgcacactgtccctgcagttctctctggggcctcaagatcaattgtatctcaaactgggccatgggttcattttctgcattttctggcatggagtgagggtagcgggtgtatggaaattccagctctcaaattacaaggtggcaggtctctgcatgggtgtgatgagcaacatgagataggtatccttgttaaggacaactgcattctagtagattccaccatcagaggtcctggagccctacctactatttcttcctgagagtgtcctgataggtaaaaggtggtgtgagtgtcttccacggggaaaagagactgatgaggcagctctactgaaatggcagttgatattaatagggccatctacttcctactttgaaaatatctgagctataagctcagacgctacctatcactaactgccaaatttccatgaaaaagggtcagtgatgaagttgtagcctagacttgggaccatgtctcaggggaaaagtctaagtatgcctccgattttgttttggaagggacgacaccgtaagaatttcatcagtaaatattaaatacaaagttcagcaaattgtgaactttagggttcatgaaaactaaagccaggatttatccatgtcaacctgtaccttatacctacatatgctagaaactaaatcaagtttcatacaatgtgcccatttagctaagtaagtcagaggatagtttccaataattactaacacttacacacttagtataatcaactcttctttggtcaagttaatatcctggcagaacagacagatttgggcctctcttcttataaaaaaagaatctgacaatttaaggggcatatgttcacttccatttatgtcctggaaaatatgccctgtgacttagcaaccatgttttaaaagctcttgcagttcttaaacaaacagagtgtatgtttatgagcttctaacaacgttattttcagagatgatgtagagttagtgatatgtagctctggggcttacagtaagctgtagatgatttattggtgtggcatacagtatttgcctcgagaaaaatggaaatttaagcagtgtttgaaaatgtgttagatggcaaacgacccggggcaccctgagaccaaaggcttcccatcttagagagagaaggggtcctttttggcagatggaggagcaagggttaagaacgtttcctggcactcagggagcacagccaattcaagaccagaaagagagacagtttagaatagaggctgaaaacaggaggcccaaatctggcctgcagaggtgttttgcttggcctgcaagtactttaagagttttggatttgaggccaatattttaaaattggagattcaacataaaatgcagtattctgtctcctctttgaaacacaggaagatctggccactagagcctgcatttctgcataggaacaatcagctggacctgggaagccacttcaggtgaggcttcagctctcattgcagtcctcaccagatccgcctcactcatttccaatgtctgcccttccctgtccagatgaatttgcaaacatcagatgaaaaaaatgttattttgtactgttgcactctcagcgaacagatctcttaaaccagtaagactcattgtcagataaaagaatggaaaaggcacatgtttttccaaaactcgggagaaaagcaagactattaagttgtcttaaaatttttgttgtatccattgttttgaatgctgggttgctgaagttcctatttcccaaagccaagttatcagacagggcttaaaataaaatgcttattttaattttctcatttgaaacaattagaccacattgaaggggtttagtataaggcatctgtctctgagcatgttttcttatctgtgaaaatttccagaaggatggggctgttggaaagggagaaataaagtcaatttctccagcaggcagtgcaggcacagtgcctgaggccactgtacttatgggacacaaaaaagtctaaattttaacttctttaaaatcagaagaaaataaatataataataaatgacgaataataacaacgaatccaggctgggcacagtggctcacgcctgcaatgccaacactttgggaagctgaggtgggaggactgctagagcacaggagcttaaaaccagtctgggcaacacagtgagacccccccatctctacaataattttttttaattagctgggcatgatggtgcccagctgtagtcccagctactcggaaagctaaggcaggaagattacttgagccctggaggcagaggttgttgtgagccatgattgcaccactgcactccagtctgggaaacagagtgagaccctgtctcaaagaaaaaaaaaaaatttgccagccatggtggtgcattcctgtaatcccaactactcaggagactgagactgaaggatcacttgagccaaagaggtcaaggttacagtgagctatgatcatgtcagtacacttcagcctgggtgacagagtgagaccgtgtctctaaaaataatagtaataataacaacaataataaatccagcctggattatattcattcttataccaatgcagccgcaaaatataatatttaatattcttatggaagaattggctcaacaaagccaacgtacctagagtccatggaaatcacagcacggagctggaggcaaatgctggtcttcaggccaacaaccatgcccacactgtggcctgtttgcgagcagcacaagctcattttactgcagactctcctccccatcatgcccctgtgatgctctgtatgtggcaagttcgtaacaagacccctgcaaagcacgtcgcacactgacctcagtttcaaaaagatggagtggatgccattcagatgcttctggaaatttccaaataaaaatttccaaaagttttaatcatctatcattggacaacaggtattactgccactggatagagtccgcttctctgattattttatgccgtccctgaagcattctcaatccctaatctcagtagctgatttcaaggcaaggttttgcttgactttagcgtatactgaaaatcacaaagcccgagtacaggccataatgagagtcttctcttgtggactcctagagttgagggcagactgagttttctgtctattcaactcaaaatctcccctacagccaaaacatgttatagcatccagctatcttttcaactcctcaaccttcagcacttactgtgtgcaatgctcatattagtcattgatatattgcttagcgatgccttacttgttcttgttttgttatcttatttttcctttatatatggctggacttcctgccccttgtaaaaatatgtataatttaaatgtcttaatggaaaagatctagcattatacataagtactcaaaattccccagtacctagcaaaatgccttatacacagtttgtactcagtggagagctattatctgattggtacctttaaggccacaggtacacagacagctctcagcctcatctctgctactgtgatgagcctggtggccaattcccccatgctcttcttctccacttaatttttaggcaggacataattgtttcctacacacacacacacacacacacacacacacacacacacacagagtctttctctccctctctctcttttctcccaaattctatgaacaaagacatatgcatcaaaaagtcccaagggcattgttgctttgagagttctatttttaagccacaaatgactcatcaccaaccagggtctccccaaagctacatgtgtcaggctgtcaggtcaaaagacaaggggtaaaagacaaggaagagttcacatctcctccagcccatgaaccccatgataaagctgtaaaagctgccaccactccacacaccacaccacacccctaccacagttgtgttaggcacaagcactgcccttgtgtttggattaaactgttctgagctataacatttcgctccagctggctcctatcctgatctctcagcagtctctgaatgcatgtcagcctgtgactatagggaaaggcccagtgccatgtgacagggaggagatgcagccctcttgcggtataaactcaggcttgttgtagaggacagaagtaactagtgggctagtgggtctgaaagggaatgcatttcttcatttgccctgaaacaattattcttttaaaaagaataagagagggctgagagagtgccaggttgtccaaagcattctttttaagttttggagagtggcgagaagggaagaaataattcatcctaattttggaaggcaaagtagatagggatgtatagacatagttatcagatagtgtttccacaggggaaacaagtgagcaattgggcaaaatgtcctcaaaagttatgcataacaaattccaaacaggccaaaacaatgtgttcagctcttcaatgcgttcagccctgtgttacccttccacagtggagctgaactcttaactcttacccatccccaactccatgctgaaacagtacaaaaaagagagggagacagtggggagggagagagagagattagtaggagggtcataaaatcaaggaattcaaggcctctcaccagtgaggatgaaataaactaatcccacgcagccacctggctggatttgatcttttccacctgggattatctttgttctttcccatggccctaaagtttcccccatgataagggcctagaagtccagaattggcataaaaagacaatatatactttgctattcaatgagtaggttatcatgtctttgttcatttctgtatttagtagaaagaacccaggagatcaagtagaaaaggactgggagagaaaagttctatcttccagctccagctctgcccctggctggtcggatgaccttgaggaggtccctcatcctcattcctcaggaaaggatgctgaggctcagagaacagtggcaccagttgggatccaatgcctctttgactctaatactatattctacagttgtcttttgtggcagacctgaaaggttcagctcagtcctcctgtcctttcctagcatagtccctgatttccccaatgaaagccaaagataagcagttcccttaatgcttctagatgccattgcctacgatgcctaggtaccacttgtgcaatgacaaataagcaaggaagacaagatttcctcaccaatgtggaagggagaaggaggaagggtgctaatgctctgaactttgacgtaaatgaaaccaatctgtttgacaaccaaagaacagatcctgtccccaaaatctacctatatggagacaaggacatataaagaagttgactctgttccttggcatactctccacctgtcttctctaccaggctttcactcgattcctgaacaaatggcaatatggaaggtcagatgagctaggaaggctgagttagagttactctcatatcagagcaccaagtgttgctattaaagggtacattctgaagggagacaagacttcccattggagttatttacagcctctttgccctgaaggcatcttctcttccaccatccctgagtgggctcggctcctctaccatctgacattccattctttcaacagctgctggctctcctgttgtgttcccttcacagatgtgcagtgccgttctgaacatcctgcccttgaactttccctacccataattttccaaaccaaagcctggcaataaaaatgtcagtgagggatggagaaaactggggggagtattttaaaaggaaaaaaaaaaacagggaggtgctttgcacacagtgatttgtgttgacttcttcaacaaaggttaaatgcatgccgtgacttctcaaaaaagggcatgaaggcagacagctggagctaattttccagaacactacctagaaaggctgtatttcataaaggaactggttacagagtaggctggtgagcttccttttccatgtcacaggctgcccatctcatcatgctgcaggatggggtacactaaaggggatagtgaaagctggtatacacagtcctttacagtttaaaatgcgctgtcatgaatgggatgggatctgtgctgtcctcacagctctcccaggtgcctgtcttggggctgagcacaggagaggcagtgggtctacacctgtgcctagtcagtttgaacaaggctggagaaggaagccagatactttatgacatttcaaagacctccatcctatgtggctccattctttggggccaaattttcctgaagtccattagtttgataataccaactctctgggcatataaacattgcataacataatgcaaaactataacaaatcaactaattctgtaactctctaaaagagataaaagaatgtatctcatggggaaacagcatttctcatatctatttcagtatgccaaatcacaaggacagattaggtaaggataggaaggccaaagagtctttctacttggaaagacacccctaggtggtggaagctaatgaggaacaatcagctctccttgttttttgttcatttgatcctatctcattgcaaaatgctgccactccactgagataacagagaagctggtctcatcaagccattattaggaagaactgaatcaaggcccaaacagacatcagacagcacctgacccagggcagtgtcttacatggaaggcctgtgataggagcctcctacgtacccacaactgcacacttggttctcagggtgagaaatggagaaagggagaacaaaagagaaaacaagaccagtgcattggcaggatgaggtgatgcaacttcccattcttgcaacatctcattaaaccccatcagttacttacacaatctggaaatttacttcttgacacttagaagagagatggctttagaatgagccatgctggaatctaatcctggctctactgcttactagctacatagcttgggctatgcctgcagcttcagcctcctcatctgtaagtgggaatagtaatacctatcctaagaagttgttaggggaattcaatgaggttgcatgtgctatttttggtaaagtgcctagctctgtagctcacagacagtacataatcagtgaatgttagttccctccaacgacttgccctctcttcccttttgaaacagaatttctaggccaagggatgagagaccaggctatgtgaagacaggggagggagaaactactgggcaactaaaccagttctgctaaagctctggacatccccaatacatcaatggtgccagttttattttcagagactatgaaaacaatctggtcaatttctatcgcaatcttaaagatagttttccttaaccataagcaattttactgcctggaaaatattcagcattatcacatttgaagatgttacaaactaataaatgaatacaaaatgaataaatgggtgagtggatgcaaaagtaacattttaaaagactggggagaggccattttccaatcgtaaccccactgttgccttggcaattgtgcccttggatgagatgctctacaaaatttgtgctgccatttcctgctccttcctaacgtccatatccccaaaacagcagtgctgataccagaagccaagagcaaagactggcaaaatcagcaagtgcccccattgtgtgccagccattttggagcagataaagtcattaaggaaacatttaacaacgtataacctttcagctttactctgcaaacagcaggtagcttccctttcagagacaagagcctgcattgaagtcaccagtgagcaggacttgaccttcattttcagtatacgccacattaaatattcataatccgcgtaaccgtagcataagaagtagcagcgtttaaacatgaatcaaaggaataaatatcttcacacatgtgagtcatcctttcccagaatgcccctggtgaaaatgcaaatacccagagctctgggcctctgtctcttccaactttctcttgaaattctgaaagctacagggactgctgcattatgcaatccatgaatctcgctctcatgctgacactggtgggtctttgttttttttccttatctgttagataagaattgctgttcttgtgtcaaagggaggaaatagacaaggatggaagcagcaatggtgacattagcacccacagggcgtctgcaggcactcttgacttggttgtacaatttctaaaaaatctttgcttcacaaggatcagaatatgtgggaggacagggttggcgttggtgtcgggagacatcagaattaggaactaaagtgacgtgtgacataaattgggcaggagtccttttaaaaagaatgcaaaagaaagggagctttttgtacacaatccacctcgtgtggctaattggagatctttggggagatggtgtgtggagggctcaatgcttgtctgtgcttgttaaggcactaacatgatgtctgaccaaagactcagtccagaggcatcttcctctgcttgggtgtttctagagagtctactgctgggatgataaagcataattttagtaaggtttaacgtaattatctttggttttcaattccaggagctctgaggacaatctgtcttagccagatagtaatcacttgcagctacacaaatgagtcttccctcacaaccaccctaggttcattaagatcagacccaaagaaaacgccctatgctgggatctgtctttgcctaatggccaaaaatgaaaggtgtgcagctgtctttggaagtgacttatccatcacctctggatagtaaaaagagctttaaaaggttaaaaagatcataaaccaccaatgatgacctttctctgagctgtattgctaatggacagaagtaaaataactacctagcctgcttgtccacttgcacaactggagctggcctgcctcgagacatagctggtccagcagacctagggagcctgttttatacattaatcggcattccttgcacttttcaaagggctgggtgcagagagcctggaatctcaaacttgtgctacaggatagtcctcagcattctggaggggaggggcagctctggctaaaattcactgagacaagccatttcacgcatgtctgttggtttagattcacttgtgggaaagcctatagactgtcccctgattcatttatttgaagggtgtaaatactagctacaattcatctggagaattctgggtgctttttttccagggtgatgatttagtataacttccacgagaagtttaaagctgtctttccaaaatacccagatggccagccaaaccatgaatgtgtaaaactggtaacagttttgaatgaaagacatggattttaagaatgtacattctactttctcactttctttccatttgcatcttatatgtggatagaacttcatttttttttctcattcactaagctcgattataattttttaataggtttcactgtgttttattcctggaaatctatggacttaccatagagatggctttagagattctacactaattctctcccaaactaaaactgagcttgcttgccgtctttcccaaggaagatggaaaactcccttgtgctgaatccactgattgggcctgccaccggacagaatcttcggatatgctctcagaacaaaatgaagtcatgaaaatgaaaagtttctatataaataaccagaaggtcttcttataaacaaagccttgctatgccaaatcacacagtttagcaacagagaagaaaggctaaagctgggatgaggctacgacagtcctcaggcagaatgggaatagccttgtttctaaccttatgggcatttttgccaggaaaaggtgaggacaggactgaagttccatccttgggatagactatttgcaagttcataaaagaaaccagaatcagagaggactcccagtgccatcttcgccaaggcctagaaggatcacaattaaagccaaaggacattgagatggtgtaggacattaggggaagagggtgcattggggaatttcattccttttcatcttctcacacggaaacagagaacaccaggatctacagaacaaaagactgcctcatagtagactgtaaaaaaagacacaatccaaatccatctaaagagcattttatttctgagaaatacagagggacaaaaggttaaaaaaataaaaaaaataaaaaaacgaaaagggaaggaaggtgctggctgaggcatctggacttctaacccatcaacacactcacctccacattagggttttctttctctgggacatacaagcttcaagcccaaacctctttcctgagtctcagcatggaagttggcagggtctgcaccccacgacatgtaagaacacccctggagagagattggagaaataagaccaggggctttagaggatcttcagttcaatacaaataggatccagaatcattaacagtaaatatttaaaagggggcttaccttcaatgacatgccaatgggagtcttccaaacttaaacaagctcttctctttcttggctcgggagagctgatggagggagcatgtggaatcttgtctcctgacagcgtttaaaggactctccatctgagatgggtgagggcagcccagcctcgcatgtggggtgggctgaaggacctctgataggcttaaacttggctgattcccagagacaggttattaaaggagatatttgctttgttttccctgactgacattttggcctctccacccaaatgcacaaaatccttggccggtgaccagatggctctgagaaattctgagtttagctgtgcatgaaattaccaccatcccaagccacaggaaaggagcactaagctcagaattcaggcacaccagagtctgagccaacaggcacaccaagcaggtttcctagtatcaaagtctagtagccaaccatgccagggatagagtttaaagttcaaaacactcacacagtggacaataaaggcaacaagctcaaggccattgtcaccagagttgccaagttcacgccacaacagaaaatgagttagactccagcttgtttcccagatgccatcaacttcatgatttgcaatagtatagttggaacaaattatttcctcagggttggcacctgcaggaatcagggcagaactggctgcaacattgcagttctagtctgtgccctcttcatccttctgcaaggtctttatcatctgtcacccaggctcactctggagcaccagtccattcggctggcacccaaggagtctgcatgagtgtccactctagaagtcctcaaatggccagggcctccacctctgggggtcatgatgaactcctccatccatctccttaccttcacaagtcaagaagcaccagcgtgcaatgcttcagctgaatacccgattggcaggtgaaaggatagcatcatgctttctaatctgacctccagtaagatcaaagcattggaaacccaattgagaaaaggatcctacaaccatagcaagaatggctcagaccctcatctgtgggaaactgtcaccctcccagaagttgcaaattcccatcaagtcatcttaactacttgacatcttcagtgcaaatacatcattaggaaacagctctttaaaaataagtaatacccagcaagaagacttgacctcatatacctcaccctcctatgccagcagactcaaaatagccttccttctgagaactttctttcccatttagaaaatcagtacagtacagcactagcttcctccaaaatcttctgcactcagaaggtcttgcaaaggttggtgtcaaggtaaataaatggatcaatgtaaaggctcatgattgtttatgaaacgagggcaagaaagtatatttgaatactcactttgatgaatctatgaagtatattacaagtgcaccgatgctgagagcaaagactaagacaacctgtaaaagaagaggagaatgccatcacttaagagttggacctcaggatgtttgggttttttgacacataccgaagcagctttgaaatacggtgcccattgcccttggggacctgcttggaaatctcaccctcatccccagccccccattactgcttcaggtttggctcttcatacagcaatgggcagcaacctcgctccttgccaataggggtcagggtagccttttatgtctcagggcactgggtttttatctgaccctgttatctcgaagtccagcttctctgcaattgtagttgataaacttcagtgggaaaaaagcaggtgaaaatttagggtgatacaatttttaatattatatgtagtctaggatctgcaggaactccaatagaggaatatcaactttaacagcttcattgaggcataatttacataccacaatattcacccatttaaaaagtacaattcatcaatgactttagtaaatctactaagttatgcaatcatcactgtaatccagtttcagaacattttcatcatcccagtaagatccctcatgcctgttaaatcaatcccctttcccatttccaagccccagaccacactaatctactttctgtcactacataagagataccaatttgaagatcacaaatttgctcgtacaaatgtccgtgtgtgtatgtgtggacatacataaagatatattcactgcatgtatgatctatatgattagaacacttctgaaatatttaggaaagtagttccagttcaggaagtcaattaggcaatccattaggccagttatgtgacaatccttgtcctactttacactcttcactcaaaattaatctccatggatggaagacagttttggcatctccttcagtggatacctgtcatgctaaggtccatagaatgaatatgtagcagattaggctgacactgacacttctgtcctcagtacacattctactttctttaatctttcacagaggagactattaatgcaaataaaggatagtcagaaataaagaagatgctttcagccaacaattaagcctgagaataaaaagtaagcaccaccattacacacaatgcctggctgctaggtcaacctttccaggtatgctaataccctgaagagactgcaggctgaagggcattggaagtcagtctcctcagtgtccatctattgacatctctcaggccttggctggtgggtagagaggaatcccaatttatgtaaagactaagcatgatcaagctttgtgtgtgtgtgtgtgtgtgtgtgtgtgtgtgcgggcacgtgtgcctgtgtatgtatgagagacagaatctctctcttttacacccacccacacacacacacactcctgtattttttatgtgtgccaaagtggctgacagaaaatgaaatctgcatgagatactcatttaaagcattgcaaaactgcatggagctcctggggcagaatggtggcttgcacagcccagaaaatgaccattaaaaacaattggacactgtaaaaggaatatgcagtttcatagcaactgataaaatctccatataaagggaggtgctaaaacaatacaccactgaggtttatttcattctgccatttaaaaaaaaaaacaactaaaacatgctccaattgaatgctgcagtctatcagtaattatcacccgcccagcactaatccctcttagctgcctcacctcaacccctcccatcacacatattcattcatatgttcctttcaaaggtacacacaaaaacaagcaaacaaaaacatgagcaggccttcgctttttcctctattatctaaaggaggcagcaaaacaaaaagcttaagattaattttgatctgtgctgctatttctgaggcataagcagttagatcctggccctgacctcattctcaaaaagctgcaaagagaaggggtgtggccagaacccaggagaagggcctcttctccattcataaacagctgatttaagactaatccctgtccatttggctccctgtgtgtgtatctgtgaatgctgagcatctgtcagagctggctatataggcctatgccacccaaagccactgttgcagaaaaggactggaaagaagcccttgcaaatggcatctacatcattctgtaaggaactcaaaatctaagacccctgcaatggcaatgatttcgcagcatccagatggccaatgtagctgatcctaatttgctccagctgcctccacttggagtcagtgatggggactaatgcattccttatttaagcaaatcagccagtgacaggaggaggccaggaatcctgctaccctctgaagatgaaaactcaaatatcagcatctctctgatagggtaagagagggaagaaatccaggagggaaataacctccacagctccctggccctgaagactctgttgaatggacatgcatttgggtccacgtattcagctggaaggcctcctctcaatgagatacaggataggcaaactgccccatgatgtacgatgaaatgctccctggggagatgatctgcctctcagtattaaggtaactgtgcacgtagtcttgaaacttgctaaatgcctctttatcgtgtcaggcttgatcacattgtcagcccagatccaggtgctgcagaaaacacatcaatactttggatgtggccatgaaaatagaatccccatcagagacttgtcttctctaggcccctagcaaagccaccttagaagtgtcagtttagtctctctctttctctatctctctaacaaatccccattgtctgagaactctaagtttgaaaacacaaaatgattacattttagtctgcatggtaatggtattattatagagcaccccaaatagtcacctaagtatttaacatatcctatacataaggcccaagaaaaacagaagatgggaggccacttggagtcatgaaatatactcttttttttttttttttagacagatcctcgttctgtcgcccaggctggagtgcagtggcgcgatctcagttcactgcaacctctgcctcccaggttcaagcaattatcttgcctcagcctcccaagtagctgggactacaggtgcctgccaccatacccggctaattttttgtatttttagtagagagggggtttcaccatgttggccaggctggtctcaaactcctgacctcaagtgaaccacctggctcagcctccccaagtgttgggattacaggcatgagccactgcacctggcaaaatatactcttttttatagagtcattcttctgtagattaatcccatgctattatgcaattagtgataaatcatatagtacaggtttagccaatataaaatgaactattgcctagatggatcattagtaactgggtaaagatagaaaaagtagggcccttatctcaatatcctctcctttcccaaaatgtccttcctttctacatagtaccactactctaatatctcttcacgaagggctgaggccattgggaatccttttgcaagcttctatagtttcagggacaaggaggacagaagcccaagggacatggtaaaatgaggccaaggaaagcacagtaccccagaaagcaaagcatccctgccctacagcagctgagtcatagaataagacaataaccaagcatgtaacaaagcattgtcccacacaagggcttgggggcagcagtgtgatacacagataatttgagcattgcctcttagggcacttctgctagcttgcttgagagcctgtcctggttgctaaacttgccatagtctgagctcaacaaattacctcagccatcttggacagtatgaattgtcaccttctcagatttactgaaaacacccatatactgtgtggagatattgagtactcggtgtgccagattcctaaaaacaaaagcaatttgataaatgtcattggaacaatggtgtttgagtcatctattttcaaaactccaagatcaaacaagacatgtgtttgcacaaaagaatgccaggaacacacatacacggtgtatttttttttaagggcagggtgcagtggctcatgcctgtaatcccagcactttgggaggccatgacaggtggatcacttgaggccaggagttctagaccagcctgtccaacacagtgaaaccctggctctaccaaaaaatgcaaaaattagcagttgtggtggtgcacacctgtagtcccagctacttgggaagttgaaacaggagaatcacttgaaccctggaggcagaggttgcagtgagccaagagtatgccactacactccagcctggacaacgaagtgagactctgtctccaaaaaaagcaaaataaaaaaatataaaagtgggctgggcatggtggctcacacctgtaatcccagcactttgggaggccgaggtggggggatcacgaggtcaggagttcgagaccagcctggccaatatggtgaaaccctgtctctactaaaaatataaaaagttagccaggcatggtggcgctcacctgtattcccagctactcaggaggatgaggcagaagaatctcttgaacttgggaggcagaggttgcagttagccgagatggtgccattgcactccagcctgggcaacagagtgagactccatctcaaaaaaaaaaaaaaaaaaatctgtccctaacacctgatgcaaagaaggagcctggtgcaaaatggggaggagagaggggaagtccatagccatctcgctagatgaaaatcccggtggaccatgaagatctttcaaatgtctgacaaggttcatgaaagttcatgaaaatggacaatagcacagccaagcatagactattccccctcaggtgatggagcacttcaggaaaaaggcagattcagtgatgtgagtatagaggtgattgagttgggaaagctggctcttagaaatatttcctgttctagaacctggactggagttgctgcaattaggcccatatgctttcagcgggtgtgtgaggcttcacggccttgggaggcagattcagagccaaggctcacaaaggtggctaccaccagaatccagtcacctgaggagctttccttccaaagcagagatgccctcatcccaccctagggccagcaaatcatgagctgggggaggggaagtctgggcacctctttttaacaagctcctccagtgaatctgacaatgggagtcactgaattaaagccattaggagaaaccacttagctcaagtcagagattaatctacaaatgtcgccttaacaattagcccattagaacatatgtatgaggcctgcaggcttagagaatcgtgctaggagtactagaaaaagtacagagaggaggatgaattaattctctcctgagcaggttttacacattcttctcagctcacagcagaacaaatgaccctaattaatgattctgcatgtttgatcagggtttatctgcctactgaaggcagagacccttctcagaaaatggacaattttctatatatgatcccaaaggcataggactttttaaattgaagtatataatttacatataataaaatccactatattaaaaaatacactttgggaggccaaggcaggaagattgcttgagctcaggagttcgagaccagcctgggcaacatagagagaccatatctctacaaaaaaaactttaaaaaaattatccaggcatgatagcatgtgcctataatcccagctactccagagggtgagtcaggaggatcgcttgagcctgggaggtggaagctgcagttgagctgtgatcaaaccactacactccaacgtgggtgacaaggcaagaccctgtctcacacacacaaaaaagaaaaaaatagatgtgagaactcccaaggcaaaacaatctggtgacattttgttttttgagagataatatcattccaacatctaaattataatgtttttgtcctggtgaatttattaataacaatgccaacaaacatttattgaacacctatgcacaagggccagagtgagagacagagaaatgcaaaactgaaacagttaagtctggcctggcctttgccctcagggagcatgggatctagaagtttaaattactcaagagtcccttctgaatgtaagaagcgctacacatatcaacagtcatctccaggatataaaggaaggatcagatcaggcagagaagcaacaccaccctcatttcagactcccaaagtggaacggggagagaaagtgagaaatggaaaaccaaggaaaaaggaagaagaatttttgacattccaagtccacctggctgttctaggaaaggacagacaccagtgatatggtttggctgtgtccccacccaaatcttatcttgaactgtcgctctcacaattcccacgtgttgtgggagggacctggtgggaggtaattgaatcatgggggcgggtctttcccatgctgttcctgtgatagtgaataagtctcacaagatcagatggttttataaaggggagtttccctgcacaagctctctctcttccctgccaacatgtaagatgtgacttgctcctccttgccttccgccatgattgttaggcctccccagccacgtggaactgtgagtccattaaacctctttttctttataaattacacagtattgggtatgtctttatcagcagtgtgaaaacggactaatataaccaggcacacaggatgagtgatgtggagaaggaagagcacaggacacagaagacctgggtgtgaatctccactctgcccctataagcaacatgctcttaagcacgtcacctaatctctctgggtctaagtttcccaatctgtgaaataatgagattgaaacagatgattatgagatgggaccttggtaggaactaaaaacttttggcttgaaaaggtagccctcacttatgctaactgtaaaccatgtatacataagtctgattcaacatgctgacaatatgcctgtccctaaatctgtatgcaggagacttgtttcataagatcacaagaataaactccatagacactcagattcatagtttgtgtttccagcagcacaatcaattgctcatgcagaatgtcatcccacaaaactaacacaagacatagaagggccatggatcagctttctcctgagtctgggtctcagctctgccatcactacagaaaattgagtggtggtctgacccatcgcctccctctccttgcctctgtgagctttgaaaagcccatgtttttgcaggctttagccttccagaagctcagactgagtctcagtgttttcctaagggaaaaagaaaatgatttttttctctttactgtttagcaagtatagttgatatgttcttgtcattcctaagtcatgaatggttctcaatagaagaagatataggccaggtgcggtggctcatgcctataatcccaacactttgggaggctgaggcgggtggattacttgagatcaggagctcaagaccagcctggccaatacggtgaaaccccatctctactaaaaatacagaaattagctgggtgtggtggcacacacctgtaatcccagctactcaggaggctgaggcaggagaattgcttgaacccaggaaacggaggtttcagcaagccgagataacgccactgcactgcagcctgggcaacagagcgagactctgtctcaaaaaaatatatatataatatataatcttgccaccaaaaaaggatttttgttatcatacatttaaaaatatctgtaatatttctgcagagccatttaatcatccataggtcccctaaattaccaagctagcactatgaaacatcacatttgacttatggaagcacatgcacaaaaatgctgtaaattgattcactggaaaccaagactccaaacaacggattaagtagagatgtattcaagatgaaagaaaggaagaagaaagaggggctttgtagttggtatttgggattatagcattaaaataaaatgcatgggattgccagataagagtaaaactgatttgttcacatgtaaggaaacctagtaaaaatctctatgattttacaggcattaggatctggtgcttccaaaagtgcaatactatgaagccatactctgtgtgcaatggactgaattcttaggacacacatgtaaatcggagagaatccctccttaaatcacctcaaatgtcctccataacttttggtatgaagaaaaaaaaaatccttgacagagtccacaaggccctgaaagctctggtcttttcctcctctctggctttatttcacatgcttccacatctagactccaggaatctaacttgcagttattctcattctccatttgcctcctcccaccccaaccaccacagagccttcgcacaagcactttcctcctcccagaagcctcacctgctcacatgggatgcccatccttcagaaatcagctctgctgtcacttccctgcccacaggtattctgttttgtgtagcagttagcaaagcagcaattttacatgtctttgtgcaatcattttgatcaattgctctcctctttcctttgctggatggcaagttctatgaaggccgggtgtgtgtccatttttagttatcacgaaattccaagaaagtagcaaagtgtctcaatcagtatttgttaaataaataaatatgtggagaaaaggctggagaattagtttgaagactgagtgtagtggaagcaaaagagaggtgggagaaacatggattaccctcactgagtgagaccctgaagtttataacccggaataaaggtgagatgcagttccaggtaatggcagcatccaggggatccctggtgaaagtggagcaggaagaagagcaccgcggtggtagaggtcgagggtctgagacacacacagggatagcaaggacagtcctgcacacagactcaaaggggatggggggagctgaggttgagaatagaagaggacagggccatccctgaatagggggaggggcctggacttagatgggtgacagcatcaggaaggacagagagaggaaggatttggtcggatggcaggagcctggagaaaacaggtttctacaagaacagaagggcaatgaagggccagagtgtccagcactcctgggttacaaagatggcccggcatggtggctcatgtctgtaatcccagtactttgggaggtggaggcaggtgggtcacctgaggtcaggagttcaagaccagcctgggcaacatggtgaaaacccatctctactaaaagtacaaaaattagttgggcgtggtgctgtgcacctctattcccagctactggggaggctgaggcatgaaaattgcttgaaccccagtggtggaggttgcagtgagctgagatcataccactgtactccagcctgggcaacagagcgagactccatctcaaaaaacaaacaaacaaacaaaaaacaaacaaaaacagaaacagcaacctccagagagaggagtgagggaaacaactatgtctctaggaaaaacagattcaactgaggtggcagatatagggagcattacgtgaagaagcagagaattcagatttgaatcaggactaggaatctgtgaaaacagatgtcataagaaagtgagatggagaggcataaaataatggaaatgccaacgttccaataataagtgaatatatttgtgtgtatttgtatgcacacaaacacgctgcaaggggcacagagacaaactgtgattcctctaatcagaaagaccgggtctctgtcagtatttattaaccacctgggggtctctatcagtatttattaaccacctgcatgccccccagcagtttgtctctgtccattttcaaatcaggtcacttcaaagtgactataaatacatacgaaaccctgggaaacaacagggttccctcttactataagtttactataaatcatgcatccatcagtatatagacaaagttaactgcaatcatggacttttttttgagagggcagaagaaaacttgactcatgcagatagacacagtgtctgaattctcattttttaatgctccccaaagaagaatctgggacatgattactacaagccaattgcccaatctcttcccttctgaggcctgtgacataactatagggccagagttatgtgaacttctgcaggttcgtgttccccaaacatcgcaggagtgttgtcctacatcctggattttgttgatgatgttcatctcattttgcccaaattaaaaatacagaaaagttcaatatattcctcctagggcttaatttattataactgaaatgagggaaagcagttgtaacaggaagtcagaaaactttccctaaaacctgtgtccttcctgcaagccgaggtttaatgacactgaaatcttacatcattgcatcataaaacttaaaaggttgctttttgcataattttaccaatgacattaaaaccgatgcactggcaagcatgataaaatcttccatttgaggtctaaagttggaagacctttcctgtccaagtattgaaaaacctaggggaaaaagttccatctgctggtggagcgctcaagtttgcagctaatgagctttttaagaaattgtctgacttaagtgcatgtgggtttggccaactggatttttaatttaattaggtttatgagatgagaaatcttctgtagcgtagtcaggtcagaagttgccactcactgtcaccaaggactaaatttgtggctatctttgccctacttctcaaaccctgccagttgttaaattacattaaaggcaaaactggaatttaaagctgggactcaaacaaatacttatatgcccatgtttgttgcagccaaaaggtagaagcaacccaaagtgtccatggacagatgaatggataaacaagatgagatctctccatacaatggaatactattcagtgttaataaagaaggaaattctggtccatactacgacgtgaatgacccttgaagacattatgctaagtgaaataagctatacataaaaggacaaatattgtgtgaatctacctaaaggaggtaactagagtagtcacattcattgagacaggaagtagaatgatggttccttggaagtgggagagagggagaagtggggaattattgtttaatgggtacagagtttctgttttgtaagatgaaaacagttctggatatggatggtgatatggtttggatgtcttccctcctccaaatatcctgttgaaacatgacccccagtgttggaggtgaggcctgatgggaggcgttttggtcatgggggtggatccctcatgaatggcttggtgtccttccagtggtaatgagttagtgagagatatgattgtttaaaagagtctgggacctctgcacttctttcttgtccccttgctcctgctccctctcttgccatgtgatacaccagctctccctttgccttccgccatgattgtaagcttcctgaagtccttaccagaagccaagcagaagtgggtgccatgcttgtacagcctgcagaaccatgaaccaagataaatctcttttctttataaattacccatcttcaggtattcctttatggcaatgcaaataactagtacagatagtgatgatgattgcacaatgtgaatgtactaaaagccactgaattgtacccttacaaatggctgaaatggtaaatcttatgcatattttactgcaatttacaaaatggaaggaaaattctgagaacccacaagtagaattcagaagcatatgtatatttaaaaactcaaacatcataaccctcccacaggaatactgacatctctcaattcaatggcagtgggtatctccaagaaacttgtattacatgcaagtgactcttccctctctagagcattgatcttaccccctaggatgctggaatttctcctttcatttccagaatctatccccatgtagccacagagatgttatgtgtgtcccgcctttcccttgcactgcactctagtctacaaccaatgcccaaagttggctatgatttttttagagaccttattttgtctttcggtaactgtagctaaagtccaagatataattaggaactttaaaagagtgttcccttcatcctataaccactttacaaacactcaacaatttcctctggaagataatgaaacacacagagggcatctggtccctaagactaaacctcaaggtcaagcttggttgtagctcctcagtggcttaatggaacattgaaagcacccctagaaataacataaaattttcatcttctacagcaaggattttggcaccaaggtcttactttgtaaaaggcttatgtaaaaggcttatcagtgcatcccagaaagcaatgccatctaagccctatagtgtcaagggagttggccaaaattgctaaatgaccattcagctgacgatatgacaccaacatcggctgtgcaggtgcatgctcacattcctggcaccaaacatgtcacactccattttctcctctgcagaatcgaatctgaccataacaatggactgggcttgctaagaatgatactagcatgcctctttgttaagactttcagtgggttgaaatccaggtctccaaagagaaagccctaacctgtctacttctgacatctctccttcctgccctcacctcagaaataaatggtatttttgtatttacaattgaattcttacagacaaactacccttcccgaatgaagtagaaagtttcacaagatagcatccctcatgctcaataaattcccactcctacagcctggaaagttggaaggcagagtcagcagcataaacctctgcatgtgtattcgcgcaagtttcgaaagcctggcccacagcccctgattccaccttgcttcctacaatggtctcaccattctccctctcacccagtgaggactgggtgataataatgcctctgtgccccctctagcacaggggacctagagctctggctcactggagataaacagtcagaaaaccacatcctctacatgtgtggggcatttgtttgagggtgggtggatgagaatgtggtcaggtaacccaagctttccttcctccttcagcctcacacttttgcaaacaaaagagaagaaatggagtctgtctgtagaatgtcacttgttatcttctcaaggtcatttttaaaaaggaagatcatgtgtatgatgttcgagtatgcttcatagttcagcagaccaggcacaccaggtacacagtgaaagaattggcaagacaagggccagaaaatgcgtggagatctttcattgcacagttttaagagctttgacatagttatcaggaagaaatcagaattgaggtgggctcccttaagcttactgcatggtttttccatgtgtcaaatttatatgtgaggagaaccttcatcctttcagggtttacggtctcttgctgtcataacccgcctgcatatttcagcacagccccagcctgatcaccaatttccatccctcatccactccatcagaagatctttatgtgctagaataaatttctcttaacctcccacaccagcctacaagtcattcattcattcattcagtgcacaaagttgctgagtatccactacaggttcagagttgacctggcaggggacacaaaactgaagaatgccctttttttctggaactggaactggaattttcattctcgggcaaagcaggatgccagaagccagatgatgttcatagcatcaaaagactcttttttttttttcctgagacagggtttcactctattgcccaggctagagtgcagtggcacaatctcatctcactgcaacttctgcctcccaggttcaagtgattctcctgtctcagcctcccaagtacctgggattacaggtgtgcaccaccacgcccagctaagttttgtattttaagtagagacggggtttcaccatgttggccaagctggtctcaaactcctgacctcaaatgatccaaccgccttggtctcccaaagtgctgggattacaggcgtgagccactgcaccctgccagaatgtgcatttctaataagtttcaggtgatgctgatgctgctggttcagagaccacattttgagaattactgcttttaaccttatttataaaagataaaaagtttattctttcaagatattctttttctttgaacatgggtataaaaacattttaaactgtttaggtatgtgccatttggacaaaatctctttaatatatctataaaaatatactttgaaggcttccaaaggggagaaaaccggctggagctctttatcttgaattattgttcaaaatcattttcagagtctagttcattgggctggacaatgccagcaaggtgtttggtttttaattaaagttgaaatatcatctccattgaaaggtacctcatgaatttaaccatgatgccatggctgctaaaaacaaaacaaaacaaaacaaaacaaaaatacataggcttaggctgggtgctgtggctcatgcctataatcccagcactttgggaggccgagatgggcagttcacttgagctcaggagttcaagaccagcctgggcaacatggtgaaatcccatttctataaaaaatacaaaaattagccaggtgcagtggtgggcacctgtaatccctgctattcaggaggctgaggcaagagaatcccttgagcctgggaggcggaggttgcagtgagctgagatagcaccactgcactccaacctgggcaatgagagtgaaaacctgccaaaaaaaaaaaaaatacctcgtaggcttagatttctgaaaacatgcttccacccagaaccataaaacttgtaaaggtgtggctgaggagactttgggttccaaagaaagcattcagaaagcaccacaaatgaaaaataggagttcatcaatatactgtttcctttatcattagaaagaaacagtgctaaaaaagaagaatgtccacatgacttccaaaaacaaaggaacccagggtcatgactctgtctgtttttcccagctatatctaagacttagaggggagagaacagctccctttgtccaggttccacccactgcaagaactttttggcaataatatgacttctcttgtgtgctctgtgccagccaaacttcgtaagaatgctggccagcttggcgcaccctctccagcattacctatgtttgttatttgaagttgccatgctagattttactttaaatgacatttcaagtacacagggtagttgaataggtttaagtcttgttgtttcttttcttttcttctattgaataatcaatccattcaggcacagaaagatcaactcttaggcttccctaattaccctgaatctgctacttcacccaagggacctcttgaaagaccccaaggatgctttaaacaaagcacttcttactctttattgtagtcatgagttttcttctgagtctcttgtctgtgatctcctccttgaggatggaaagggtatcaatcatggctgtggccccaccattcactcattcatttattcaatcaatgtatatttattaaatgactgctgtataccaagctttgtgctaagcctgaatatgcagcagaggaccaaagagccacagcccttgccctcatgaaccttacagtctgaagtagggacagacactcaacaaatgaccccactagtgagtaaaatttgcacatgaattaggaggactctccagagaaggggcaatgagctttgcaggctgtggagtctaggggtgttccatggaaggaggatgagaaggagtgaagaagatgaagactaacattgctctcacagaacccagtgcatctaaagctccttaatgcttcccccatggatgcttgttgagtgactggatggacctaggcagagttttgcactcaatgtgacagactggggaggagctctgtgtggagcaagcgatgaagtcccactgaattcaattgagggaggacccactgtcttcaaaaaggaagaggcatctccattctaaaggtggagcaactgaggcccagagagcttaaatgccctgtataagaggcagagcttagtctcaaatccaggtcggactccctgcctttgttcttttaatccatgactccaaagctccttcctgaattggtgggtataaatcctcctgtctctcagaaacttcttctccactttcccttgtgaaactctgtttcatctcatcagctttccagagttatttggtgaaagagcatccaaggcaggaagatttttcttggatcgctgtgatggctgcaccctccaaaaatgggttcacaaagggtaagcatcggccccactcattttcccaaaccatagcaaccctctctttctctccaagaaaattttaagttgcctgcatcactgtacatattattagcatattttccaatctcatatcagaaaagtcttctaatgagtcccaatctaatgtgacaatcatccaacaatagaatggctgctgcatgtggcactgagctttcagtccctggggacatttaagttgacacaggagatcacctgccaagaataccataaaaggaattccctgttatatcagaatgctgactgatttctgatggcattttaataagccaagaatagacgcttcttgacagtagaccctgccaagtgaatatgcctaaggagactctacttcccagtttgcttgatgtcctggaataattattaagagcacctcctttccactctcacaagtgccctgagtagatgccaaagaatatggtcatccaatttaagttgcacttgggtccttggagagaggcctaatacatcctgacacactggctgccaaacatccaggagaagatggggaagcacagttgagaatctgcagtgctcctgtagccactctaggagagtttctagttctctgtttagtaacctgatataccagcaggcgaacgacaatgtctaaaacctccatagttctgtgcctacacacaggcacacacacactaaaacacacacacacagacactcatgctgttcgcagagtataggagattctccgagagaagccagtagcatttccatgctgctagtggtctgctgatgagtaagtgttgtttttttaaggccttgtctggcattgaacatgattaataaattgctggagatgatggggactgctctactgtgattgagttactggaggcttacaaggatgaaaacagggatctctagatttcagatcaaaagcagtccataaaacacagcccctcaggtcatgggaagtggcatccgcaggcttctcaagatcgcttcccggtgaaaagagtaaaccagcctctgatcccatactgaactctaactcacatggggttcgaatgtgtcatatgctctctgtacctcaagtaataaagcagggagtagtgggagcccatcgcttatggctacttttctcaggaaaacttaagaccatgcaggatgggctggctcaattttgacagagagggtgtctctgcactgctaccttagtgcgcacagtgatttaatgaatacacgcctcagtagtgactgaacaaaagcagtctccaggagacgctgcaccaatgcaaagaaacacaatccaagcatcttgtggcagaagtcccagcagtccccagcctgggaccaaaggaggcctggccaagccttgatataagctgctttcccactgcacaagggcagagtccccaagtgaagaactgccccagttctggctcaaggagttggtggtcactccttgtcttcatttcaggggcttctagaagaccccctttccccgaaaagtattctctatctaagagcctgaaatttcaccattagagattacttcctttcaattttaccttaactctctttcttggacttcttaaaaagcacaaggaataaggagcaaatccatactgagttgttaatgatttcacagggtgatgttgaaatggcagcctactgaatatccacttgggctgtaggttacaagtgcatttccaaatattctgattccaaaggtctgatgaacagcttagaactctgcattttcaacaggcaccctgcacccccatctgctgtaattctgaagcactttgagaaagttcatttcaatgcaccatatcctctcagggaaagataacttcattcagagtttttaaaacctggattgtcaggttacaccccagagcaattacatcagcatctctgtggggaagaccaggtatcagtatttttctgatgtattagaaaaagaaagctccccaagtaattccagtgtgcagtcagggccgtggccacctgaacagccaatgggtgggatcttaatgctaacacagcagagcaaatggaacatgtgactatctccagggatctgggctgcctgggactcaggtctctgcactggcgaagtgggcagctacctggtcttcaatgtccccacttgagtgaccctggaggagtcttcagttgactcagttatggaggagccccatctcccctatacaaacccacacctctccttgaaaccacggtgatagggaggctgccccaagctgtacctctgaggagatacaggtaagtagaggctgggacagagccagacccagacaatgattggccatttgctgccacttggatttcagtagcctgagttgctttggcaggctgttccctggctctgtggggtccctcaagcaagcacagccctctcacctcctgcttttgggcacctctgggaccaggtgcaggatttggccctcaagcattgtgctgggtggatagctgcttcctgccagtggcaatgcaggcctcattccttgtcaaggaacaggcaagggcagaaggcagaagtcacatatggttgagagactctctaactccaactaaatccacaccatttttgagcaaaatgggggttgtgttcatgtatgagttcccaccaatctctatccatgtggcaattccatctgcaaaacccaagaaatagtggtgcatgttggtcccggggaactgggaactggagtgagctcagcaagagcccagaagtccgggagaactggtgcttaggatgatggctcaatgtccacccaaaacacagccgttatttcctctttgttcaagctctctttctttcctttctttcctttctttcttttcttttcttttctctctctctctctttcttttttttttttccagggtcttgctctgttgcccaggctagagtgcggtagtgcaatgtcagctcactgcaacctctgcctcctgggttccagcggttctcatgccacagccactcaagtagctgggactacaggtgcacaccaccacacctagctaattttttttttttttcagtagagttggggtttcactaagtgattggcctgcctcggcctcccaaagtgctgggattacaggcgttgaggcaccgtgcctggcccaagcgctctttttagaggcttgagggtaaacttcatcccagctccctctaatagaaatattcaaagattcaagccacatttgtaattttgaatgtcccagttagccacatttcaaaaaaaagaaacatataatattagtgtgtaaagtgtttcatatttaacccaatatatccagaatatttttacttcaacatgtcattaatattaaaaattcctaatgagatactagaaatacttcatgcacctgacacccccactgaaatataacagtgtttcatgtgttgcaacaattgttgcatcttgtgaaaattagtcctaccaaaacaacaaagtattgtttaacagacaaacattttatattccttcagtttttaggtttatatttttgttaattaaagttaaacacaaattaaaaactcagttcctcagttgcactggctacactgaagtgcccaatgggcacatgttgcaagtgggtaccatactgggcagactgagaatgtttccatcagggtggaaagtccttagatcccttaaataattagaaaaggtcccaactctcattctgctggtccaggctagagacacttagaagtgtcctgagtgacatgggtgctctctcgtctcacaaaaaagaagcacaagagttaagggctagaacagcataactagaacacctcccagagatgtggcctagagcaggtaactctcaaggctcagttcctgcctctgacagaggagccgaagatgagcatctaccacaaagaggtgtaaggattgagtaagttaatatgtttgtaaaacactcaaaacagtgcctggcacatagcaagctctctagaagtaagtgctaaataaatccccagttcaatggctgccagttggttgccagacactctgacatctttcatcccagaatggccttactggaagatgcaaaaaaaatctctcattgtgaacagctcccagccttctggctgccaaaattatacattgattcacctgagccttacctgatgcaaaacaccacaaccccacaccctgggggaaaaaaaaagctcagatactctgaaatgttctagaatgtctgtccctttcctatcctccaaaccatatcttcctgaccctccaaggtgaggacagaatgccatcccttctccaggttatttctccttattcaggtctgagtccaggccagctcctcctacaaggcctttcctgactatcctttctaaagcacgactgagttgtgagcaagcaagtacatgcagttaggtgcacacagcactggcctgtcccctcacactgtttcatttccttcattggcttatcattccctgaaatcacattgttgacttacttcttacttgtctattgcttgcctaacctcaaaagaaaataaattctgtaaggacacagacctggtctgttcagtccttgctgtatctctagcacccaggtgtgagtacctagaacacagtacatgctttatatacaattgttgaatgaatgaatgaataccctccttaaagtataggttcctatttccccttgcttgatattccaaagcactttccatctttcatattttgaaggcagtcaattccataatacttgatacatacagttaactatttttgtgtatatgtcttatctccccaactagacaataagcccctttgatggtatgtcttgaatgtacatccctcctgaggtcctcttgcatcctcaatgaatacttgttgatgaatgactgggaagaataaagcacaaatcttaaattaattttcttggtcacacatactagactatttctacaaataataatttttaaaatgaagtaaatatatatatatatacacatgcatctatatatgtgtattatgtttctcatcctaattaaatgaagctatttttgcaactgttttccagtccaagtgtaaaactgtaaagaataatgctaaatgttagatcattaagttggttttctttaattatatggcagtgtttcaaaaaggctttgagtcacctttaagattccttgccaggggtacagcacactacatttaaaatggcacttatcttagtaaacacatttctattgcaaatgatttgttccaataagcaatcccttggcaaagagctgctatttcttctagaccccctaccaaaacatggacctattataagcgccagagaagagaaagcttaaaaagcttcctttatcagaagttaccaagatacattccctaaagcagaagcatctattcatctacccttttctctgatttcaaaacctatagcacttactttttgtaaatatcttctataaggtagctgtaaataagtcctcaaaacctattgtgaagtaagctatagatgtaaatatacattcatcttttttctctctctcattttctttcctcctgcctctctcttattctccctttgtttctgtttttctaaaacaaaaatcagtaggttggtcacaggcaaatacaagttcaatttctaccagaaagctgagttcttgagtgattaagcatacaaaccaatcatttgaagggaaaaaaaatccagtaaaggctaaattattttctgaagtacttattacattacatgaagagcttattatgataagctattatacttgcaagatgaattgaattcacattcaggcaactcatctattcctagagaaacacagataaaaaattttatagcaacctgaaaaggtttgtggaatggatataaaagagatcaatactataagattttaatgtcaaattgaaacaatagaaaacatggtccaaaacaaggtctcaatttccaataaaaaggaaaagaagagataactggtgagcagaggagaggacagtccttcaggcaggagtggctggggaaggacctggtggaagtgtaattaagctgtaaaggaatcatggatagaatttggagggtggaaagcagtccacctgtaagttcatttattccacgtgtatttgttgatttcttactatatgctgggcaccattcccagcacaggggctatcacagagaacacatgacaaagaccccttattcagatgatattctagtggggaaggcaccacttctagaaattagttatgaaaaagcaggcacccttttatgtttacgtgtacatacatggaaaggaggcattcatgtttttgttttctactgcccttctcttgagcctggaaggttttcctttgtactgatggctagcattcctcttagctttgtggagatttgccttgcaaacaaagagttccctctcttccctcttgccactgtttaccatggggatgcagttaaggatcatgacaagccataaaagatttctcctaactctttcaagtatgactatcctgattatagcctccagatatggccagccagaatcacacactatttataggcttaacccacaggcagaattagtcatgtatcacacatgactaaaatgcaagactctcccagacctagggtcctaaacaaatcccctctccttccctaaaccttccaaagaagggcagtgaggatgcccccacaatgttcttcctacagacatgtttatttaagatctcctccccatcccctaatcaaggaaactacacaactgagctaatcatttaaatgatgctactgagaaacgaagccattttccttgttaaaaatgtgcttgccaccctatccatttatctatttccttggcagtgctcactgttaatttattgcccaataaagcacagacactagcagagctgctgaaccatgcctagtggaagccccactatttcatcccagcaaaggcaactgacaagcccaaagcacaaacacaaacacattggatgccacaaagccgggctggctaaccccgactccatttgtcatcccagagacacagaagggagggcggtttacagccttctggagaatgtaggtgattaataactatcgattgtcagaggaaatggagtaagtttggtcggttagccaactgccatgggttttctttctattggatggtaaacctcactgccgcagaagccatctcatggtgagttttgtggggagagaaactgagaagggaagtgatgaagaccgagatggggcagccttggctggccatggtgtccaccattcgggcagattgcctcctgttgcctcctgcagctaacacacagccatcactcataaagtcccaggcagatgtgtgcttttagtgcaaaaccttggcaatcattatcttgagtgtggaggggcttttcttttcagagtctccttcatgggcaactggatcaaccacacagaaggcagatccttcttatttggacagcttagacctcagagagcctataccaactgaatatttgtgaggtaggatctgaaagcacaaccctgagcttcaggatactctttctgatgtcttgactagctccagtttgcctggaggtttaaaggaaaatgtacccagaaaacctgggctcttactccagtatctgtctaatacaggaggaggaagccttctcaaagccaaaagaacagaacaccaagaggggttccaaagattgggttcaaaaaagtcattgaatgttactttgagaaggaagcaaggtcacctagtcgtaagcctgtattttagaggagaaaactgggacccagagaggaattgacttgtccaacgccctattgtgtgttatggacagaagcaaaattaggaggatgggtgaaaaagaaggaagttccaaaagcccacagggtctgccttccattgccatagtcccaattgttgctcccctagtgagggcacagctggcctaaccactcacaggcaaaagacataagactacaacagaccccacaaaacacatgcacatcatccactcctgcaggaagttgtgagcaggttgccctgctccaccatcactgctcagcaggaggtagagaggtagatgagaggagcacaggacctgagaaccaggagaaaaggatggcaagggaggcccagccccagccaaggcccagcccagttatgtaatccaccctgggaggttatgcccgctgctttccatccacggattttgcaggatgggtcttcactaggaagatgggggaaatgtcccagagggaatcctcaccagccctgtcccatgtcaagttctttatgcctctgaaccttcctcaaacggtgtccccccttccttgcccttgccccacctctccacattcacagggcatcttaattccctaagctgagtcaacatgagtaccacagtcctctccgcttaaccaggctgctgcatctcagagtgagcctcacagacacgcacagaatcagcacctgctgggcattttcatgtaatttgatgatcacctctgtaataagactcctcaggagctgagaccatccttcgtctaccttctagcattgtgtctccattgggccattgaggccatctgctctggaagttcctgcaggggcctgctaacaggtagatgcctaggcctaatccctgacttgcaaactcagaatcttgagccagttcaggaataactgcctagagtgcctcccacagcaaagggcatactgcagacatcaggaaacactcattgatcacagagaggggcttggcgtcaggggacctaattttaaccttgctgtgtggccctgcggaagtcacttaaccctctggtattcaacttcttcacctctaaaataaatgtcagacatttgtggatcatggatgtgaagttaccaacacagatccaggctcagcaggtactcaattcgagatgtctgtattatgcgtgaggtttgttcatacacagattgacccagtaactaccctgaaccagatccccagggagtgggtttctaaaggctggggactgggcctggcttgagaatatactaatcacacaatatatttataatagccaaacacactacataacctatcatattataaatgaataatactataaaatattaatagcaaacaaaatatggtacatattttgtgccaggcactattctaaatattttacttatatttccccatttaatccccacaaaaaatttagaagatagttctattattattatccccactttatagctgaggaaactgaggcccagggctgttaggtaattctcccaatgtcctgtagccagtaaatgacacacagcggggattcttcaaactcccacaccttcctgagatgtcagctggctgtgtggttcatgccttctcttcattgtctctgccctgagatgtgctcagcaagtggtcgttgccttaagagagctttgccttcccagcatggttgggggaagctctccctccttcaagggaggagaagaaggggtgaggagccactaacagggctcacctgcaaagttttcaggaccatacctccaggccaaactctaatgagaaggagcattcctgggcctcagctccctggggttcagacttggccccttaccataaagaggtcaactaatgcaaaatgcagaggctgcaccatgatagcttttccacgatgggtctgggccaggattgagggcactgtccagcaagctgatgcatttttaaaacttccgaatcattgatactacctccccagggaaaggaagacctcagcagtttctccaacacccagtccacatgccaacctgccagagaagctgggacggaccacagcaaaagcaccagcacccaagctctgccacagacaactgactttcagggacatgaatgacctcctcactgaaaatgaccttccccagggggcttattctctgaacttctggaatcaccaatcacttctccatgtaactgactctacatcaaagtcgatgcaacagatcacatttctcaccactcccactgccccaacctggatgcaaagtgtcatggtctttcaccagattattacaataacctcctaagtggtctccctgcttctacacttgaccccaagtaccacaattggagaaggatgatctccaaagctgcctgggaagtctgcagttacgcctttggacatggactgttgggacttttcagtttctaagagttcaaagaaaaaagaatgctagagatgttttctttccatccaaacaactaaaggcttgtatctttccattaatcaataccaagagctgttcatgcagctcaaatccaaaaatgagcatgctgagtttctcaagtctgtcctctgatgatatgtatataatcagcatgctctgttgtagacctttgtgacaatctgtgtcacttagtacaagtttacccaatgtcatttgcatttaagcaaatggaaaagaattttctcagaccctactatgactctggccacctgataggtgctatagaggacaaaacagaaatataaaatatgattctctcctttaaggaatgtattttttctgatggagagacaaaataaatgcccaacagatagacaaacaaccatatcagaccatttaaccatttccatatggttaaatggaaatatcagtaggaaagatattaaacaccttgggaattcagaagcagatgatcagtttggctagaatggctgggaagataatctatcaaaagtaagaaaagtgataaatgtgtgaagtgtaaatgagttgtagtattgcatcccaacaggcaacaaatatttcgtgcactggattgaactgctgctaatactactttcctctctcctgcatttggaaaaaaacaaggtggtctccgaaatccagcctcaacccaggactatggaaatttgtaatggcagtgaagacaaaaaatattttctctgccatatgcggtcaccaaaagcaaagcaaaaattaaagcaaagtatataggatttggtatggtaaaagtgaagaatcacatgacgattcgttaaagaatataacctccacccaaggggacagttgagggatagcaaagtcattaaagcgtcacagctaaaaggaaaaataagtctttcagctactattatccatccctctgctattcagtttcatgaagtgaagctactggagtagacactgtattacatcacaaatttgttacagacattcctgtaaaagtggctttttcctcatagactgaaaatacacctgaagatcccctcatgatgaataggaatagtccattttagatgagtagattttggaagtgtttccacacttttttttgtttttaggtttttggggggtgtgttgttgttggaagctccagcattttcctcttcaccacctgcagcactgggacagcaaagctgaagaatctcattaagcttcgacaagaccaattttttatttttagccagtcttttaagacaatgtgaactctactacatttagaataattattccatcaactatttacttaaacattttagaggaaaggaaagaaactgggagatgtttaaggctttttataacagattgtttcaagggtaaatagaaaaatccaaatgcagctgctgaaaacacgtaagcccatggcagggtgcccacttgctgcagcggaagtgaatggtgagaagagatgaaagatgtggaagacaaatgtacccagggcatccaatcccagcaagcggacaaagggcagattcataacactactttgtggttaactggtaactttcatcagggaacctcaacacactttacaaataacacttattttcctgtctcacagaagcagggagataaatgccaagcccaaacgtcacacagcaagggtgtgatgattttaagaataaaatccagaccttatttcccagttggtggcctaccaggtgtcttgatatggtttggctatatccccacccagatctcatcttgaattgcagctcccacaattcccacatgtcatgggaggaacccaatgggaggtaattaaatcatggggcaggtctttcccatgctgttctcatgataaggaataagtctcatgagatctgatggttttataaggaggggtttccctgcacaagttctttcttgcctgctgccatataagacttgccttttgctttctgtcatgattgtgaggcctccccagccacatggaactgtgagtctgttaaacctctttttctttataaatttcccagtctcagttatatctttatcagcagcaagaaaacagactaacacatgcctcccttcgaacccacagtacatccccaccatttgctctttccataaaccagtttcctttgaaaacttccagatccttcctcctctaatagagaacaccaacataccaaagactacttcagacatgaaagaaatggtgtgcttatcttgaaatctcaagtggaatggtaaaaacttacctaggttcatcaatgcgctagaaacaccacaaattaccaatgcaggggaaaatgaagtatgctgctacaagggatgcattgacagactccagagaacgccactcttggtaagctgattctgaccatatagaagttattttataattctgtaaattgtacataagtgacagcaatgcaaataattcctgtccatggacatgaaaattctgtcctgtccaagagaagttccattgacttctctcctgcctttgtggaaaaaaacagttttgcctctgtttccacattcatttaaatattactgacctgtaagtgtctgttcttttcttttttgtttatgtttgtgtctttgtttcttcaagacagggtcttgctttgttgccctttgttgcccagactggagtgcagtggcacaatcatggctcactgcagcctctacctcctaggctcaagggctcctcccacctcagcctcctgagtagctgggactacagacaggcatcaccatgcctggcttttttttttttttttcaggtataggcagagtcttactatgttgcccaggctggtctcgaattcctgggctcaagtgatcctttcaccttggcatcccaaagtgctgggattacaggtgtgagccaccatgtcctgcctgtcctcaactggttataacatctgcctggtcccctcattgaataggagtagaataaaatctttaacacatattcattttgatatctgaaagtcatgattttcttcttttgtgaaaattaatttttaataccaattcaatctcagaaatgctcaacctcaaagttagaaacacagatgggaacagcaagagatgttagaactcacaagaggactgatggagaaaataggggtgtagatctccgaacacaaattggaaaagattttcttatgagaacaaatccataaatcagaaaatatctgtgattttatcctctatcttcctaccacttcaatcttgttaactcaaatataagacatgttaactggatccaggacctgagccctggcaagtgccacagacaacagcatgctatccaaaggactgcccttaggaagcccttaggaagccttgaatgcattagaaaaaaagtactctcccctctggctgacacagcaccattctggagcctctggcttagcaaaaggggtacaggttgcatttgagtgctttcttgtaccttcttcagctgggcacctttgtgcagtactcaacctatacaactgtacatggtggccatgaatggaaggaccactcatgacccaggacccaaaaccataacagggatatatagctagagaacagctgctgctaagcagggcatgagagaaactgagagggctgtgtccgggctgactttatctagaccactgagatccaatacgattgaggaaaatcactaactctatggcaccctgctccagccatgcctgggaaccggtgactgccttatgatgggatgcccttttcagggagtcaagaagtgcctgactggtaataaaaaggaatgaactactgatacctgctacaacatggaggaaccttacaatcattatgctgcatacaaaaaagccagacataaaggattacatactgtatgagttaatttgtattaaatgctcagaatagaaaaatctatagaaacctaaaaataggttcacacaaagtagattagtggtttcctacagctgcggtggttggggagcggactgaagggatttccccagacactccaatccatgtgtctgggtgttacgataaccatgataataaaagccagggagacctcagtttgggttaacagggaggttaacctcattttcatgctttgtttttcaacccttattactgactggttctgccacgatccttaaaacatgctcttagcaaattttatttttagtaactatcacttagtctttctccccagctttttcccactttcctcccatcccttagatcccatctctcacatctgtatgttttacccaacaggatggaaagagaacaatgtgtgggggcagatttggtacctgtcatggccttgacctctggcatcaggcttcctctccctaaacaccccagccaggctgcactttcctccatgactcaggtgaaccttcctctgtgccaccacgtggactttgcaaattctgtttctcctatctgcaacattctctcccattctcctcccaccagtcttctttcatcatggatgaaggatgactcttattcttcctcctaatctcaagccaagcattcttctcggaagcctttgttgatctttaatcccttggctctcatagcagaatgtgtgcagggcaggtatattagaatttctgtaggttaaactcataaactgtgggactttgttgactaggtgacatcaagggaaacagaggcaggcttcttctgtggaataattgtgcatccttcctgcccttctaggggtcctgactatctccccagcccccagcctcccaggctccaatctgcaacaacaaagagatagaagctctgataagaaacacaggtggctgggcgggtggtgtgctctgtagtcccagctactcacaaggatccccttgagcccaggagttcaaattcagccggggcaacatagcaagaccccatctctaaaacaaacaatcaaaacagaatttctttgctaattacttttgacataaaaaaacaaaagaaagaaacacaagtgattgtagcaccaggacccctgaagctagctgaatatgttcctgcctctggcagagtaaatgttctctacttttgagtcagaccagtgaaggccaaccttcgtcttaggaagaagttgtggtgccaacataagctttggagccaaacagacttagttcaactaccagcctttacctagtttttggtgctcccattgactagtctgcggcaacagatgagttaaaggagatgttgggtgtgtatcctaacacactgcacaggctgtgttgcagaatagtcagtaaatgtccattttctttcttcacatacaccttcttctttctgcaccaataatttaagtaagaactttctattttctcctctaccaatctcagaactgtctagatagaagttaaaaccacctcactctggctcgaggaggagggagaaggaggcagggtttcatttcaagatcagtcagcccattgcagctggctgtcctgcagcttcaggagaaacaccagtggtcccacagctaaccaagatggtgcctgtcaggcacaacagcttgatagggacagccgcattccctgtcagattcttgataaagtacagcacatgccaggaattctgtgggcccttcaggcacttgtgctgttgacacccctatggctcaaaatcagaagctgtctctgaatttgatgaggtggtagagttggatcctttggcattgagggaagaatggcagaacgtgggtgtttacaaacacttctgtccacttatgtatactgcagatacttaatggagtgctcatcctgtgctgggatagaactgagacaaaaaacagatagtagctgctttcagggaacttaacaatgtcagttaatgggggagacaggtatccattcataatcatccccaatgaatgtgaacccaaaatgaaataagggcatggaagaacataacacaattctagaagagctgctcacaaaagatcaaggtgaaaagaagtttctcaagaaagtcgcactggagctggcatctgaagaatgagtaggtgctatttgggtgaaaggcgtgtgctgtgggaaagggatgggaagaagaggagaaagagagaacagcatgtgcaaacagagggaacagcacatgcaaagcccagtggcaagaaagactatggcgtggtgaaaaattgggctaaagacaatatgaccagggctggacactgagggtgagagtgaaatgcagcattggggaagagaaagtcaattcctaattgttcaggaaaggtgactgggtgataggcatgaccagaagaagagaggtttcctatgaaactctgtactggaaatagagctgccacaataggcaacaagaactaaggtacctagaacaaaatgctctgtcattttgttccctgggagagtagagtaaaattcaattgaacagaggttgagacagcctattgataatttaaagaaaaaaaatttaatgggctaggtcatcatacaggcatattaaaatgtaaaacagcagaaccaaatcaaatttctctttgacaggcttgccctggttttataatccctctttcaggggagactctgttgttgttattattattattattattgctcaagatggtgtctctctatgttgcccaggctggagtgcagtggcacgatctcgactcactgcaacctccacctcccaggttcaagcgattctcttgcctcaacctcccaagtagccgggattacaggcacatggcatcacacccagctaatttttgtatttttagtagagatggggtttcaccacattggccaggctggtcgtgaactcctgacctcaggtgatcctcccaccttggcctcccaaagtgctaggattacaggtgtgaaccaccgcgcccaacgagactctgttaagctgaaaatattgagctaaatgccagtgtcattcttctgtaaatatatgtaattgccatttaaagaactctcaaattaaggttataacagctagtgataaacattccttcatttctcacaatattataatagagaagaggaccagcattaacaaactggcttttcctgttctcccgaaacagtcttaagtgatctcatttatcatgaatttctgtaagcattaacagtttgtaaaatgagttaattatgttctttggaggtttaataaaatctaccaagttaagtaatatcccgatgctcttgaaatttacccagaaaactttaaagaaagaaataaatgcattcgactgagcagaacatcatgtatatttttagaaagcatacattatctcacaatacttatgctaaatatgtaagaaaatttctgatagactctaaatcaagtctagttgtaaaaggatctctcctctaaagttttttttttaatcttcgtatcaatgtataaatattggcatctatgcaagccaaatatattccaaatccaaaagctttggcaatccaaactttgagagaaagaataataaaatctaacctttaatgagaaaaagtaggaatttcaagaacatgcatctattttctacaggcagtggtatgagagaaatagaacagacactgaaacaggtgaaaattaagatgttacatagggatggcatatgggactcattaagtttaggatggtgttttgcccttctttaaaatgtgtttttcttttcccccaccataaactcaatttgccccaggtagtaaactgaaatgactggaattttctctgattagatttctctggggctgttactgggtgttaccacatggcataggggtgaggtgccaggctctggagtcaaattgcctgtgctcaaatgctgcctctgccccttactggccatgtatttttggaaaagccagttactatctctaagttccagcttcctcatctttaaaggaagaggtttgttattatgcatacctcatgggttgttcagatgattagatgagatgtgtgaaaagtacttacttagcacagtgcctctgtaaaggacagcgatcagtattcccctggtggaaacagtggccatgtttacaagatgaaggaggaaccagtccttactgcctccctgtgtaatcaaagtagtcattatctcctattgccagggtttccttatctctatcactcatgtcctgtcctgacaacatatttataatgggactctacctacacaattaattgtgtaattttttttctttaaatctcattctttaaagttcaatttttaaattgaactttatttcactaccacaaatggaaagcccatctcacttgctataactagaaggtaattctaaacatacagcaaaaaagaaaacccagatcatttaaacgccacctcgatcttgtcaccccaacaaagactcagagcctgagagcggaggctgattgccaaagtttagagaggtgttaaagacctggtagaacctagggaagacattctctctgtgttaaagagaatgtaaaagaaaacataaccctctcctcattggagtctgtgtcatcctatgctgggtcaggccaccacctaaaattacgccatatgcccctggtaatacccatctctcacgttgttatctagagtgatttccattgtagtttatggagttttatgcataaacagacagtgttctgtgatacctaagaatacttccaaaattcccatggaaggaggctcccaattaattccagtccattcatttttaaaattgctgagtgaggcattagaattcatagaatttgcagacctgtgaattcccctagccagcagcaatcttattagcatatccgtaagtctttgcaaatttgactagggacggtgtgtgtgtgtgtgcggggggggggggggggttccattcttactttatgcatcctcatttatacaccctcctctctcttgaggttgagtttctaagctgatagatcataccttccatctctgtccataaatgcctttgacccaaatatcatgcaagtccaatggtacacatgtcctctaaaacaccctaagtggaaagcattgcctgttgaggattagagtagacatataatcacgtttcatactgagctatggccttcatccaatacaaatgccacattcacttaggaagggtgtgtatacatgggaaacagcaggggaatcaaggacaacttcctgaatcagcctgctcagcaaatccaaactcattcagccacaaacccagttcattcatgcatcagggtttgcactgctctaataagatgaatggaaatgcaaagacaacacttggagggagtcctctccgtgcactgagacccttgtctgaaaatacaagcaactgctgctgcttcacactcaaagagccaaacattttgcatggataattcagaagcagtacgtcactgccccatacacaatcctcatgttaagggagcctgcatcaggaaagcacagactatctacctacacaaagaggtcattgcaaattcctcctctccttcctgttgcattcactttagcaattttattacagaagagactgtctagtccagaagcttgctcagtgatgaaagaagccaatttgggatcctaaatttgactatagagcattcatatggacaactgggaattacctggtttgtgaactaagcaaaagccaaaactctaaacaccttctgagcatctatgaaaaagtatttccaaatcacaagcattcattttttagatgggagttggcatgaggatctcctgcaaagagagagagagaggtttcctggcatgggatggggagtgctgagcaccaagacacatgtgcaagctgaaagcacaccaagtgctcttctctgcatccagcacctcacacacattaactcaaagggctgacaagtccctggatcactcagcaggcaggcagcaaactctcagagcaaacagagttactgctgccttatcttgagctccactattaacacacttgtcatcactaagccaggttgttagtctctggaacaatttgatggaaagggcaaacaccagagaaaaacaagttgacccagatgggctggcagaggggatcaagtggcaataaactccgttatcactcctggttggcaaacaaaaagctctgcctacgcatgcattccagttaactatggacttcccctcatacatgcatggaaggccattatgcagagaaatgggcacagcaaatcacactaaacactgaaactctgctgaagtgactccagtgacttggagttgttgatctaaaaattgcttattcttgccttgacaataaaatcagagtccaagttaataaagatttctagttagcaaagtccccaagagcaaacagtttattcagatcaccagctttctgctttgcagtgtgaagagattaagggtccagggacactcctagttctggttctgcctgtgtacatcactgagcctttgtagacctcagctttattccctgtgagacttagactgatcagcagttctcaatctgaatgtgatgacagagtagcagaggtggccgaatatagaatcctcaaaattaacttacaaccaaaggctggtatctgtcagtagctttacatgtattgactaatttaatcttcacaataaacctgtgaaggaggtactattatcatccctattttaccagtggggtaaccaaggctcagaaaggctgacaacatgcaagggtcacccagccagccaggtgcagaggtgagactaggaatcatgtggtctgtctccagaaatgctgcttttaactactcaactcttcataatctagtgcctctcaataatggttaataatagctatcagtatggccaattgatggcctgattagaggagatctgaggcttgaaataaaaggctactgatactcgcattttaacaagctttttttgagagacaaagaagtggagtttcataacataacctggagtttgcatctcaaaagtgaacaccatccacaaggccaggcaagaagaaaggttggcactggctgaccacacaatgtggttggttccacctcacttagccatggagtctatgattccttggtgctatgagaaagaatgctgcaatctgctcactctcattttgggaggaccaaagccctgcctagcagcaatgacaatcctggccctaacacagctgggagcctcttgacaggcttatctcctccagctccccaggaagtctcccattggctgtcagatcaagatcaccaaacccattctcctaattagctccttggcaggcaaaccacacaggagcagttccctttccaccttgaacccagcagacagtcccactccccagcatcagccagccccaaaggcacagggctcccctaaggcctgcatgccctaagtgtctgagaggaccccatgactacagcacatgtcactaagtccctaacattccaatcatcagcaggcatctgtaactccagccggcgtccctccaggtatgcaaatgccatctgcccttacatgagggaaatggacagcagcggaagttaccaagggcccacaaggtgtcagcatctgggacagaaatgaagttccctccctatcaccaacttctcttttaaagaaccactcaaaccctgccaagcttgtacaagaggagtaaataacaaaatgacacagatgacccataaaggatgtatatttgcttaaatgaaataatagagtacttcacaagtgcctggtccatgtaagacttttgttttgttttgttttaatggctatttcaatataacactaatttaatagatatagtttaaatataagggactgtaaatagagtcttcaaaatagtacatcaaaaatttccttcatgatgaaatagatggcctactatgcttatccagagttattcttgcaaatttctacctgtagatattgttcggcaaataggcaagttcaattgattgttgattttaaataaaagttctaactgagaaaaaaaaagtaagcccataagagaaaccagtttcaaaaggccacatcctgtggattctccttatttgacattcttgaaaagataaagctatggtgatgaaaaacagatccctggctgccaggggttagagatggaaggaggcggttcgatgcggtaaaggcacagttccactgattatagtggtggttacacgcctccatacatttgtgaaaattcatagacctacacaccaaatttttttaaaaagtcaattttattttatgattacctaaaaaataaaaatgtttacaaggcccatgaattgggttgtctctaaaagatgacttttcttcatatttcttccaaattggttcatatttagagcactattgattatctaacaaaattttaaatggaaatagttgcagtggagattaaatgaaataacatattaaactgcttttgaaataaaaagggcatggaggatgtcatagaagtagcggtgcttgcagtaagaagtcagatcagactttacaaccttgttaaatgagggactgaaggcctggggtccccaccactccttcccgtgagccagtgcccttcgtactccactttccttatgtgtgaaaaggggcacctgaggaagggttgtatcttcaagcactttaatcccattacccaattattcacgtgcacagacccataattgggagttagatgttttccttcagtgctcaaaatagagcaagtttgtccctcaaaaccaaaagtactcaggtcatgaatgaaggctgaagaaattctgatctggcgggaaattccactttctgacaaccctgatggtacctctgaaaaaaacaaacacaatgactgcttttgaagggcaggagacagaaagacttaaccagtacttttcaaagggaggaaaattctgtgtcatcgtaagcttgaataaacccagtgctgtgaattgccaaaggagaggttaactgttttgaaagctgtggcatttttctcatcagtgtctcatgaggctggccaggaggggcagttggaaagaaggctcggagatttgatattcaggaagtccaccagacatgcagcattcttgacaagatgcctttcacctaatgtcatattagcaattcagacagaaacccaggaaagttagcacacacatatgccccacgctacacatgagccctcctcccaaaccacagcttcccgtgcctctcttccccatgaatttagtaccagcctccaagggtttctgccttcctttctgcaagtcaattgaagtaacttccagaaatgccttaattacaggccagtatcactgtcattagaggtttaaataaaaagtccccggattctaacctgctgagatttcttgtatgaaatgtacttacggaactttgataaagtaccagtcaactctaacacttaaatgggaaaaactgttgcagctcaaaattcaactctcatgcaaaactccagggatgaggcagcaaaggtaccacctcagcaagaagaaaaaggaagagagaaaaaagaaaaacaggtactccataaattacccacataaatcagtttaggcagactacaattttttttaacacagaaaacgcttaaaggaaaattcacagaaaatccatgattactcctttagcagggcgaaatgtcccaataagaaggagatgtattaatgggtggccaaccacctcttttgctccagtcgccttccgtggagaataatcaacagaaggaaatctaaaaatcaacatagagaggctgcggtgagctgcttcatgggtcctgggatagggggcatctgaactatttcccagcgtctgggggaaaaggagtgaacattttcaagtgcctcatatgtgctggtgctttacttgggctgtttatttcattttttcatgttctttcaaggtgttcttaattctgccttacagaccagtggaggctccagtatgttagataaattccccaggggcaccagttaaggatcactaggaatgcggaattcccctccagctcagctctgccctgaacatcttgatgccaggagtaaattcagggctctgagaagggtcccaaatgttacaaactttaaaattgaactaagggatgaaagtttaaaattgtcttcaaaggaattcctcaagtaacataaccctgcacatataaaagtgtcagcaggctcagattaaagggctcatgaaagagggttatttccagagataagaatccttcatcctcctctgggcagggcagcagagatagaaggcacagccggctgagaccccgccgggcctcaggaagtctccactgttaaacccagcctgcaaagcccttccctcttagggatccactccattagagttgacctgaaagctgactcctttggagtggtgcgttccattaattcatccatccaacaattgcttgctgaggacctagtatgtgtcaagacagctggagatagagcaaggcaccagtcatttcagtgttttcagatgaattccccacctattgcctgctctattcttaatcacaggggcggcccccactatgttttctggcactgttgccaactggatcatactggatttggccagtggaagcactgggcaaagcccagagggcggaaggaagggagaagttggaacctgtccctctcctgtctgttcttcagccatgattaggtctcctccatgataccacctcctctttttgtccttccaggccccagctcctttctcttgtcaacctccgggttgccctacagtgacctacttagccattccactcttctgatgctagggtaatagttccctacattaaatatactctcttgagccactttgttttcctggctgggttctgacctctacaagcattgaatctgactaaccagatccctgccctcttagaacttacattccagtgggcaggaatacaataagcaagtaagcattcaaatacatgaataagaacagttcctgatcatgttaggattatgaaggaaattagcatcgaggtggcaggatttggggatggagagctatatcagctggtaaggggatatctctgctgagatctgaagaacgcaatggatctacctttgaaaggccaggagaagagcatggcaggcagagggaacagtaggtcaaaggtctcccaggaagaactagcttggtgtgcttcaagagcctccagaagccaatgtggccaatgcatctgagcaatgggggatgtgtcaggggccaatgccatgggaaggagtttggaacttacaattgatttcatttacatttaaaaagatcactttggccaatgtatagggaattttcctcattgtttataaagagagacccttaatgcctcaccctgtccaggcatatccccatcttgaaggtctaagagagagctacccctcctaatgagtttgcacaacaagaatgggggggacaaccatagctcctaaagcatggttctgagggagaaacggtggttcccttgatatcagctctaccatgttctgaggccatggtacagaagaggtaaccattcatgtgcatgacagccctgactctaaggggcattgtgggttcctttcttaaccattctggaaggttcctggtgaaaggactgatgcacatccacatagccttgcattccaaggtgatccactggaccgtctagacttttatctctggaccctgggagttgcagacactgtatcagaacctccaaccttccccttggcctgccagaaagctgaaagtttccatgcctctgctttccagctctttctctgctacatcagagagcccctttctcatgtcctcaaagtgacaaatgtatgctgccaagcaaggctgagggaaagaaggaaatagaaatgcagtccccatcatgcattctttcccaaaatgcgactaatctggcatttaggttgtttgctcctttaatcagaatgccattaagaaatctctgccgggtttctgtacacagtttttctctaatgaagcatcaaatctctttcacaaacaatagctgtgtcacatccaagcaccctggccccagccggtgtggctgcagtctctgctaaatgtgctgcctctttcaggtctgttcctcccagaatagcccgccactgcggtactcaaatcaaagtctcgacactgtctagctccagcaacgtggacagacaaaagaaatcagaggttttcaagaagacatagtgctgtgtccctagaatttgacagaatagcttggaatatgatgtttaatgaatagcctttctagtgaacatgtttgtcctggcttcaactctgggcccaggtttgcagtggctcacccaatgggtgtacttatcatccttgacttaacccccaactagtgagctatttcctggagggtggaccttgtcagaggcagaactataatgagatgtccccagagctattagtgaataacatggcagagccctgctgagcatggtgtttgaccaggcccaggtgccatggtctctaagcatatgttcatatatacatcttggaaggcaatgcagcaacaactatcattatttaaggtgcacataacctgggacccaaaaatgccattcataggagtttaccccatagatacactggcacatgtgtgcaaagaccaatgtaagaatgcatttgctgttacattgtttattacagcacaagattagaaacaatgttacaatcagggccaggcacagtgactcacgcctgtaatcccagcactttggaaggctgaggtgggcgggtcatctgaggtcaggagttcgaggccaggcttgccaacatggtgaaaccttgtctctactaaaaatacaaaaactagccaggcctggtgccacacgcctgtaatcccctctacttgggaggctgaagcaggagaatctcttgaacccaggaggtggaggttgcagtcagccgagattgtgccactgcactccagcctggacaacagagcaagactctgtctcaaaaaaaagaaaagaaacaatctattgataaggggctcccaattacatatatttggatacaccaatgcaaagtaaaaatatgttgtagctgtttttaaaggcaggtatataggtctgatgtgaatagatcattaagaaatagtgtgaggccgggtgtggtggctcaggactgtaatcccagcactttgggaagccaaggtgggcagatcacctgaggacaggagttcaagaccagcctggccaacatggtgaaaccctgtctctactaaaaatacaaaaattagccagcaaggtggtgcatgcctataatcccagctactccagaggctgaagcaggagaatcacttgaatcccggaggcagaggttgcagtgagccgagatcatgccactgcactctagcctggacaacaagagtgaaactcggtctcaaaaaaaaaaaagagagtagtgtgaaagtgcaccatcattttttaaatgggaaaattatacatagacacgcatatatgtgtgcacatacgcttgtatgtgcatagattctcactgaaagtgtacactagagattgttaataaacagttttcaggccgggcgcggtggctcacgcctgtaatcccagcactttgggaggccgaggcgggtggatcatgaggtcaggagatcgagaccattctggctaacaaggtgaaaccccgtctctactaaaaatacaaaaaattagccgggcgcggtggcgggcgcctgtagtcccagctactcgggaggctgaggcaggagaatggcgtgaacccgggaggcggagcttgcagtgagccgagattgcgccactgcagtccacagtccggcctgggcgacagagcgagactccgtctcaaaaaaaaaaaaaaaaaaaaaaaaaaaaaacagttttcagctctgggaaggaaaaatggggcattagaaactggggatgaagagatattttaaagtatatgatttcaaacaaattaacttttttttatttttacaagtacatacttaatctctttaaaagtaattttgtaaaagggcaaaatgcagtgctccctgaggctctggtaaataaaccgagaaatcactgactggaagttgtggtagataaaataatgaccctcaaagatgccagtatcttaatcccaagaacccatgaatatgtgaccttacatggcaaaaggggtttgctggtgtgattaagttaaggatcttgaaatggggagattgtccttgattatccaggtgggcccactgtaatcactaggtctttataaaagggaggtagagggtcagaatcagagaagaagatgtgccaacagaagcaaaagtaagaagtgatgtgaggaaggggccatggaccaaaaagtgtaggcagtctctagaggctagaaaaggaaaggaagcagagtcttcccagagccagcctccagtcctgctgacactttgactttagcccagtgagatgatttgggattctgaccccccaaatctgtaagacaataaatttatattgttgcagccactaagtttgtggtaatttgttacagcagcaacagggaactaatatggaggtaaaccttttaaaaccaactaattcatgtgtcagaagggggaccatcagccatgcttacccaagtggaggctcatcacccttgattgatcattctgctggggacaggacagattttccataacactatcagttccaatgaaagctgatgtatgaaaaacatctcccttagttggtctgatggtagcagtctcctggatagaactgccatcccagacccacactggggtgagcttggcagccatctggcctcatcactatgctcttcacagaatgctatctccactctagcatgtgtctgtctcatttatcaagctgatgacatggcggtatgaaaaaaacagatgagaggtcctacctgccgatctgctccaaagagattataaaatctaagaggaatgcctgggtgtgtgggcgggggggcggtgggggaatgtagagaagaacaaagttccttctggagctttgggaaagccgtttgtgagcctggacttcccccagcctttgaatcattaatctggttgtacccaagacatccaacagggtgcagacttgcctcattgctccagaagctgagaccacccccgtaacttgtgaggacggaggtcctaccccctgtgaagaaggctgagacacagagaaaactgagagattaaatttataatcataaccttcctctggcttccagagaactacaaaacaaggacacattcccactgtctcttgtcccaagagtagagccaaaccaaatagcctcaccatacccaacattatgcaacttgaagcccaatcaattggctccacccacatttcatctacaggacattgttgccaaacttcttaggtatcttcaatatgagatttttaaagagctaaagatataacagaaaaagcctcaatggaaattttacggctattttcttttgcggctcagggaacataagcttttatcattttccttcattcaagtaacagctttgccctagctccatggttgtcatgcatggtccatggtgctgctttgatgatttataaccagctgagtcatcatctcactaagtcaaaagagattagtatgtgaacctatttggtaaactgtaaggcactacacacgtctggtggcaaggcttgtaaagctctaaatacacgcataattaatgtgactactccccaagacagatggtataaaggagacgacctctacctatgaaaggaaggggagaagaaaagatcaaaaccacctccttctccagccaagctatgtttgctctcccattcctctccttactcccaagatctaaacatgacaggagtggagaagggaagatgtctttaatttcctggttaatttctcctgcctggattccaagatggagacccaaagggagacctgtgtgataactggccctcaaaggagtgcacacagtagacccaggagcaacagcaaaagttgctgactaaacctggggacagcaattggtatccatccctcaggcatttactttgccttttcctcaccagtcaacttcaaggcccttgaagttgtcaagaaactggcaacctagacatttatatccaaaccagatccaagaattgtatcgtaagaatggaacaataattgaaccttgtgtcccctgctaaaccagagagagcttgtcaacaaaaaggactgagagaagaatcctggggaacgggctaatgagaaaggctacctgaaccttcagaaatacctggggagcttattttatttatttatttattttgagacagaggttcactctcaacgcccaggctggagtgcagtggtgtgatctcggctcactgcaacctccacctcctgggctcaagcgattctcctgcctcagcgtcccgagtagctgggctacaggcattcaccaccacgctcagctaatctttgtacttttagcagagacagggtttcgtcatgttggccaggctcgtctcgaactcctgacctcaggtgatccacccaacttggcctcccaaagtgctgggattacaggtgtgagccaccgtgcccaaacttgcagcttattttaaatggatgtctgggctgcactgcagatctatggtgataaggcaggagggggcaccctaactgaaaaaaaaatctccagatgattccaatacccagctgagtttaggtcctaccacattaggtgacctcccaaaggtcccctcatttgatttccctcccacttccacactgaacaccagcaagtccagagagaaatggccctcggcatccagcagagttctttccagtgcccgccagagtgatggccaccaaaccttcctccagactggctcccattgtgtgcagggcaggcaggacagtctgtaagagatcatcactgtggacaatcggggaaggagctggcctgggcagagactgccctgaacattcatgggacctgcgccccagagcatcagatgggcctctctgctgaaggaataataaatatgtcttttgaacaactgattttgttgttgttgtgtttccacacatatatgttcaccagtgctggtttcatagtagttcagtcgtactgcacaggtgagctagggggctttcttaaaagccagaagactatttaaatttagatttgcatgctgaaatggagcaacttttggcatgtgataaagatggggaaagttgaagaccacaccctgcaacgccctccctgacttactactaccacccatcatctcccattaaaagaaacaaaacaaaacatcattctaatgccagttaaacgttgcatgtattgattaagccttccctcccatctgaaattctccctaaggagtaacattttaaagcttgcagtgagggtcctaaggaggctgctgctttgacagcctgcatgagcagcagaagggaccttgctccctaggccagcatctggatttcccatctggcccacgcctgcagctgcgtaaccctctggcccccctccaacgtgcctcaaaatgttatttcacattttgggtccaaatggacactttctgagaagtcggtgtaacctatcaagctttggaaacaagtttaagttgtttttgtactttccattacccaggttgttctggaacgcagctctaagaggttcagcttgccaccacgtcaaggaatttgagaaaagggaaaaacaaagagggggaaagcctgcacaagaagaccgagggtctggaaatcagaacctggtgttttccaaaggtcctgttcagcctacactccccttttccatttctgccatgctgttggggcaaactggcatgggaagtaggggcttttgtcctaaaggcatagcatcaaggtccccagagctacaaggctctccaattccttctccctggtcccgtatcatcagacaaacccaatagagtgattctctaacatgctgtgctcagaaaggtgaaagaaccaccaggcgtggtagggaggctgtgtccactgttcagcccagtcagtgtggcttctctccctgggctgggctccatcagctcatgctgagcctctgtggcattagaaaaaataatcccttggcctcagggcctgctaagggacttcaagccagatttcattcccattcacttcctaagccaggtaccctgtgcagggcatgagagccagtggacaggacgcccctgcacttgggagattcggtaccctgattaagggaaagccacctccctggctctggggaaggtaagagacctgagaaagcaacagccttggatctcactacattttgtgggctacttctgaaaaccacactttgaattccagtcccatcactgaccagctctggactacctgtgactttgaataagctattcaatctgtgcctcaactccctcccccatacaatggggaggatgttagcatctatctcacaggtagagttgttgtgaggactaggcagagtaatccatataaggcactctatcattatgttgttagatcagtttcaagaagcacattttccaacataaaatgatttgtgaaactgagatcttataatcagtccatatgttaatacatacttaatagagttttctcccaccgcatcctccaaaacagcaggtattaaatcaatggtgcatctttctcatcaacgtatttgagttaagaaaatatggtcttttaattaccatttcatgcatagtaatggctgcaatgttaaagactcacttcttcctgggtaattttgcagcatagtctctaccagcacccctggggatgtaggtgcctaccaagccaccatctcctttcttctccagcccctctggactccttcaggtgctctcaaacctaaactcataaaatccttgccagatccttagggagcatccaacaagtggttctgagcccgagctgctcacagaaatcctagggcactcgctggccccacaggttctgattccattaatggaagtgaggcccgggcatcagcatttttaaaagctccccagatggttgtaacatgcagtggaatcaagaactctggctccagtctgtccccacctccatctgatgcctgaaatcccctcaatccctgcagctaatgagtagctggccagcctcttccaggagaatcaaaacttcactgacttaggttgcagaacaccataataaagcagaggttcttcctcaggcagtgtctttgttgttctgagataaagaaaaagaccttgaaggcaattctaagctgggaaatgagaaaacctgcctcaaatggagtccttcttcccagccatcttaagctcagatacctggaatttatttattttgaactttgtagaaatcttttgacttacaaatgacctaattctctaaactagctatgctgagaatgcaagataacttttatgctggcttgattccataagaaatagtgactcataaggatcatcatcagaaataaatttctcaaaacttttaagtaaatctgtttctaggtaaacttgatggacttttgaaggattatatttcccccttctttttcctcttgcatccataccaagctcttttctttatggcagaccttgtttcctctccatcttctactttcatagatacagtccatcaaatcatacacatgactcatttcaccaaccacgaagattctaccatgcactggagaattagtgagttggcttcaactgcacttcaattgacgccccggaggtgggtaagcatacatttccacatgtatgcagatagaaaaatatctgattgggcactaaatgtttaattctctgagaaattggcaatccagtgagaaagctacgctaggcatcctagatgcttttagatcacagtaatggaagcatctcacaacagcctaatgttttcaacccatcagaaagcagagtcccagagagcctatggggactcaaaacaaacccaactaaagccaggtggagtgacctctcatctcagactccaaggcttgggagtaggaatgggcaaagtggagacaagctgccaaatattaggggtgcgccatgtcctacatgttggatgggccctttacacatgccatctcctttaacttccttctcacagtaagtggggagacagagattagaatcaggctcgcataaggtcacaaagatagtaaacagcagacctaggacttagccctggtccctctgatttccaagcttccttccaccaaatggtggagtaacttgctcccaatccatggatccagacctgggaaaggggctgcttctctgagctccaggagctattggttgagaatcctctcttttttgcatccctgggttgctgcccacccccatactgctccttaagcacttaattaatggtgtcctgtggccagtcctgatgatgcagtttttcttggtcactctgtgggccacagacttgcagctgccaattccccctacaagcattgctcgggtccaggcccactgtaggagacaccctgactactccggtgcagatctcacagctaccatgactgtttgttcagcccccacattctccagggtcccaatttcttgtcccacattcaaaaagaatgaggttatgctgccagccagtgggtgagcaaggtgaaaagttttattaactgatgaaacagctgtcagcagagaggggacgtgagaattgtctaccacccaaagtcaggtagtctctgtgtcccagtgtggctgagtccagggtttttatgggctcagaaaggggatggatactgattggtctgtgagtatgcaaaaaaaggcaacagtgtaaaaaccaattggggaagggtgggtataggtgaagaggtgggggttaatcagaggaaagcatgccaaatgggaagagaggttctcaatccagtctgtggatttatccaagacttgtagcttggctttcagactttaaactggctttggtttgcaggggggggtttcactggggactcacctgtgtttgcctagggatttgtctacctcctgctgtatcactgagttcaaatccccattctaccacttgccagctgtgtagccttgggaaaattactaacctctctggcctcagtttctccatgtttgaggtggaaataataatacctactctgctctgaacactaaatgagctcatttacgatggcatttagaagagtggacagaagtgaatgttccttctcccattattcatattgactccaccagtactgtctcacagggtcactgtatcatggcatccatctttccatgggtacatgtcttgtatagtccttaggggaaggtcttgttcttctctcctctcctcagggtccactcacttatgcattatctcataaaggatactgaagcccattgagggcatttcctaatctgaaggggcctctgatagacttctactacttaagtctcccatcactttcccacccttaaccccattctagaaaaacccataggtaaacagagtatacctgattttctaatacccattgaatattttatatttgtttttatactttgcaatgaagaatgtttcagtaaatttcctaaaggaaacaaaaaactcatagatgatataagtaagccatgtcacccctgggcttcctccaccttccactgtgtactacaggcagcacagtccctcccatgctgtgctctgaccttgcctgaccttgccaccctgagtgtgacctgcagaccagcagcatcagcatacccaggaagtcagttagaaatgtgaattcttgggccacagacttaaagactcagaatttgagcccatggattcttgcttcagggtctgtgctcttcgccaccacactacactgtttctctttatcagcaatgaaattgagaacagactcattgcaagacgctcattgtcagctccgtcctctactgacttcaaaacatcatcagcttttcacattaaatttgtttatcacccgtctcagatactatctttgatatcagaggtaagactggcattgtggacagatgttttcatgccttgacccaaaagggtaacaaacatggatactgcaggccaacacgaaggaattgtgttgatgggccataagaaccacaatgggtcccttaaaccacacctcagctacctgatttcctgcacatagggccagaaatatactaaggggaaaatggtagaagggaaaatgagaacaagaaagaatgagataccctgcaggtgtcttcctctactagggaggcccctgagaaatgactgaatgtttttagcaaaagattagaagaataatattatcttgccatctgttattgcttatagagagccaataagtgtgtcttagagattctgagttccagggatgatcccactcaggttccctgacccactgtgagtcatacctccatagcagaggggcccctaaccccaggatttccatgccttctgcaagctggtcttttagatttcatcagcagtcagtcctgtggccatggaacggggaatgatcgatgacagcccactgaaggaggaccttcttcttgtttgcttggttctggggaatgcatctcctaggcaggagcaacacgtgccataatggtaaaataatttgggaaaaaatggcaaaaaatatttgcttttgccttaaatctaccaaaagtggatcacaggttgaaaactgcctgatcttggtcgttcgaagcccctgagtggctcagtatttgaactcagtgcagccctgagcaaccaattaatatttgcccagtgggcaggattgacttcagttacctaaagatgttactactgctcttctggttgcccagagattcccacaccccgtgtgcagcacagatccagcagagactccttgccaaaggccattgcggtccaagaccccaaagaggaaggctccagaggtgactgctgcttgggaagtcaatatcggacatgagtgctagaaccaaggtaatgcttcccagacttcactatgcccaccagagacctggagagcttgttaaaattttgactgctgggccaagagagctggggctgaacctgagaatctacatttctaacaagtctccaggggatggtggtcgatggaccacactgagaagcaccatgtctgaaaatcttttgagccaaacattttatttcaccaatgaagaatttgggaccagagaggctaactagtatgtccaaaatcacccagcacatcagtgacagggttgggaccaggtgccctgactcctagtttccactgtgttcccactctatcagcttaccttaaaacagcaatcgtcatagtcattttatgaactataactcattttgagtaccaaatgcttttcctatttcctcttctttatctttataatcaccctttgaggttgagggcatgggtctcaacttatagagaaagaaacgaaggttgaaaaaagtaacaacaacaatgaaaattggctctagatcacaagccaaggagtagagctggattctacccagttctctctgaccttgtgctgttcctctttacatctcttcaggttctcagaggggagctctctctaccaaaggtttaatgcaagacccacatagtcacctagcttacggaaaggacaggcctgaagactagggtaaaattaagatgataaaacagtgaacaaatattttaaaactatgtccaggaggaaagctagaggaaagagccctaagccccagctgctccataggctacctgtcattctctttccaaaacctttcaggggtttaagacctagaaccacgtgtctgacaccacagccctgtaaattctgtccccaagagtcctgaggctctgcgcaaacaaaattaatagcctgcaaactctaaatgggtgattacaatctataaagcagcccataaaatgacatcatggggattcatatttattttctcccactgatttccactataaatttgcttggtttatgagtagaaacagtttcttctgctacgtgcctgggcataaagctcacctaaagatggaaacctaaagatgtctggggctcacttcacccccagtggtgctctggtcaatgggacacacagaagaaacctcccaaggaagctctggaaaccccaaagcagccactgcctctacaaacatgccctgagagcctgctgagctgcaggcttctgtgctaggtcttgagcagtagccaacaaaatgggggtggtctctgccctcagggaccttgcaagggtccctgaaagggaaagaggagacagacactaaacagaaaactacatggataacacatgggggttcattagggaatgcaaagggaaagtacagcaagctatgagctgtggaacaggagcagctaacctgatctggtaggggtgatgcccaagaaggatgagtaagtggaggctaagcaaaaggtggggaaagggagaagaggagagacattccaagtagagggatccacatgggtagagcccagctgtttgctgctgttgcagttgagccacatgagtatcaaataaagaatgacaaaaattctgggtcagacaacacatataggatataataagattaggttttcttccaagtgcaatagaaataaatgaagagttttaagaaaagaattaacatgatcagaaaaccatcttagaaagattctaccagccgcagttagaagaatggatttgacagagagggggtgtttaggagggaatgtcagcagatttgtaggacactattgcagttgtctacacaagaagtgatggtggcctgaactaggtaagaataaatgggccacagtgctatctaggaggtaggaccgattagggctgtcagacccagcttacgcaaaaagggcagggcatttaggaggtgcacagtagataatggtgatcactgacctactggcacttgcaaatgctttgaatccaatctcattagccaaggtcaatacctggaagccactcagaagccagtattggtacgaggtcaagtgaccacctcaccagtgcaacatagcacacgcagctcaagtcatccccagaccagttgacactctcaacttgcaaaagaacacatgaggtagaatccctttcctttaatttaacccaagctctactactgcctcagttcaaaggtcatcaattgcaagatcagcagaaggggcatggctccctgaatcccaacaaggctacaagggttttggttttacatagctcatccaaagccagtctcttctggccttcagaaatttctccctcttccaagctccaagggcatttatatcatccctgtacatgcagacacagtccccaacttacaatggctcaacttatgattttttgagtttacaatactccaaaagcaatgggtattcagaagaagctgtacttcaagtacccatacgaccattttgtttcctactttaagtgcaatattcaataaattacatgcaatgttcaacgcttatcacaaaataggtgttgggttagataattttgcccaactatgagctaatgtaagtgttctgagcacatttaaggtttaaggctaggctaagccatgatgttcagtagatggagtctcgttccgtcacccaggctggagtgcagtggcgcgatcttggctcactgcaagctccacctcccaggttcaggccattctcctgcctcagcctcccaagtagctgggactacaggcgcgcaccaccacgcccagctaatttttttgtatttttttagtagagacggggtttcaccgtgttagccaggatggtctcgatctcctgacctcgtgatccaccctcctcggcctcccaaagggctgggattacaggcatgagccactgcacccggcctaaacacatttttaacttatgatattttcaacttatgatgggctatcaggatgtaacaccattgtacgttgagaagcatctcattctaccttgcttagattcaatttggaatcacaacttaggctgccattgttgtctaataattgcatgttcattaacctgttttccaaaaagactttaagccaccttaagataagcacagcatacccagcgacaaggtgctgtagatgagcacctactaaatatcagagaaagaagtgaattgactgggcccagaagagaggaaaatgccagtctggtgatgccagaccaacagagaggagtgagtgggaggacaggctcagcactgaactatctagagttgcccttgagtcctagccaagatggctgtcactccccaggtgcccagagatggtggctttcttgagcaattgatctgaaaataggtcccctaagcagaccttgtcactgaagttcacacactgcccaagctgagtgccatgctgagcatagcccagatgaaatgattgctcatcttgagggcaacatcccagacaaaccagtcccttttatgtctcactcactatggagggaaagcccctgctctcttgccctcaaacattagatgggcttacagaaatgcattcccatttcataatgcctgctgtgattccaggtaattcctctaagtgcactattaaatcccagcagctgttccagataacagcaaagtcgacaattccagctgccgccttgtcaggaaatgaagcaaagcagctgtaagtttcctaacactgagacatgaccaaaatggcagcatgagggatcactcatgtgcaggtttctccaccgccatgcagataatgtgtgtccaccatcacacatacattacctgccctgagtctactctgatgtctgaggctggaggactcaaaactgtgggccatattcccctgagatacccagctacagttatctttgagatcctcatgagaaagaatcccaaattaacactgagcccctacccataaagcatgctcaaggtgctggagaattgcttaaggccacacagctaaaatggccgccaagtcaggatttgaactctgatcctgtgagctccaaagcatcaagcttctctatccttcactgttccctactgctcttaaagccctgtatttcccttacccaaaggagcccggccatctcaacagtattttcgccatctgggccaaccacgtgccggcagagtgcataaataccacttttgtgaccaaaactgtatttcctcggttgatccaacatcagcatctttgcacctgcaactttccttaagaagaatttttccatgatgtgatgacagaatttgcagccagcaaaggggatcatagacatacatgtacacacgagcccacaaccatctacttcaaagcctcccagcctgaagtacgctctccagatgtctctatataccaggtgcttcgaggctggccagcatctccctgacagcagaacaagttagtataaggaatttctatttaaaagccaagttctacaaaagctaagccaagcaaggttctaataaacagtaaaaccgccacgttgtgacacatggcttaaagttggtcactcacctaggtgggtcagaaagacaccaatgcttttcattttccccagcacctcaaccctggttagtgctagggtgggatccctggtgggagactccacccacactgaacctggctggcttcacttttccagactggtgtgttctccaggcaaatatatattttccccctacccacctccctccgtgtgactcagcaagcaagtgctgggtaggaggagtgctggtagggtgggggacgactctgttctcattccaggctcaaggaacagcctcagtcatggacaagaagtataggcagagagtcaggagaccaaggctctagacctgttgttgatgactaagatggcctgggatgagtcccacagcctctctggtctcagttcctcatctataatttgcaggttgaatgatacctgaggctctgtgattgcttgagtcagccaacagctcaatcagccacacagaaacaacctctcctcttctctcttccagcctggataaagcttgtggggcatgagatttatgggtttggtgctgaattgcatcatgtatgaggcagaatttgagttggattttcatgggttgggaggatttgtaaaggcattgaaggcatggggggacatgagtggcataaacaaagaagtggagtcaggaatgtgcttagcgtctttgaaggaaccactagggatgataatttagacagcgtgcactagtacaactaaaccagtctctcaaatattgaaaccttttgtaccggctggtaaacagccaatggccttgacttaggagtgccccctcagctgcccctgctgctgcagtgcctatcccccatcccaaccccatgatccaacaaccaaagggttaatttctgagatctcgatccaaaaggtgcccataccatggtgatcctagtcagcccaaagccacaccacacatctaacaagcattcctgtgtgccagataccatcttaggcacattaacatatgttactttttctccccttcacactaacctcttcagattaaggaactgaggcttggagcagttatgtgacttgttcaaggatgcaataacagtatttgaacaaagaccattaaatccaagtccagagctcacttcttaaaaccccagctgcctctgagcagccttggcccgcagacagacgagctttggaggaaataggaggaatttctccctgctatggagattgttttaagatcatgaattgttagcggaacaagttgtcgtggcagcttatgaaatcaccctcttctgcgatttttataagtaagaggggttagaataggcccagagacagagggagagatgaaatgacctaataaaaccctttccaaccctggaacacttcagccccacatgaacagaaaagtctatttattttcaaagccccattttaactcctgaagtacttaggagacttaaatatgtctgaaggcaaaacaagttccctctttttcctcttttcctaccactccaactcttcattgcagattttcttcctgcaggtctgacaaacaccatttttggccacagctgctgtcagttcaaaagtttggctctggggtctgaagaccaaagtctgtccaaggctgatcaccttctgagaaagactcttaaattctgtgaagagtctccagcagaggagaaattggtttaaaaaagcaagaagaatcaccacaatgcatgcccactccacattaccaagcctgcacaactcatgttaggggatgtctgctgctcctccagctttctcccctggcaaatacagtggtggtccctgagtccccattagggcccaacagcaggaccagtagcagcccctgtcagagaaaccacagccagttggggagagcgaactcatactataggcttgtttccatggcaacagatgctccctcctccctgcttctcggcaccagggaaggacaaggaaacccatgagaagacagtggcaactagggggaggaggaatggcagcaagtcccctttctttgaaacccaggcagctgctgccccacatgttgatggttacagctctcagtgaccttggacaagttatgccccagctctgaactttgtttttatcatttaaaaaaataaataaataaaaaagatcaagagattgagagagagagcaagcgagctgggccagagatgatccaataaagctatttcagctctgatgtcccagaatccaatgatttgtctaacctggccagtgattgggaatgggttcacctcttcttgcagccctctgcaggagcatgacattccgcaaggctggagtggatctgcctctcagggacctaagccttatccattcccccagtcatgctgcctccctcacaatggtctgctgtcatttctctgaaatcatctcaggagatctatcccatgctttcctaagggtgcacgggtttcctggggctcacacaagccatccaacatgacaggtgagccagaatgtcatggcaccgcacccagccacttgcctcccacctcactgatgttgttggattcaacctgcaattcagatgcacacagcccactaggcgctagcctgctatgactgcgcaagcgaaggaactccagggagaacacccagaaaggtcattttgtttggtatgaagagtgctagggtgaggtgaggggcagggagtgggacagaagcttcccaggaaaaggggaaaccatgcacagcagccaggagccatggactccaataccccaaggtttggaaaagtacttgtaattttggctgattgaccaaaagtggaaagaggagtgtagcatgagagaagggaagagaggaaggacagaaaagtggacaaagaattccaggagatggccggccgcggtggctcatgcccgtaatcccagcactttgggaggccaaggcaggcggatcacctgaggtcaggagttcgagaccagcctggccaacatggtgaaaccccatctctactaaagatacaaaaaataactgggaatggtgatgcacatttgtaatcccagctacttgggaggctgagagaggaggactgcttgaacttgggagacggagattgtagtgagctgaaatcgtgacactgcactccagtttgggcaacagagcgagattctgtctcaaaaaataaagaatgccaagaggcataaaaacacggcaatgcttccagggctggatttaggggagaaaagggagtactcattgttggaagtacaagccacatgcccagtgctagcttttatgggagtagcaggggatagctgagggccaggttagtcactgagccctccacatgagcctggtgggggtgtacttgtttccattgtatgcatgaagaagcagcaactcagaactacagcatgatttcacctagtaggtcagctaccccttttctggagtatacaatcttgctgggggacaaaataaacaatcatggacaaattaccacatgatttaaaaattgacacacggccactctcacaaccatcctcagaaatccagaagttcagggaggaacaacaacaaattggacttctgaggacttcctgttgccagtggactttaagaaacgttcagcctctccagcgcaattcacccctaacctatcagactccgcgttggtctgtgatggctcatctctggctcggaaatggttaaacagttcatttctgtgcttgaatcaggagcttccttaaacgctagcataaagctggtctacacataagaaatctgattagctcccagcattgggcaatcccaattattatgccctgcaagttgctctgcaggattagcggtctgcggaagaaaggaatcaatatacaacagtaattagggctcctgatgccggtaagaggagcacttctcttccccttaagccactcacgacagagtccatgaggggacagggccttcacagcactgccagtctctgttttctagcatatgttcattttgactttggtttttatttactgaaggatgtgaaattctctgctactgggccaagactttagggctacatacgtcacccaagaacagcgaacaggatgtgtcatgcatgggaccttccttccaaggaaactcagggaaagcagatgctaggatcctggcaaccccaggaaacctaatcagtgtccctgtaaccaagagctctttgagaacaggggctgtgtcttatttaccttatatcaatgtggcctagcacagtacctggcacatggtaagtaatgaacgggatggatgaggaagtgaatcaatgagtaagtgaattaataacacatggttttcagtttgtcaaaaactttatctgtgagcctgctgtgcacagaattttgtaccctaatactgtagtagcaatttacattggactcacaggatttgggggttaaagggaatttgaatataacccaatctggtatttttaaaatcacaggttgcaacctattagtggaccatgagatcagtttcatgagtcctgaccgtcattttataaatgaaatgagaatggaatgaaatgaagtggagtggagtgggatggaatgagatggaactagcaggaaataatagaatattccagaatagaaactatcaaagtacatcacatgtagtaaaggtgagtacaggaaaattaggcttgtacttgcagggcatgagtgtgtgtctattgggtgtacagtgtcttaaggccaaaagccactgatgaatctaaccattcatccagtgattttcactgccctcagaggccacatcagggacaaataattttcctttttgatcccctcttgttacaggaaatgaatttcatccagaagcagcctgtttcacttacagactgtctggctgcaggaattagggcaaatcagagatgttatagaaagaaaaagaaaatgtttcctagatcaaaacacccatctaagtgctggggccatagagatgagatcgattccattttccacatgacaaacattcaaagattttagaatgtcaattgcgcccctgctgaatggcttggagaagagcaggaatagttctagttatcctaacaattgctcctaagatgttgctttgtacctgctcgttatccatcttgattgtgtttatgtaagttccagcccattcatgacccctggtgtgtggcatgaagaccatcacatttgagtctggtctgaagcttgtctgggtgatggctgaggtgaacccatgttagctcctggtgctcaccaactctcttcctaaaagctctcacattatctgttcaaaagcctgcatccacctagcagggtaatttcatcatccctgccctctcgtctgtgaataaacagcttgaactaatagtatttttcaaatgtttttgaccacaaccctcaggaagaaatgtactttacaacatggttcagaagacaccaccacacccccaacacacacacacacacacacacacacacacacacacacacacacgaagcaatgtttacctttactatatataatgggatgtactatgatgttttattctattctgcttcatttcttatgatgttggtgatgacccattaaatagatttcacaagctactgatggaccatgacccacagtgacactgaactagatagtacctaataatctgaaaaggcagggaagggcatctgggaagaatttcacaccaagcccatttcttttcattatgtttatttagccatgtgcctacgtttggttgtgtgtaaaggaagacaatggcttagtgagctgcagccaggctgttttggggactcacaaaggaatggtcacagtttcctgcctgtctcttattgccccccaggcaagctcattgagaaaagacagtgtgagtctcgtacagagcatgctgataactattacagatacgtgattattctcggttctgttgatgataacaacatagctgccatcttgtgtttgtttcctcttaggattagaaagcaaaagcaatctgaagattgaaagtcagaagcaaagttagaatggtgatttttttcccccaacccaacttggaagaatttgtctttggagaaccaacctaatcaaataaagtagcatcaatttactggagacataatccaacttgcataattgtcctggctggtttacaccacagctgttcatatgacatggttcattaaataataaagtcttcatcaggctctcctgcactgggctgcaattcttttcccccacaccaccaaagaagtgctgcctttattagaatgcagtgccacccattggcagtgggataatcaggggatttgtttttatgtgacattctattaaccaaacatcataaactgcatcaagtaaaagccactgcattttccccagtggaggatcccatcaccacataatcattctagactgtgggttctctgtgggcagggaccacatcccttcatctttatattcccagtgctaagcaaagtactcagcattggtgggcgcaagataaacatctattgaattaagaggaaaatatctccagtgtgggattcagaagagcaatgcttagaaacctggaggctccctggttgcaatgagcatttagtgtcttgaatactgtgtccctttcctttctggtttattaattttccacttgactggaccaaattttccaagtccacgtgatagcagacaggactctcaaaatcccctctggccaacagaaggttcaacaacaccaattttgctgtcttcaagctcaggagccctgctgggcagcagggaacctgtgccaatctcagtcttcctaaagaatcccacagttaaaagaggccacctgaaaatgggctgctgagaggtaacgatgaccttggaaatgtcctcaggtttgggaagtcagcaatttggtttacaaagcatgaaaaggaagactcgttgtaaaatacagaagatttaccagcttaagtagtttagaccaactcaaacttgagcttgagcctgcacgggactctcctggagggattgttcaagcacagagggttggcttcaccctcagagtttctgattcaggaatctgcacctctaagatccaggtaacgctgctcctccaggcaccccactttgagaagcattggtttagcctgcttattacaagcaaggctctagagctggctatctatgctggaaccctgaacccaccacctcagccaataattttaggcaagtcatttaaactttcccatccccaagatgcaagtgtcaaaccaaagcaccaagaggatctttctcacgagattgttatgaaggtcaaaggaggacacccactgcttaggggtgtgcttggtaggtagaaagagcttaattaaagttaaccacataaaggaaagtagggatatggtctgggggaaagactgctggtcagagaagccagatatgcattctagctctagccctgcgaccctgacttgctgtgtgaccctggacaagtgacttctttctgggtcatgccctcattcataaaatggggacactggacattctataatggactgaaggtgccttggcgctagaagcttccaaagctccttgctcctgactctatcacacagcgtcacgtacctgtagtgccttcccaatcaccccctaccacttagactgccaactgccaggccccagcaggataactcaagactgccttgaagacattgtctggttccttggccttgaagggtctttccacttggccacaggtgaccacctgactcaccgaatgtagtctaaggaacccacttccacctgggaagtgcaacctgggatccttcttgctgaaaccctattgcactccaccaagattttgttcacgtttcatttgtagccagctccactcatgcctctcattgatattcttttgtggttacattccagactggaagataagggaattcattgaagtgtttagaagggacaagtgtggtttcatcgggagtgttatgctcagatgagtattggaggattagttggggagagaatccacactcgcagagggagatgaggttctgaaatttattatcatagcctggttgtggggaagggagcctcaggaggagggttggaagcccaaattcctaattgaagatgcgaagcccattttcatcttatatttttattagccccatagcagcccactgcactggctttctgctaacagccgatggcagggagaggatgcttgttggcacaaggccgctgtacatttcatttttgtcagatgctggcaaaatttcctcatcagggaagataaattcgaggtgatattaataaacctctgaatgcagcaatcagatctggctggcactcttaatgattccaccagcagtgagccatttccagcctgaggagcttagagattcacggttttgtttaaggcatcccaaaaactagaaattgtttgcttgactcctgggttgagcccgcatcttcaacctggatactcccaggtgccccaagtgaggcagtagtgatggaagagaggcatttacaaaataaagtcttgggtaaatgttactcactattgttttgtacccagaaagtgctaagtgtctcatactatctcgtgtaattaccataggctcagtgatggaggtactatttttaggtgaggtcactccaacttagaaaggttatcattaacaatattggcatcatcatattgcaatattgactgacactaagtgctttctatgtgactgagcttaggattttacctgcattttcacttttcatttgcacaacaagttatcaattaagcactgtgatcgccaatttacagagttgaaaatagaggcttagagaggttaaacgtgaggctcaagatcagactcaagatgcatagccagtgatggaatccatgtgtgttggattctgaagctcatgccgccatggactgtgcttgttacggctcacaccaccatggactctactgtggaggcacaaccagagggccccatgggtctccacttgtagaaggcggttcacctatcatcctaccttctagtatgaaagcagcttgcactcataggcaagcttacagaagggtgcagccccagctcttgacatagaaccaagcacctggtaggcaccctttcaatgtttgataaataaatgaattgatggtcagtccctactcacgtcctagaagatttgtgaaaggacagttgaaattagtctcctatgctgctgtccacctcttggtatcttggtggacctattcaccaagggccaaatgtccctaagcacaggtgagaagagttgaggaaggtttttgtatcctactctgagagcagttggagacttcgttccttggcttagaagtcaagattggatgcagaactaggcaagttgcttttctgagcaaagagagtgctggcccaccccacatcctcccctggctgctggcccgctgcaagccttggcacacaagagaaggaggcagaagtgcatttgtttattcattcacccacaaacatgcctcaagcaattgagcacctactgaggccagagtagttttgggctctgcggagaacatacatataaataagaaaccatccttgaccttgaggaatttataagctaggaggaaaaataacaggtacattaactcaggtgtcagctgtctctggcttctccagtgcctaggcccatgtatacagcatcttgttttgccctgaataactttcatcctgaaggttacacttttttgagcttctccctcttgtccctcatcccaccccatcaccaccccatgccattgctccagatacaagcaaaaaggaacaacacagactgttgaagatttcacaggtaaggcagaaaaggaatttaaatcacatatctcatggcaaatgctctaacagattttgagtttgccttagttccttccaggccaaagcacaaccaaggatttccttccctgaccttttcccacagagttccttgaggtagaaaggtggctccaagaagcccaagtccttcactcgccctccaaaagcctcaccttttcactagagcagtcttcaccccttgtagatgtcattaaggatattcacaaatactcctattacgtcctctttctgggcaattgtaggattgcactttctagtttcctaaagttaagtgtggctgagtgctgagtggtttgctctagccaatgtaacatgagccacatgatgcgtgacacttctggatggaagctcttagccagagcagttcaccactgcctcctgccaagacggtgctggaagcaaagaccaagaggaagtttccatcaatctggtttgctgagtgactctgatgaacagcctccaccctcctactggcctcctaccttcatgactgatatatactgtattgagcaagaaataaacctttcttgtgttatgccactgtgggggctgtctgttactgtagcagagcatggcctcacttgactgatactgccctcttcgaagcagaacaattctgctttgctctgacctacagtcagactttcacactaaaccaaggtgggcactcaccaaacaaaagattctccaggtaacacaatctacactctgtggatggaaagttatggcatcttttgatggtggagcattttccttgaggtcttaccccttactccatgagactcatcaacatattttttctaaacaaaatggtggagaagaattctggggaaagaattctggggaaagagtgtctggcacaaaagaaatatgctctgggaagtgcatgaaaaaggtaagtgtcaaaacagtggagacacaggaaatagtagcattaatttggacataagatgtcttcaagaagaaagtgaagtcccccaaactttcatgcaggtttctctgcaaggaaggaaggggctactcccctaagaacctaattggaatgtggctctgggtgccaaagctgaggctgagaccctaggcacactcaaagaaggaagagggagcttctgtggctctcggtgctctgcttctctgggtcaaacccttcttgccacacaggtgtgggagcctgagcaggccagtccactcctgccctcctttcagcccactccctgggccaggatgcacacaggtatgtattccccaatttgagccctgcctcacttcttcctcgttgttacctgccagcaccaccacacttgagaacagcagacacattgaactaaatatgatatgatgtaactctagcctaggagttacagaaaaaaacccaagcacatttctaaaatattcgagaatcctgtgttgaatgttaaagaaaccaaccacataggatctttataacacaccaaggcaggcactcacggcctgtcctgaacaaatccaaatcttttatccctggaacctacgtcattgtccacctccaggaatctgtgctgttgagctgacggctcctccactacaatgttctgctcattcaagactctgtcctcagtggttcatctccctcattcacatcccccatcaaaatatgtctgacttgtatcctattctttcagggcctttctaagaaaattccaaatgtactctagcagcttaatattttgccttccctaggcaagatgtttatatttaatcaaacaacttctgggaatgatgtatgtttagtgtaaagatatgcattactcagagtggaaattttcagtatgcaacagatcataatggacagaaggctctttgtggagtccgtggcttcaccctacatgccattctataatatataccacatgtgccaaataaatcccctaaatacagctccaaaaataacatatcagtatccattctcaagtaagcgacttctgccatacccagaggagaaagcatcagattaggtaactctgcttagtggtaacattctctaaagatgaaagcacttttcccactgacagaagcatggctccaagaagcccaagtcctgaggatattgtcagtaaaaccacacacacaggtcacagcttgttattaatcaattaattctcagcttgctttgtcccaagtcatccagcagacagaacaagaagagatttacaagctgtgtgcatttaaattaatatttttaaatggcatgagtgtgcaattaatactttcgaagaacatgtccacaccagatcaggcagtgtcggtttttttttcccctgtccatatgagtctatttttaattcctttcttggggaaagacaacagtcctagatttgttttgttttgtgtttttcttctgagactcaaaataaccatgttctttctgcttcagtaaatcattactgcagcttgaaagggttcctagaaagttctagttccattcagtttttaggaggaaaagcaacccaaacacgccaagaactagaagctttatccacaagggagtacgcttcaggatgataccaactgcattaatcaggatagacaaggttatgctgcagtaacaactaaaacctaaaattccaaaggcataacacttaaacatttacttctcactcaggaaaagtcactttgggtctggtgactctccaacacagcttcctttaaagagatgactcagggattcaagctgattgtatcttgtggtctacaatctcaatgcatggcctctgcaatcaccatgaaaggccaagggagagcatggagaagcaggtagaggcattttactgactcggactaggagggacatatattatttctgtgcacaatccactcaacaacaaggggccttggaagcatgggagagtccacaagtatttgatggttattaaatctctctttacacgggttatctcatagtgatgttaagagacttcatgatgttgttactctacttagaaactcttggatttcagcccttgaagaccatgctccaacttcatcatcaaatcctcaccagaaaagacaagaggatacagaacactgagcaactcacaagatgtgtgctgcagatgtgtttatcagaactcaaaagtttcctctcttttctctgtcctatgactattccaggagtgccagacagaactagttcttacgctctgcgaagaaaagagtggactggaggtgggtcacattgacattttggtaagagccctactccttagaaacagaatgaaagttgtcaatgaggggaagggagtaaggactggctaagagtagccatgctgggaagatttcattgcaaattttcctctacctgggagctggcagataaaccagatcattgttcccaaacactggaaggaggaccgactgttaaaaaaaaaatacccatgctggagcctaaatactctatgctagagcctggctattgacatattagcaagcatccctgggcaatccaatgcacagtcatattttgcagtcattgcactaaaggaatatccaaggtccccaccaacactaggatttcacaatttatgagcattttgaaagaatttacccctgaggattgacttattcagcatttaaatgggaactaagaccacgtaattgactgggaccaaaccaagatcagaattcataacctcacagctgttcctcatgtcaactctttctattctaacacactgccatcctcattttaaaaaagggaatgtggccttgatattcccatagattgctggatgcatacttccctgtcaccttccagtagggacacaggcattctattagctcagcagaatacagggctcccatccacatctgatggaaggcaaaggagatgaaactggtctccatgttgaggacagactggtacattaaagaagcaataggtcccctcatttgtacaccaagactcaagagttgaatctttcctttagtgacaagtggaagtccatggaagaatatttacaggcatggaagagtgagtttgaagtggggggcaaattctaaagagtaaagcctttaccaatggtaaactgtgccctttctatccatgccagcttgggaacccagttgagagtctgaaggagcaggacttagctttggacctgtgagatttcctctgtccccatcccaactgtgctcaggcccatcactttgcaggagcataattttatggcaagaggttcaccacatacctattgagctgcaagaggagtgatatcaatgtgcatatagttagggagagcaaagagtgctaatttagtaactgaagataagttacattgtatatgagatgtatttatatgcattttctacttctctctcctgcctcctgtatcactataaaccctagcagtcaagttccatgtcaggcctgttggatctttttcctgccatagagggagggacctgggagatggggagggattcagggatgacagtgttccagagtttgaactgggcataaagatatagaaccatccactggccaaggctgtcataggtaaatcctgcctggaggcaatttctagacagaacattctgtgagcttctaaatgatcctgaggtcggtatgcagatgctgacttaccagatctaatttgggaaaaagaagagggtaagaagttatatcttctgtggggattctggtggtaaggatgggcacagaagcaaaagagtgtttcctccttctccagaacatctggcttcattgcaagccactgtgggctactggagtagatggagagcagacagcatggcaccaactgaacactgtgcccactctccagacctgtccatgcaacccacagtagtggagtggccactccagggtcaggtagatatggcttccttcccagctctgccaattcccagctgaaaacattcttaaacttttccagtgtcctgtaaaatgggaaaaccagacctgtcccattgtatcctagtgagaattacatgatgtcatgccattaaagtacccagtaccaagcctggtacattataaacatccaagagcctaggtcttagcttcttcacctagcatgacacctctcccacccagcttactataccactgtgagatgataaaagcacacaagccctgtcaatgctaaaatatttatgaagctatagagaatatttttttaaattttcaacctgaatgtctgatttttttcttctgtatagagacagggtatcactatgctgcccagactggactcaaactcccataattctccaaccttagcctccagagtagctgggtgccaccatgcccagcttgtgtaagagcttttctgtcacgttctcagcattcctagatgcatgcatcaggacttcaattcatgcttcttcttgcctacaagtgggttctgttggtagctggaaagccaggctatggtggaggcaacagaaggaatacaggggtcccctttccaaacctccaagttatctgggttgggatactacaattttaagagtatcaaggaaggagctggagagaggaacttctggacactcagtatagctctagactctctctctctctctctctctctctctctctgtgtgtgtgtgtgtgtgtgtgtgtgtgtgtgtgtgtgtgtcagagaaagagagtgagattgattttttattttgaactgactaggtgccaccccttcattaccatgctgatttaaactgtcaagactgcagcctggcctgaccactgaggagcaaagacaataggaaaacagaaggcgactcaggatgcaaatgcctcattgttacagaacaataaacagattcacccttttgctaaatgtcaggttaatatcctcttggcaccagctgtgcctctcccctccttccctgccacagtgagtccaggctcctggaagtctgcccttcaccagccacctaggctcagcactgggcgtcgaggagagcaggtgtggctggcacagtaaatgcaaacacaaccagtccaaccgcaaagtggaatcagcctttgcatggagtgatatcctgggacagcctcaagctctgactttggggagctctgggctttgggctacagcttgggtagctgactaagccaggggatggcactaacacatgttctccgtgtacttactcacaagccaagaacaggtaggcaaggagggaggatgaccttcaaggccagttaccaacaggctccaaatgcatttcccatggatgcccactgggcccatccccattcctccctccaccaagtccctatccattctaacttctcatgatcgcttctttctgccttatctctgcattgacattgacactgttgttgctggggggctttgctgtgcttgcctctgctgccccaacaggtctccttgtcgccataccattctccacagtatctgcagagtctccccagttagatgatctggccaggtcactccttaactcagaatacttctgtagctccctctggcttttaatgtaaagccaaacccttagcaagccactgaggaatgagtttgaccccattcctctgaactcacatggtcctttgagtttaccctttgcccaacccttattatccaggatgggggttgactgttttggtttcttcccccccatttctaaggacaggaaccatgcctcttacctctgcacaccctgtgccttacatggggtatggaacaggaaatgtgctcagtagtgattggaagccattcattccttactcagacctctctacaaattgtccctgagtctaacccacaacttccctcactgcaaaaatccttcagattgctcctgacaggactgtcttcctcatctcatctgttttctctgtcctaatcactctctggagcttagctcaggttcccccacaagtctcaccaccatgaagcctctacactgttttgtcttctctaactgcatcccccacgtggaacttcataacggtaggctttgtaatagttactttacacctctgaacctcatctacaaggatggttcacaatagatttgccataaattttaaattatgatgcaatataaataaagcacatagcacagaatctggcacacagtaagtgctgaaaatagatttgtctgatggtgaggacgagcgtggtggtggtggtggtggtggtgacagtgataatgatgatgatatctctgttttatattgcaagacccagaatgtcaattccttctttgagggaaagggccactgcttatagtggtcttgacaaacttcaaaacatatggcccaatgcttatttctggtggaagctttactgaccatattaatgctattgataatattttcatgttattggtattaatcacgttaccagggaaagagcattggattcaaagtcaaatgcagactttcagtcctgtttttccactttgggcctcagcttccttagctataaataaatgagttttccagagttttccagaatgatctgtagtcctttctagcaatgataattacgtggttattagtgagactagtccacaccaaagtgagcctacactccatccatatgggtcatccctccccagtatacctgggccccaaaatgcaagcacaccatggggaaatggaagaaattgggacttatgtcatccaaccaacagaacgccagtcctcacttcaacacacaaatgttttctgttttaaaatctactccagcagcactacaattggcattccccctcctagcagtgggttagcagcagatgttacagcaaaatgatccagactgggggtgattattaacccttctgcacagcatacccatttttgcttctgggtccacacttgcacacctaagacaagttcacccgccatccctgtcatcaagagcttcaccaccttcttgtctagacaagcttgaatcccaagcagaagaggagactgagcaccatatctttgctgctgtttttgttgttattgttgttgttgttgtttgagatggagtctcgctctgtcacacccaggctggaatgcagtggtgcaatctcagctcactgcaacctctgcctcctgggttcaagcgattctcctacctcagcctcctaggtagctgagattacaggtgcccaccatcacatcctgctaatgttttatatttttagtagagatggggtttcaccatattagccaggctggtctcgaactcttgacctcaggtgatctgcctgcctcagcctctcaaagtgctaggattacaggtgtgagccacctcgcctgaccagtatcaaatcttatcaagtatcaaccacatcctcctataaggtgagaaaccagaccccactgtaaggtaggactgcccacaatggtgtaaagagccatctgggaaataaatagtaaatagcccactgcaaaaaaaaaaagtttcaagacagacaaacctggcttctctatgtatagtctgtgcgatcttaggtaagccacttaaatgctctctcagtttcctctactataaagtggggatttttatgtcaacacaaccccaggaaataggctttgagtataataatattcacaaagcacacaaataggcactctgaagaggtcagcccctccctttccaccctgaggaccttgtgggagtgcacacaacgtgacctcaaggtaaagtgggactctgctccactgtttatgacataactgggttgtcttgcacattttaaatatctgtctgtgtctcattttcttcatctaaaactattcatatccccaagatttgttgttgggaattaaacaaaacaatacatgcaaaacagtacttggcgcacagtaagcactcaataaatatgtaattgtcatcacccatgttatcattatcatttaatgatgctgaagaacaagtaagtgcttatcacttcctttaaatcttggcaccaaccacactaaaatctcaggcaggcaggtcaaactgcaagtcagagggccagtactgtcaagtcccaacgaggccacaggaccagttacccatccgcagattatccttggaaaatgtttaaagcatcatccactctgatgtcagcaggtgtgtgctcaggcagtgctagtgtgacatcctataaaagtcagaaaaaaggcctcaaagaagataacctgagccaagaacacaggcgtagcttaactaaaatgtttgtctactcagacaccttggcccctgtccgtggtcctgaaagagacaagtggacaaagactgacgggtggtcatgacttttctttttcccttttgcaaatagttgaagacctcttctgatgcaaatggtatcaacaaaagataacagaagaaaacatatatgggaggtcatgacttctgagacatttccaaggagaaaacagaaagactcttcgacatcaagttcaaataaacaaaattattgagaataaatatatatctatattttttgtttttgtttttgttttattttgtttttttaagatggagtcttgcactgtcacccaggctggagtgcagtggcatgatctcggctcactgcaagcttcacctcctcagttcatgccattctcctgcctcagcctcccgagtagctgggactacaggcgcctgccaccatgcccggctaattttttgtatttttagtatggacagggtttcaccatgttaaccaggatggtctcgatctcctgaccttgtgatccccctgcctcggcctcccaaagtgctggaattacaggtgtgagccactgcgcccggtcaatatatatctatatttttagtcattgggcttccccacctcttataccctgactctaaaatcatcaaaaaacccttcataatgcataccagaaataacacaaatcacttgtgtggtctttggctactgctatggtctgaatgttttgtcccctcaaaatccatatattgaaatcctgtcatccaatgtgatattaggaggcaaagcctttggaagctaactaggtcatgagaaggatctctcatgaatgagactactgtctttaaaaaagagattccagagggccctcttgtttcttctgccaggtgaggacacagtcagaggactgccatctatgaaccagaaagcaggccatcaccaggcatggcatcagttagcaccttgatcttggattgcccagttttcagaactgtaaaaagtgtttttgtgtcaaccacacagtctaggtatttttgttacagcagctcaaatgaactaaaacacctcccctctgttggtctggataataagaaattgaacaacacgaatgtcctatcctgaaaataatttaattcttctattccctcatttattgcaaagacatgacagaaaatatttagtaggagcaaggctctgagatttcaatcctaacctctgattccagtcctaaatccatcactaatcaggataagaccttgggcaaattgcttcacctctttgtccctcagtttattcatctataaaaatgataacaaaaataatacttagttcataaggttattataaaaattaaatgagataatgcacccgaatagcttaaaaagtgcttgccacattgtacaaccccagtaaggataaatgttaatattataattagttttattgttattattattgttgttgttccaaattagacgtaaccacatattggtttgcacaggtgccctttctttgtactgtttctaatatctaaccccttctatcctctgcctgagaaaactgtggacatatcacgtaagatctgaagaaagtttgttcactcacccacccacccactgagttcaccataaaaagaattcagaaatttcttacaatgggagatagtaaaaacataatggccacaattcccaaaaagctgcagagagcttatacaccctcagtccacatcacaacagagccactctccactcccttacccagccatgcttggggccactcctactcacttcctcatcattctgtcaattttagaggagcccacggggctcacacaagctgtgcagatcaccaaggttagtatctccattgccttgctccttggaagaatgttcaatattagttcagtgttcccagcccacaacctaaagcctccaggagtcaggatgaaatacaaacaatggcaatgacccctccttatctggaactcacaataatttcgtaaatactgctatgcaccttggttccttcaatcttcttaacatccctccaaagcaggcggttagtgatctcccgattatacagaaaggtagctgaggcctagagattgacatgacttgctaaaattcacacagctatcagtgaatggcaaaatcagaacagcccaggatggctcttcaggcagcaaagtttagtgggaaaagcagccagggagaactcaagttcaagggagaacttgaatcttaacacttattacctatatgacctcaataaagtcacttaacctgtgaggactcagtttcctcacatgtaaaatgaaaatagtattttccattcaggatgctggggcatgcaataatgtgggagagcactgagccaagtgtttggcacagagatgggattaaataggagggtcctattgttattattactatggttaggggagccccattccctctccaacgtacagagccacacggaatctaaactaaggaggccataaaacacactggctccagtctaagtccagtgtctttctccctgccccccatgtacctgccagccacatgcctgaacagcagagagagagctcaatcatcacatgtggcttatctagagaacttttaaatcccacgctggcctgacccaccccagctggcatactctcaggcctctgacactggcagcaggtctgagcatgaggaatacagtatctaatctgagcaataacttgcttatccttatatttaatttatacaaaagtgctttatgatatatggcatgatggcaaccatgggtcagtgaaacatatgaatttccattaaacatatccacttccataaacaaccattcctgttttgagtaggtagagccagtaaggatgaaatgatgctgaagaggaaggcagtggagggtattttataaatatcaatattcaaataccacttaagtcctcatatttacttaataaatatgacaatgggccaggcacagtggctcacacctgtaatcccagaactttggaaggccaaggcaggaagatcacttgagcccaggagttcaagaccagcatgggcctgtctctacaaaacctttaaaaaaaaaaaaaaaatcagctgggtatggtggtgcatgcctgtggttccagctgcttgggatgctgagatgtgaagatcccttgagtccgggaggtcgaggctgcagggagctatgattgcacctctatactccagcctgggcaacagagccagacctcatctctaatatatgtatatatatataaaataggtaacctgtcccctgtcccaaattgccctggggagcactgcaaagccttaaagaaatacattggggattatctgcttgtttggttacccaagctgctacttcctttttgtctataattaatgaaattagaccatgcacatagatgagatccactcaagtctacaaatattgacagcactagatatacattttgaggccatgaaaatgcaatgaggaacaagacacaacccctgttgttacgagggcacagcccattgtgggagacagattacatagcatttacagtacgataggctgagtacgcaggggtaagggaacacagaggaggaacatgtttcctgaatttggggcccaaagctgagacctaaagcgtgcacaggagttggccaggggatgagagggaaaaaaaggagagagagttgctctgagttaaggaaacatttgagcaaaaaatccatttgtaaacagagcttggggacctcagtgctgccactgagtgacaattcataaatgcagcaactctcagccacccacccaacattattctgtgcttgatcaagagctgaagcagcctccagctgctgccaccttctgccagcagtgttagttccatgagggctgttctgcccatggatcattgatgatctgttgtcccctgcatgcacagaccagaaaccccacctccccacctgctgctgttaccctagttgacctcctgcctcactgggtggcagaatggacagccctgccatctgcttccctccccagagcaccaggcatggaacactggggatttatggggtcaccaggcagagctaggagggttttgcagtggtagggaactagcagtacacttgaacacatccatgggatcacagcaaggaggccaaatgagataggatagggattcaaaggagaaaaacagaaccacagaagtacacagctctcagatgaaagccacttaatcagcctcatcccattttccaaaattcagacaaatgcagagaaacactgggcttatttagcagtatctatactctaacacacacatacatgcacctgtgtgttaatctaattagacagcttttctagttctaaaggtgaaatgcacgaagagcaagttcttaggttattttctctttaagcaagggggactcttacatccaacacatgcaacagctatttagtaaaacaaacacatgttttcattctgcttcctgcttggagctccagaatggcctcatctggtcaaggaaggtctcggttctgccagcccattcgagaaggcaaatagcaatggtatagatggcatagagcaggatgtgagtcctataccttggattgccctggacagagggcctattgtctcctctatttttggaccaaatgggtgagaaacagcttatatcaagaatggcctggcacatgcctgtaagtccagtactttgggaggattgaacccaggagtttgagaccagcctgtgcaacatagagagacccatgtctaccaaaaaaaaaaaaaagaaaaaagaaagaaagagagaaagaaagaaagaaagaaaagaaaagaaaagaaaagaaagagaagaaaagaaaagagaagaaaagaaaagaaaaggaaaaagaatggcctggcaaataacccaaagtcctctcaaagctacattactataaacgagtcgcatgcttataattcaaaaataacatttgtgcctaaattcaaactaacacattttaatggaatggcaacatttttaggcctcaactcattctgggctcaaaataataactagaacttcatagcatttgcttgtggaacccatattccttgagcagtatctccctaggcaacagctccagtatatcctgcattagaggatatttcagatgagatgcacttgtgttgcctcagactactacggagtgactccgcagctgctgaagtgttgcctaattgaggatctactttagaaacgatgtgagtgtgatgggtaattggcacgttttcctgcttctgagagtaagctgtgcgctccttgggaggtgaaacccacttccttgtctcaccatggcttgaatgacataataggatttcagtatatgcaattgttgagtgaataaatgaataaagaaacatattagctgaattattgaaacaataagatcaagtaagcccacatagatttgttcaccttcttcacatgccccctgcctgccccaaccacacctcctttcctttgccttgtttgattttccaccaggctgcttattatactatcggacatgtaagcactttacttggaaatgtgtttattttcacatgctgtgtaaagtccaaagggcatggatttttatctcattcgctcaccgctctactcccaccacctagaactggtccctagcaagagttcactgagcattttgtgggggagttcattgtaagactctttaagaatcactctatctctaaacagaaatgatggaagatgtttttgttctgtgtatcaagggtctttatatatgtaaattaatcaaaaattaaggtgtatttgagggcgcttggtcttaaaaatgtaaccattccaccttgcactgttttcttacaaaaatctttgtaatttggccccaacataccatttgagctttattacatcatcttcttcattaccacaatcatcactaccatcactgttatcattcacaattacagaaaacatttaccaactgcctgctgagtacaaggcattttgaaaataggtgtttgggggccagaaaatgaatgggatgctgaggtctctgttctcaaactgcccatctaatgcaagcgttgagacatatttacacatgaaacatacactcagtgtcaaacaacgggttgaaccagttctgtctgacagaaatataataatgagagctatatagctaatttaaatttgtctattactcatattaaaaaatgaaaaataaacaagtaaagttaattttgatactattttgcataacccaatatatgtaatatattataatttcaacatgtatccaatatttttaaagttttattaatgagattatttttcttacttagttttggaacatgtatgacacagcacatctcaattcaggctagccatattcaagtgtctaacagccatatgtggctactggccacatattggaccctcagggttagactaaaggattttcagagtacagaggaggggacacatctcagcaggcacaggagtgtggagaaggtcccatgagaaaagcctctccccttccctccttttcctgctctttccttccccatcttcctcctcctcccgtcctcatccttatggaagcacaagcggtatagttgcaggggtaaataggtgtcccaagatgaaaacaaagggaaaccttgggcttacccactgagagtccctgttccacactgcctcttcttctctttctcctaggcacagccaaggaaggttaaatcccattccatcactaatgagagatctgcccacaagcactaaaataagattcctctgatcttaaaagaaaagtgtttttggactttaggcaaccctggggacttagagttgttctcaaccctagcatccatcagactcacctagagaaaattttaaaagtaaagatgccacaagtatacactcccagattctgatttaattggtctagagtgaggcctagggatgtttgcaccttttttaaaggctcctaggtgattctaatgtgtaactagacctgagaactgctgggctggggtgcagaaattgcagagtggaggagaggaaagagtggccagttggctatgatgccattaaccacagcactcagcatcactttatgtaccctttctcgttggatccatatgataaccctgtgtgacaggtaccactaacctcattttgcaagtgagaaaaccaaggctctaggaggttaagcaacttttccagggtcacacagttagcaactgggaaaggaagaaactcaagcccggtcaggtctgactccaagacccatgctcctcacttcatatcaccccttgtccctcctcttcatcaaccttgccctccatttccactccaccaatcttggttcaaggtgagaaactgggatgggaatgagaggatgaagaaaactaggtaagatgcagggacaggttgggaaaaaatagtaatgcatacagcagatgcagggggaagttgggaaaaaaatagtaatggacacagcagcaagggagaaacctccttcatagatggccagcatctcccagatatttttttaagtgctagatagattaagtgttgaaaggacacatgcaggggagggtgctgatattgactacgagacttgtttggcatcatgacaaggaagaagtgatgagaaaaggtgtcccagaaaattaaccattacctagcttccacagaggatcctgccctaaccaacagataggctagaaagaaggctacagaacagaagacaaagaataaaagagctgtacacaaagatatgttctttttctgaggtttcatacactgtgaaatttccaagtagtgaaaaattaactcaatgcttaaaaaaaaaaaagaagatgaatgcaaagaaagaaaaaaaaaagaaaaatctggcaatgttggaagagaaatcagtcttgcctgacagtatttaaattgaatgtctgtgagcatggcccacaatttttagtgaaagtagaagctattaaaaagtcgatgcacaagattaaaatttagaatgctattttaataataccaaattctactcaatttcaaatggctgtcatttttaagctccaccaatttgataacacttgactgatggcattgggagctgagtgatgggaagattgaattcggcaggtccagctcagctgacacagccagagagatgaatactcatcctcaaagaactaagcagaccaggctgatggacctcttagaatctgttttcccatctgtaaaatgggactaacaatatctgccctactgaaaggaacaagtgtgatggagggtgaatgaaccattgtcaaaagcattgtgaaggtcaagaatgcattgtgctcccgctgtgggtagagcctgtgctaggtcacaggtcacctctttctggaagcttcccacatctcccaattctaacttagagaatcaacaagtagttggactagtcagtgctgggatgagaacatgctcaggatgttccagaactcggagacaagtcatctgtcacgtcattagatccaccaccttgtaggactgggagtttgctctgtgtacctagcactgtgcctggtatacagtgagtggatcctcaataagtatttgtagttccctcattcaacaggatcttgtccctaatgttttgactttagatgggaagacaaatatttaccaagcataatataagtactgatgcagagaccatcagagcattacagaggaagaagaaacactaggccgggcatggtggctcatgcctgtaatcccagcactttgagaggcccaatgccaaggctaaggcaggcgggtcatttgaggtcgagttccagacctgcatgggcaacatagtgaaaccccttctctactaaaaaatacaaaaattagctgggtgtggtgctgcacacctgaaatcccagctactcgggaggttgaggcaggagactcgcttgagcccgagaggcggaggttgtagtgagccaagattgcaccactgcactccagcctgggtgacagagtgagactctgtgtcaaaaaaagaaaagaaacagaaaaatcatttcaactggatattgaaaaatcatttattataatcactgtggtcatgtttaatgctgttgacaaatatttcctgctcttcacatcctaggcatgcagcaggattacattaccctgcaccctctgaagttaggctaagccatgggtcctacactggccaatgaaacatcagcagaagtggcatatgtcccattttggcagaaactttaggagctgtgcagttctccatgttttcttcctgcagtatggcaaatggaaggacatgttaaaatgaagaatcttgggggaaaatggctccagaagcaggggtttcagtacaacctatacagaacatgaaggacaagcaagaaatacacctttgttgcagaatccgactgagatttgggggccatttgttattggcgcctctctttactaatacaatcatgtcaggaggagctccagcaaagtatctgtaagggaaggggtgagtgagcctgaaggctcttgagagtgaaaaggaaacaggactcaagcctctctttggtcacagactcagctaccttctttcggagatttcctccacagggatacactgaaaatgccactcaggtttcagaagcctctgagtgaggagccccagactcctgccttttatatacccatctcccgccctcatgccttctggaaatggtgctaagtatagctgggttggatccctggctcaattactacatcacaaccagagactgaggaataaacatgccagggtggggctttttctctttgcccgggatggctctgcctccatctctctcagctctcagcgaaaatcctcccctgcagccagaggcccttacagaccctaagcctctgctcctgctcttctccagcaggtgctgcctccccttctcatctctgcatctgtctgtcctgcagagctcagttcacaccccatctcctccagggaggaccactacagactccagcctattctgtgctcatcctacgagctttgaacccatctgacactcaaccatgccctgtcatcagaatagtgctagcttgttcatctgggcaggttggatctcttcaaaggagggaggaacccctaaatcttgatgatgtcatttgtgaaatgaggcccctgctctgaccactcagaactgccattgggcatcaggtgagttgtcagatctaaagcccctgtcttggtgccaaatacctaacaggtgctcaagaaatgtaagactcttctcaattccctttgtctacaagacagtttgacaaagtgggaccagctcttctcctcccacagtaagcccagatgcgtctctagagatgtgtctcatgcatgtattctcaatgggggcaaagtctcctccaggaaggcagacattgaaaagtgaaaaaacaacctttatgtataaacacagatacatacagagtacacacacagatatacagtgtatctgtggtattaaaatctcatggggagggggtaaggaagtgtttttttaatgcttagaaaagctccataggtatgcaataaaggaaaaaaaaaaggcaggctcttccatgcccatctcagctgagcctcttatcacttgtctcttatatttcctctcttgtgtctcttccaaatcaataaagtgatattttagaaaattctgccaaacccacatttctccctcctccaccgccttcccagcctctctgctcctgtgctcatctaatctgctgcctttcctgggatgtcagccttgcaattggctacagggaaagcaggcactggagagctgagagactccagtcttggttttccagacatagcagatgtgactgtgtttgtatctacccccagcaacaccatggggaagcagagctaggcactcctgcctcaccccacctccccaccacccagcttgactcagaatggtgcctcaagtcaaagacctgcctgcaactcccaagagaactaaatgtttccctccactaggggagggttactggtgggtttgggcttaggctggtttgttggaaggtggctgacactgcagtttggctcacccaaggtggagtccaaccttgcctgtcctcgaagatggaaagctgaataatcaccttccagcctcccttgcagctataggtggccacgccacatattctgcaggggaagatgtctgataaaaagcaggagggaacagcttaacctgatattgcccttcccccttttctttctaccttgaaatggacccaaagtctgaagctctccatctctcttgcagccatgagtgaaaagccaagggaatcctgacatcctacagacactatcttgacatgatgtagcagcagcactagtgccagaaacccctacatctagacttctacttgtaggaaaaactgcttttctctctgttacatgaagcccaaggaatcctaactaacacagaagtcaagagtgacaggcacagacacatgaaaaaatgctcatcatcactggccatcagagaaatgcaaatcaaaaccacaatgagataccatctcacaccagttagaatggtgatcattcaaaagtcaggaaacaacaggtgctggagaggatgtggagaaataggaacacttttacactgttggtgggactgtaaactagttcaaccattgtggaagacagtgtggcaattcttcaagcatctagaactagaaataccatttgacccagccatcccattactgtatatatacccaaaggattataaattatgctgctattaagacacatgcacatgtatgtttattgtggcactaatcacaatagcacggacttggaaccaacccaaacgtccatcaatgatagactggattaagaaaatgtgcacatatacaccatggaacactatgcagccataaaaaaaggatgagttcatgtcctttgtagggacatggatgaagctggaaaccgtcattctcagcaaactatcgcaaggacaaaaaccaaacactgcatgttctcactcataggtgggaattgaacaatgagaacacttggacacaggaaagggaacatcacacactggggcctgtcgtggggtcggggggagggggcagggatagcattaggagatatacctaatgtaaatgatgagttaatgggtgcagcacaccaacacggcacatgtatacatatgtaacaaacctgcatgttgtgcacatgtaccctagaacttaaagtataatttaaaaaatgccaaaaaaaaaaaaaagagtgacaggcataatccttacccatctgacttccctggagtctctttataaacacatctgtactacaaaacagaatgactagtgcttctcaatgtccagagtgcagggagactcagagatgctctgccatgctttaggtcccagggtcatggcctctctgcagggggttaagcacatgggctttgcactcaaattgacctggattctagtcctaactcctccacaaaagctgtgtgatcttagacacctcaccgttctgtatgtccgttgttttcactgtagaatgaagttgacaacagcacttatctcatagaattgttgcaaagattaaatgagatatatcacacactaatctcagtgcctggcacatactgtcttctcaatacgtgttagctgtcaagataattttccactttccctttctgggtctaagtccttctatgagcttgtctgtctcatttcccaattatttctcagtgttttctcatttccttatctctgtagctctttccttctcctttctctgtttctccatctctctgcatgtgtctccatttttgtctggctttttctccctcctccctcattcccattcaggtttacagtggagaaacacagcaatttgcctaattttccctctcccaggtcaagagaaagcccttcccaggctctcagtcacagttccttagacgtgggtcccccagatccccttgtgttctgaaatgcctgtgatgggaaggggaggggatggtgatgtggtctcctgccaggaaaagttgctgaaggttggggctggtgaagggggtagtgagagaggggcctgctgccctgcctcaggaatcacgtccacttcatgactggctttagcagctgagtctaaaagctttggaaggaaacgctgggtccaccactggctccattcctgcctccctttctggcctaccccaggattccttggcagaacttggaatttggtatagtcagggacaaactcttctctcagatgcttactgtcccaaatggaaagcaagacctaagtgcataatcctaacccaccatggacagacccctctggctccacagcacccaaaagacccctctggtgaggggagcaagtcaccaataataacccacaacacttgccctgcactgatgctgcttcaaaggcctttcctgtgccaacctactgacatccttgcagctgcaccaaggaacagactcctctttccccattttacaaatgtcatggcacatgggggctaagtgatatgttcaaggtcacacagttataaatagcaaagacatgttccaatctaagcaataacaacagcaataataacagcaacagcaaaataatattaagataattttaatgataaaaacacaatgtagcatttattatatgccaggcacatgcaagggctttgcatctattagctcattaaatctgacgcctaccctgtgagataactactatcattgtccccattttacaggtggaagggaaggtcaagggaaattcagtcatttgcccaaggcctcgataccataagagtgtggattcagggatgtgcatgctgcagtggccaaggcccacaatcttatgggacagctgaccacccaacccccagccagattcctacaagccccaggagtaaacactcccatgaagaatcagctcaagctcacctccaggctgagacaaagggtcaccaaggactggccaccacacgaatgcttctccttggtcttacaaaacatgaaaggtgctattatcagaagccatgcctgcttgcaaactacagaggtgacacgaggtaaattcatttccttcctgtcaagagaaactcaacaagggtataatcagaagctaatgtgtgtactgtgattgggcccatcacggggtggcacataattgaacaagttctccatgcctggaggagcagagccgagccccatcactgggaagtgtcactcatctggccagcacacattggtttttaataacattatggaaataatgctgcagggctgtggaaaggacagaagcttgaggggcagggcctcatcaggtctccgagagctttgaccttgagaaagaaccttctggccccatccagaatagccactttcctcagggatctctcctgtaggctttgtggatttatgtctcctgggcttaaggaacagggcttggtgtggctgaaccttcttgctgaatggatcccaggggaccccaggtgagcattgaggccgggttctcaagagactgaagggggtcggggggttaccagagagaggacaggccctttgcttccccagtaactgttgacaatggtaatacctccatggcccctactatgaatcagataattttctgaggactttatgtatattaactcatttaaactgaaaaacaatccatgtgataggtattgccattgtcctgattgtatagataaagaaattgaggcacagagaggtgaatttatctaagatcacacaggtgggaagttgtgtttgagcccgggcagtccatcatcctaaccatactccctactgcctcaatgagctgacacagcccagccctgataaagggggtggcagaggggagggggatgaggtgccttcctggctgttggcattcatttcattcacatttttatcaggcacccctttcaaccagatactgctgtaggcactgaggatacagtggagtataaatagataagagttatattctagcgaggagacacaaatcccatataaatgtacaaataagacaatttcagagaatgccaaatacaatcaagaaaataaaaccaagaggtcatagtgtccgtggcaggaaaaggtaagtaagttattttagagaggaggaaaaggtaactttaagaaccagagacaactgtttaggagaaggcctagccaagactgaataattcatgtgttaagaggttttcaatcacctaccaaatacaggaaggaaccagtcattgaggctattgagaagtcaagaagttagagacctatgaagacaaaggcagcctgggctctgctccacctgcccactcatgggcctaggcatcagaagctccgccatcttgcactgcaaccctggaagccacagtctcttcagtgccatcagggaagacagcaactgcaccaccacacacaggcatcccctgccccagcccagaagtgatgcacatcccttagtgcctcatgtcctgcctaacagtggatgctggaaatttacaggagcaactggaatattcataagcctaactgcctcggccaccagcccacaagggacactaatggagacagcagagttgcgtgagggctcacgagctaagaggtggaacccagccaggctgagtagaaagtaagccatcgacaagcagggagttaataggtttttccaaatgaacggtccttaatttcaattcattgagaggtgagggatcaggtgaaggaagcaaggtgaaaaggaggattaatccatccatcaaggaccttgggtactgaaaacatgaaaagatgaatgcatttgtgagacatactgattcactaccatgagaaataattatcttgaagcttatttggtcccagaatcaatctttatttaaccgtacttatttttggtggctcatcctgcttgcctctcttggaaactcaagaaatgctttctctatttttttttttgggtaaattccaaagacttgcatatttcatatttttcaacaggatgatctttgtgtagactgactgtcttccctcttcactagtcctctctatcattggacctcacccgtagtaatcactcactccacaatcatcttctcttgtttcctgcatcactcatcactaccttaaagtattatttattgatttattatttttttataatctgactcttctattgtaatataaggtgggtaaagacggagacctttcctgtctccgttggccacatccccaacaccacaccaatcaagcaacagactaaggacacagctaaataaatgaacaaaaagataataataacaatcatgtgttagtcttcataacaatcttcatttattctttttgattattcccatgttacaaatgaagaaatggaggcacagagaataattaagtaacttgctcaaggttatacagatattgtaaaacagccaggatttgaaaccagagagtttggctagaggttccatgctttgttggtataaatatttaagaaatatttgttgattgaatgaataataaataaatgaatggcttccttgtgtttcctgccttctttaccagggttatttgccttcaactttcactggaccctctatgtatcaggcatggtcttaaattctcttcacacattattcagttgagggtagtcccatctaccatatctccatagaatcggtcccaagcctggtacttagaactgccctgcattgtcaggctccccctttgccaggtggtgcctccctaatctgaaatcatggactgagtaccttcaaaagaaaaattaaaccaaagatcaggaggagatgcttctgacttagtgagtctagaagaccctggcctcccttgcccactctgcccagaaactgaatcccagagagatgaagttatgggtttcatacctgtgtctgcccatcaacccaagggggacaaatgccaacatagaatgacagagagggaaggaagaaagtgtttttcctaattaattggctctaaaagtggagaggaaccaagttgggttattatagaagcatcagcgtccgacacaggtcttcaactgccatgcaaataccccctactctgcaccatgcagttcccatggtttactctgttgtgatgtaactgtgcatgtttctacctgaacccattgaacacggctttgtgcttgaaccttgaacaatgcctgggacacagttggtgctcaataaataatgatgggataaatgaatgagggatccccattctcctacctaccttggccttgtcatcatctctcacttttgcgactgccagataacacctagctctatccccttgagccatccaagtctcagacacattcatatactgactgaccttgaatacatactcccttcctgaaagagatgcttcccaggaccctgcatcatggaaaataggaatatcatggtaaacgttgctttaattgaacagtggaatctatgctagtcttcatgacgaaccttgaaacacaagagtgctgcagtaaccatcattcctgaattgtggaacttcacagactcaggttagccccaagtgatgctttgctgagcaatttaaaacccagtcatgcaaagccaagtgctttcatgtttgagaaacaaaaacatttcaactgctcagcacatctaaatcagtactcccttaacaacccaccttggttcttccccttgattctgaaagccaatttagtaagaaaagcatattaataatcttgccctctcactggccttccctccctccctcctattccagcatcttgcagctggtaccttgggtcatttgttttgtttttgtcccttaggctgaagtgcgtccacagttttgaaactgctaactagagtttatatggaaaattcagattagaaacaaattcaaatgcactctctcattttcctgtaatacactgggtttcttcccccaatcagctagaagacttgctgggtacctcctcattgtgtcctgttggaaagtgtctcttctggtcaccttgactgttaaataagtaaacagactcattggggttgctgtgtcctgtgacattggcacagactctcaccccagccaagcatgcacatatcaatgggccaccatctgtggcagaattaccagacccaagatggaatttgatgcatctgtcctggtgaaatggcattatacttctgccatattcttctggttcaagaacattgtcctcaagcccaagggacagccctgtccagcataaacatgattaaaatgcccattgcccgactgccctgctgaccaagaaacatggccaagcacagagtctgcaagcagcctgcatgtgggtctaaagaagaggaagggggaaagtgtttccagaaagtaaggttgccaagatttgaatctcaatgtcacaatctggctttatgaccttgggtgagtcccttaatcccacagagcctcagtttccccatctgtaaaatgaagagtaccaatatcctgatgtgttgtgaggattacatgagatcattttcgtaaagcaccctagcacagagcctgatacagtgtcattgggagctaagatttaccagcactcatcatataccaggccttgtgcatgaaccccacctacattatgtcattaagcatcactgcatgcataagaaatgggtgttaccatccctatgttacaacagagaagactgatggtcagaaaagttaagtaacctgcacaaaggcaaggaggtagagacgagtgaacttaggattggaactcaggactctcttaaccacatgaagagaatccaagtggaaggtgcctcctaccaacgctgagatgaggttcgtgtctgtgggcccctgtctgaggctggttgacaagaagctttagagagacgcttggggatggcaggcttgcagccagaggccagggtttgactcctgtatgggctgtgtgaccaggggcctctttaccgctcgggtgtgcttcacctccttcctccataagacaaggacaactgcatcttccctgtaagactattgggaataaaacaatagggctttgtgacctttgacctaaggtaggattcttatactaccccatgctctatgacatgataagaagacagtaccaacactcagcacagtgttaaaagattccagcaaataataatggatactaacataataatagctaccatatatagaatacattatatttcagaaactgtactaaaaccttaattaaagcacttaatcctcaatgcaaccctgtgaagtagatgctttttattatccccttttacagatgaggaaactgaggcatgtaatgattaggtgacttgctcaaggtcacaaaactaagtgctgaaaacttgggattcacatggttgcatcaaaactttattgaaaggattggtcaatccaagtgaacaacacatctggactgtgccccatagaaacaagcattttagtttcactagaatcaccgggataaacagaggcaagctaacccctttactacaggacatctatggtctttaacttgtaaatacgaggaaaccatcaagagggagatagagtatgcagcctttcctgagctttgaggggcaacagtgtgctctgacatacgattcgagatgtaccaagtctgagtcatttaccctaaatagaacagccttccattggctgttggaaacacaaagtaaaacccaaagaagagagaaagcaaaagtgaagaggccattgtcctcgatcctttatcttttgttctctgattcagatcaggagaggtgtgtatgcctgcagacctggacacccgcaagccacatgctgaatgaaggcccacagaagtcccaaaaaaagatggaaccagggaaaggaggtcagcctggaacagtcctgggaagctgagacccagcccagaacctgctggaatcaatagtctttaacacaactgtgacattagcttgggctgctgggatccgtcttgaaagaagaagctttgtatatttctgctcttattccccacaggatccagaaatatatttctgtaattcttttagctgataagtatgaaaaacagaattttaaatattccagtagggacctgacagaacagggccatcttcattagctgctgaatttcccaatgactcctagaaattgacacaattagacaaaattaagtgcttctgtcctgaggataggccgccactgttctttagggcatatctttgcaaaggaaggtgctggaattcctcacaaaagccacatccctctctctctcacactctttctctgagcaaatctaaaatctagtgccaaattccttggagctaattctaaaaccaggaaagctttttgtaagattataaagattgtattggactttgaagatgagtccctttgctcagcaacttactttcttaatgcaatccctgaattctccttgctatgctctgaatgtttatgcctgcccacccccaattcatacgttgaaacctcatcaccaatgtaattatattaagagatgaagcctttgggaggtgataacgtcatggagacagagctctcatgaatgagattcatgcccttataaaagagcctccagagagctgccttgccccttccaccatgtgaggacacagcaagaaagtgccatctatgaaccagacagcgggccctcaccagacaccaaatctgctggtgtcttgaccttgaactttccagcctccagaactgtgagaaataaatgtgcttatcagccccccaagtttatggtatcttgttacagcaggccaaacagactaagacattcctccatcctcccatcgactgggcaaaaggataatattacttccatttctatggtgattatggaaactcagacccagcaagtggctcccaacccactgggtgagtaagcagggaaactgaggttaggaaatgaactcagttccttttctccccatcatcttttctcccctataagaaacttatcagcagttcttttgcatgtagagtcaatcagaaaatcattagccaaggtcagacaagaaaccacagctttggtttctttgatttcaaggttagaataagagcaatggaactttaaagagcatggatggtagtaactgtctctgagaagccagccactcaaactttccaggcccagaatcaacatttatttggaaaaactttttgttgtccatttttttaaagagctctaaacttccagtgagtcttatgtagatctatttatatgcccatttcttcttttattttttgagacagagtctcgctctgtcacccagcctggagtatagtggtacgatctcggcttggctcaccgcaacctctgcctcccaggctcaagcgattctcctgcttcagcctcccgagtagctgggactacaggcgcctgccaccacacccggctaatttttgtatttttaatagagatggggtttcaccatgttggccaggccagtcacaaactcctcacctcaggtgatccaccagccacggcctcccaaagtgctgggattataagcatgatccactgtgcccagcctacatgcccatttcataggcaagaatactgatgcatagggcacaccacactttacaggcacaagaatgaacaagtctttagagggtaactatttcttgtgcaagaatcaaatgcaactgctgacacttacagttttatcactggtgacagcatgagtggctgagtgagcaggatgaatcttgagcctggggtgtagaccagagcaggggcttccaggtgctcacacctctggaaagcaagaggaactggaacagttggagttcagaataggctaaaaaatctcctgccagtcttcacagcagaatctctgagtggagcacacagccattttgaagttggcctacttggatgccagggctcaaaaattctaatgtggccaaagaaaccttcagagaactacagcaaattcaactgataaatttgttctactctagaaaagacactgccaaaattccagtccctatctatcagggaccttggataagtcccttcccctgcatgcatatcatcacagaccatcctcatatgggggtggggagggtgtctctctcccctcttcagctgccttcctacctccaggggtgcaccaattcactgtgatgacctcacaatcatgcctggtgattatgaggacttagtgggatgatgctctgggcaaccacagggattgctcaccggtgactcagtggttgactcaaaggctagagggtggtttgggggtggaggcagaggtccagtgagctgggctccaccctttctctccctgcagtcccaactccatttttatctgtgctatatgttggagtctagccaagatgtcatttgaacaaagattctgaaagatcaaagaaaaaagtttgaaaaccaccaggacaatgctttcaggggactttatccaaaagactgcaacaatgtaaagagatacgattgcttttattactgtgatatgtttaaagtattataaattttttaagagctttgtaagtgacagaagtgaagacatgctcattttaatgttaccagtcaactctgagaagactaaaggtcaagggacaatgaaaatgtgacccttaccaacgacagaaactcccaggaagccacaattaactcaagaccaccaggatatttggggaagtttatccttctggaaaccagaatttctgatttgtggaaaattctatagatattctctgccagactccagcctatttggtaagctggccacagatgatttagaacacaatgaccctgatactcactagagctctgagtgtggctggataagcccatttcagcagcatgtcagcccctccctgaactaggctctgtcactcagatctcagatcttagggcagctgtagtctgccccttgctttcttattaccccagataaccaatgttatcctctgtttttccttcctcccagggggaaaagaattcagaaccctagtctgagtatatgaattagactctgcaaattgtttatatgagtcattctcaaaactaggtctggagggtccccaagagatccacaaatttcttgcaatattcatgtaacaatgttcatctctttagatctattaccattgagtaacccattgatatttaacaacaaaacaacagcaaacaccatcctgatagctttaaaagcaaccctgttcttctaattgtttctagtgcatgctttttgaagctaaactagtagactggattgtcctcaagtagactggctcaccaaaggtgtccacaacaagaacatttcaagttcagattggacaggaatatttatgagggtttgaccagtgctagacttgccagacaatgtgcctgaatagtctccctgaacttctctcttaaacacaaacaagatcctatgctggctttctggccacacctgtgccagccacaaatgggctaaaacacgtgaaatgtgctgtccgcgtgcagggttcaaatcagataacaaaatacacattgacggttctctatagaatgaaaaatatcctactttcattgcatgctggtgttgggtcagaaaacaacagtttcttatttctcctggttagtggtcctttggaaatcacagaggaaatacatgcagagagttaagaggactacttcacatctgttgtcccgtgatgctacttaactgaacactacactcatgtgcccattcccgttccctttcccctttatggtaaatgttgtcccatatgactttgtgattgatggaaatgttctctatctgtgctgcccaatatggtagccactaaccacacatggctattgagtactcaaaaggtggctaatgcaaagagaaactgaacctgtaatttcatttaaacttaaacaaccactcgtgtctagtggctaccatataaaacagtgaactaagtctaaaatttaggatcttgcagtacagggtgtgtgtgtgtgtgtgtgtgtgtgtgtttgtgtgtgtgtgttaacaaaacaaacactgctccttctgtagtgagcactggcctatggccagggtctaaggaatatgcaaaagaaagtgactggaagttttaagcttttaaggttttatcaaaagacatttcttaccactccctctgggcagtactgtagaacatctactagggagaggatgatatgaagatagagaagcaacaaaagtacagacacattagaggcaaaatatagatgccaccttgtaaactggttgataattcagaaaatgacagctctccccgacttagttggaaaggcaaaggccaaatgggaaacatcagtctcttcacgtccatggaagacaatcccctgaatgcaaaattagaacttggtggctatttcctgatccagccccttgtatttttcatgaagcttaaaggagattaatgggacaatcaggatattacagatgagaagcacaggcatttcaaatgaggctgtgacaaatggctgggaggcctttagaatgggggaagagaggatgtggaacaagccctggactgggaagctcctcactatgattcacaccctggtcctgctaatgaccacctggccaggagaccctggagaggcatccaacccttccctgagagccactggacagaggaataggagccccatcactgagtggttgtagggctcaagaaggatcatattggcagcaagaactccagaaactataaagctctatttagatgaatcacattattattaaacagttcaatcaacataataattattaataatagctaagatttattcagtgtctgctattgccagacaatatatatgcaaagtctctagggcttacagcaaccctataagatatgtctatctatccacatcattcgtgcttactagatgctgttacaagtgttttccatatatatgaaggtatatataatatatacatatataatgcataaaatttgtaaatgagttaaatgaggattaatccttacaacaacctataatgtggacattacttgtatcaatattttacagatgaaacaattgaggccaaagagataaagtgacagccaccatcatcccaactaagttggaaggccaaatgacaaaaggaaacataagaacgcaattacctgaatgacagattagaactcagggattatttcttgatccaggcttagtcaatggaagagctgggacatgaacgcaggcacagttggtgaacagtagagccaggattcagactcaggcagcctggctacagggcctgttttcttcaaccccatggcatcctgcctctttttttgggggggggggtggtgggggtggaggggtggggatggagtcttgttctgtcacccaggctggagttcagtgagtggtgcaatctcggctaactgcaacctccgcctcctgggttcaagcgattctcctgcctcagcctcccaagtagctgggactacagatgcgtgccaccacacccagctaatttttgtatttttagtagagacagggtttcaccatgttggccatgatggcacgatggtctcgatctcttgacctcgtgatctgcctgcctcagcatcccaaagtgctgaaagtgacagggtaaggatttgaaactcaggcctgcctgcctgtctccaaccactcagtcttttcttcagccaccctgcgtccgttacaattcacacactgtttgtcaccactggctaatggctttggatatttcttcctcttatcagtgtgagacatctggggaggctcccctttttttcaccatttgaggactgaaagtaaatttagcttcctcagcagaaagaaaagaagctgttttggaggttgggaagagctttagaaaatgcggcatcacgtctgttgccccatttgaagaaagcagctctggaaaaggcctaggacattagttgctacaaagttctagatcattctgtgtggtaagtatgccatcatgcccatagcactcttctctgtccacaaaattcgtcatatactaataaagaatgggtgtctttggacaaagtcaaagcaagtttgtccagagtactaactaagaagagactacagagggaagcaaaaggtagttcagtggctgaattatccaaggaaaggcctagaatttgagttgtcatagactgagcatcaaagattatgtcttggagctatatagaacctttactgcccaaaaaagagagactatggaaacttcagtgctctggtaaacatttctttgatgccttaccaaaacatatgccttctgagcatttgatatggtttggctctgtgtccccacccaaatctcatcttgaattgtattcccataattcccacgtattgtgggagggattccgtgggagataatctgaatcacggggtggtttcccccatactgttctcgtggtagcgaataaatctcatgagatctgatggttttatcaggggtttccacttttgcatcctcctcatttttatcttgctgctgtcaggtaaagaagtgcctttcacctcccactgtgattctgaggcctccccagccatgtggaactgtaagtccaatttaacctctttttcttcacagtctcaggtatgtctttatcagcagtgtgaaaacggactaatatagcatccgttgtccacttcctccttccatcagtctgcaaaattccatttggggatccatgtggcttcagggaaatcaactttatcaatgttctctgttccgtggcagcagtgatgggttcagggatgggcatgtgacctaagccagtccaatcagagtgactctcaggtcttgctgaaagtgcctggaaacgatgccatttccttcctgttgggcatgatgaaggaagcatctagccccaggagctccttcagtcatattagggcctaaaaggtgccagcctttgataaagacaccaaaggatatgaaagatagcataagacagaacggagagatggaaagaagccagatccttggtgatattgttgagccaacagatcaagtttggccttaagtcagccctaattctgtgcttttcaattagataagacaatacatgccctttattatttaagcctatttgtgttaggagttctagtctttgcaaatgaaagcacctaactaatactaatgtagatctctgtggccatccttctggtaaaaggagaaggcagagtcaagggtgacattacatttcctgaaactggcagctccatctcatagaaaactcacgcattactcagtgaaaaaacgaccccctgtacacaatatccacgtgggaaactcctactcactcatcaagacccatctctaatgtcccttctgtctcctagactacatttacgtaaaattaatcacttccttctgttttacttccatagaggcatattactcattcttttatgtaactataaacacagagcaattacatacagctcaagggcagagaatgtcttattcatccctaaatgcatcaaacccagcacaagcacatagatgctggattctccaggttgcatggcctttaacaagttctctaccattctgaccctgttttctctcctgtaaaatagggctaattgtatatgtcagaggattgttgtgaaaaatatcaataacggaagctacaggaatttcactaaaatgtgtttaattatagtaaaattaaattgatacataattttgtaaatcttcaatagtctttagctcaatattgatagccaaaaattaagcctggaggatagaaataacttcttaactctacagttggaaaagtgtgggcatagaacttgtctttgccttctagatcaggtctgtgttggtaaattagacaccgtgtggcctttcaacatccaggagcaagatggcaggagaatcatgccaacaactgaggtaccttgcaggaaatcaaacaggaagaaatcacccaatgggatcagctgggcaaacatgggtcaccccaggtctggtccctcaagtctacccaaccaaaccatatcatagtggatagctattatctttacctgactagcattcattgccccttctggtatgccctattccccactctcaatccctctgttttaagaatgcgcccacctccaccttccatctccaggagtgatatccacccaggtttgctcagtaagactatgagacctatcttcctggctgtggtgattggttcagaagcaacatgccaaccaacctgatccaatgagagtgagttctaggacttttgctggaactactgtatgtctatatataaaagagaatctatctttctattgaaagccaaaggtaagaagccaatatgatatgcatttgattctgttacggaaatccacataaaagaaggctgcccaagtataaaaccaacacagaagaaagcagaggtaagagatggaaaaagaaatgagtgaaccagtgacagcaagagactgaagaacatcatttgattgcctggaatcagctaagcctgaagagaagcctaaccctaagcttttcagttacccaagccatcaaattcccatccccatttttttggttcttaagcagcttgaaccatagttgtctcacttgcatgcaagagatccctgaagatacatgcagttcctcaggtgaagattgccatcagttaacagatcctggcacccatggaccctgggacagtcattctggtagcatcctctggtagagaataacatagtcaaatctgacagtcagagagtatctgccagcctctgcttagatatagcccactgaaagggagagatgattaatttagccttgatttcaaaaccttgtcttgtatattccattcagcactttttatcttcctgtattcccctggttcctctctagctgaataaagaacaatttttaaagcaaacatcttcactgtgtatctagcaaagctttctgcttcattggaatatgtgatttatttaaaaaattaaatttcccatgagacgcaataatttaaattaagagaaaagcttgtctttcttaaacttcagtttctacatacaaattgatgttttatagattccagaaactttcactgttatgaagatggctctcagttttcctgctggattcagattctcttcatgacttaaaacaacatgaggaggatgagtcacaactgtaagctggtgaaatgcagaaagaaccacctaggaattcaaatgtcagcttaagaaagacagaatggcttaaaaatcaaagatgagatgaagtggactgggggtctcgggaacaccaagtcacaaaatcagcttacagtcagagggaacttgcaaatgatctgattcaagatacaaagaaaggttttagttcttgaggactttttccagataaatatttgagccaaagcacaatataagaaaaagatgcaagtggaacagctccttcaagcagtgggggatgttaaggaaaagcagggaaaatcagctgagaatcctccgtcccacccccaagactcctgcaacctagctgagagccacagaactggtcctctctctccggctgttctccaacatcccagagccttaggtggggctacactaagaggaagtcctccaaggaaactctcaggattagaccagtctttttctgctagtggtctttgataagcctacatggtaaagagtgggattcactgacttatctgtagtagatattattaaatatgtctcaaagcatctcccccaccttctcacacccacccattagaacaggatgttatctacaggctgatacctccccactccctccacctcccttctaatacatggcaccaagacactgcctaggacctaacaagtgattggcccctccttctccaagacattcccctcttcctttttctcttttaagcccagagggcctgaccctctaacgcctgtcccagaccactctctccctccaggagcctgccaagttgaacacaaagtcctaccacccctgccctcaacacagacttctccaaaacaagtccacaaacaccattcaggatgattcctgctaagacccacagggtgggagtgataaaatttccagtaacatctaccatgatattacttacaatcctaaaagaggaaatgttctgtattacataaaacatgtccaaggtcctcctacaagtacgagtgaatccgtgcctggttcttctttgtcttcggatcctgccacctcatccctgtcgtcatctgtctaagttttgctttagaagccaccctcggtcaaaccttcactctcttacacaatgagctgggcatcctcagtttccccttcatgctaaaagtaagccccatgttttgtgcatgtgcccacaccatttcctcaagttcttgctcctaaaggtaacagggcctgggtaaggcacttcctgcagagatcaaaggagactcgttcacacccaggaggaggaatattcttcctgttctaccccatttaaccctgtcccctcaacccagaggtgtcctcactgtccagcaagtgcttcaggcctgcagttctgctgttaccctattttgaatctcataggtgtggaagcatgtgttggcggggaggggcaggaaggtttgtccgccaggaagaagaaacgagtgtgtcggtatgtgtgtgtgagcgccgcaatgacagtgctgccaccgctgctgctgcatgtgctgggtctttgaatgtggcatctgtcgggctcagtgaggatgacagatgtctctctgctttatgaacaaacaacacaggcctgtggggtgacaaaaacagcctcagcccaaccagagcggagaggtgcagttctctgggaataatcagaagacagcagcgtaggagtccagagtctaccacacacctgctcccctaaaaaagcatgttctcattatgaaaccttagaaggcagctcccacgccagggacaagtataagggagcctgtgtggcctcattcattaccagatgaaccactcattcagggaagtcttgaggcatgtccaggaaatggcgccccaaagacccagttaacccacagggtgagtgcccacggagatgggagctctgggggtgacactgttgagccagtggatcaagcttcaccctgagtcaaccctaattctgtgtttttcaaataaataagccaatcaattttcctgttcatttctgtatccccagcacctagaacagtgcctggcacacagtaggtgcccagtggacattcgctgaaagaacaaacgaatgccaaggcagaaaatgggggtgagaggcaaagatgtataaaaaaagaactaagcagagcaaagcgataagaagaatattaataatatgaaccacaaagacaggaaagtcatctgatttcaatacacaagagtataaactcattatggatgctgaattacactagtgatagtttaaatatttcttggaactgaatatgcacataagaagagcccatcccaggcttgaatgagtgcacattcttgtcttggagaaaaggaagaaaaatatataaagcaataggtacaatacaatgcaacagatgttctagaacaaaggcctggagctatgattccagggcagcctgcaaagatctcccagtggagctgatgattagcaggccttgaagcaaggatggaagcctggcaagaggcaggtcagtcatcacaggcagggatgacagcttccaagaactatgtcgtctgtgagcccaggggccagagagctgctgggtttcccagtctttccaggctatggccaaactgatgaagccatccttgtttcagtctctgattccttcagagaagaagaaagagttgagtctagcagagtctcactctgcctggacgcctgctgtaccaggagagcactccctccacatgccactctaaacagaaatactccccggagcacctgggacgaccggcatcctctgcacttccaaggccttcactcttcccagttttgcttacttcttctcatcttcccattcacttcccagatgtgtttctcgggtctccaaagggaaactcaggggagaaactgagtcaagctactttaaatctcctttcctacctggccctttccacagcactcagcccagaagaggtgctctgggtgaaacaaagcagcagtcggaatctctgcaggccacagggagggagggacgggtagaatcaaggagtggggcactagcacggaggcctgagcctcctcactgccaggatgagggagccgcaatgatctggggtactggcagctctgggagcctctgaatagtgaccctggggctctcagaagtactaggtcaaggtgtcccggtgggcacagctgggcttagtcatcaagacatgggtacaaacctcagctcagtcaccatccagctgtttgagtctgaaagttacttaatctctctaagcacagatgttctcatctatgaaaggactataatgcttgtcttgcggggatgttgttagaattacatgtgatgaggtctaaattgctcctagtacagaataggcaattggtaactcttaactactattagtgtagtattatcatgatcgtcatcgtcatcatcatcatcattggggcagacaaatctcagaccaggcctgagaattcccaactctgaattcagagccttttgctccagcaacagaaatgagaaggtaaggcctaaagtagaacaagactagaggaggccctgaacagtgctgggcgcccaaacagggacttcctcccaggaggcctctgtgccactggcctggggtctcatcatcaccgccagcaacagggtgactggctgccccctggattttctgcaagcaaagaacaggagggcagagcagaaaagcccgggaactaatgagattcagagagctcgaaaattagaggtgcacgaaaggagtttccgcctaattgctctgacacctcccactcccactgccgagtcactgcaaggagcaggcgagtgcaggagcaagaggggatccataggtctgctggtccaggtcactgctctctccaggagcactggctccagttgggagtggcccagggcctttctgcggcctggcaggacagggtggccactgcccgtggctggcccagaagagtccaccttgtgggtcaagagctgcccaggctgatatgtgccttaaaaagcgggaacgaaagcaaggcagcacacagcaagcccaggcacctcctcagccttgcaaatgggagctggtgatatgggctcaggaactgccatttctgacccagcccagacaaatgtggcccaattctctgttcccttggagctgagcccatttgtagccatgccaggcccagggtctccctcagtggctgctggcagttgatagcagctgtccttagagcctcagctgcctctcctgcgctgtgtcctccctaaggggcttccagatcggttgtctcacgcgaggctcccagcaggctggaggagggcaggctggcaaggcagccacactgcccctgcatcacagaggagaggagggtggcccactgacaggccagaggcaaactgagacccttccgatccattgtcccttccctgcacccccaagaacaatgacttagccccaggacacatccttaagaagagggcatccctaaataccaccagcccccaccccctatccccccccaccccccccaccccacacacacacacacacgatgctgggataggctgtgagacaatatggaaacagccagaaagatttgcattcaaatccaggttgtgtcacttcctgcccatatgtctttgggtgctttatgtaacccctctgagcctcaactgctccatccataaagcggagcatgactgggagggataaatggaatggcaagaggaaaacacagtgcccagaggacagcaggctttcaataaatgtgaaatgctctcagcatggccctgcctgacgtcctgcctcagaccccgccgtccagctcacaggacaagccacagccttgtaggacactagaattgctgccagtctgccttcagttccctttgttgtttaggagtctcccctggactatcagcttataagaagacatgtatccatcacaagggcctctgataaatctcttcacggaccgcttgcttatatcaagaggcagaacatttagaaaagacatagtgcctgctgctgtctgggccaagccatcccacaagcaggctgaagtgtgagagaggcagatacattccctttcaaaatgtctatggtcccctggtccatgatataataggagagatgcacagctggcttagcttgcgccgtctcccaatgcggacaggcacctgggagagccaagatcgttagccctccaggcaaaccattcaagtcctcgtgctgtcaaggtgacttacaatattgagagtagtttgagattgttaagaattattattattttttttttctgaaaaatacacagtgagtttctcaactccagtttactccagctaacaccacagctttactgttcctcttccaatcaatagtggaatgaaatgatccagttggaattccagttcaggccacagagctgacatcttctggattcccactcctggggattctcagacccaaaggcaaaatgggccctggtcatgggaaagtccatggctttagatgggcagaatctgcagccactgaggctgcagcacacagcagggaccaaagccaggaacagccaaggacactcaatgccactcctgccttatgccagccctcagggtgagtgcataagctcttcccataaaaatggcatttgcacccttagtaaccttttattcaattcaacttcatctagtcctagtaaatagaattacattacttccttgcttaaaacacttccatggtgcctatgcaaaaatgtaaaatactttctctggcacacaaagcccacatgctcttgccctcctctccagcctccttcatgccagtcactggcttggccatccaattcagactccctggcttcacttctccttccttgactgtgcgtagctctttcttgctttgtagtgagacatacactcctccccgtctttgtccagttaattcctgctcccttttctggtctcagctcaaatgttgcctcctcaagaaaaactcccctgactgcttcccagtacaatttattcccactcctgcccccttctctcctatagttccctgttctttttaaaatggacttgtcaatatgcatgacgatatgtttttgtgtttattgtcctcgctctctgaccatgtaaactctatgaagccagagagaatatcttattctctcgaccagtttgcacaatgcctgacacctagcagatcctcaacaacctttgttgaataaatgtgtccatttattcagttctccaatgtctgacttcattcaatcacttataattaaaatgccaatttttataatctccatgaaccataaattaagaaatcactgtgcggccgggcgcagtggctcacacctgtaatcccagcactttgggaggtcaaggtgggcggactacctgagatcaggagttcaagaccagcctggccaacatagcaaaaccctgtctctactaaaaatacaaaaattagccaggtatggtggtgtgtgcctgtagtctcagctacttgggaggctgaggcaggacaatctcttgaaccccagaggcagaggctgcagtgagccaagatcgtgccactgcactccagcttgggtaacagagcaaagctccatctcaaaaaaaagaaagaaaaaagaaaagaaaaaaagagaaagaaaacactgtcttccaagctgtgactggaggcttacattaactcatttatatttgtagttagtaacatcaccatttttaaatgagtgaaccctgaccccaagaagctaagtaaccttataagtcatagaatcagtaagtggcaaaaccataattgaaacctctggctcataacttctcacttttcctaccaaatgacacaagtggctacaacctgagtggccaggcctgaatgggtagccagtctagaactgccttggtccccagccccacagcacctgggacaagacccagagtggcatcctcctcctccacagcagaggagactacttaggcaatgagatgaaattggcacgtttacctgcctctgattaaacagagtttttactggacagcagttgttgaaataatttgggctataaataaataggaaccgggctagaatctgaacctgcttacaaagctagtccttttccatttgagtcataacaaatccaatccactcggggaaaaattaggaaacaagggggaaaagctttcagtttctgtagcattttaatgaaggattgattgaggttttatgcagcaagaagggcacagctggggagtaattgccaagaaaattgaggtgcaagagccatttacatagaagaatcaactaaggttcctcaccagtgctcaactgaaagcagtagcaattggaccaaatgacaagcatcacaatctcactctctagcaccccaccctaggaaacaaagccaccttgtcactgtctccttcaaaagtaccacaacccaacccaagacaggcaatggcaattcatgtgcatcctccactcccaagccttcagcaacctagatactttgtctggggaccttctgaagaggaggctttagttgacttcttcaagatcacttactaccatagacgatggctaaagcaggactgaattccagatgttatgatcctagagagtctctcaatcaatggtagaactctcatgcacaatcttctttggttgggggcagaggaggggtaacttggagcaggtgatagtgtggctcccgacaggctagccactttacaaggattcaccttctgtcccttcactatgtatcagaagctacactttatggccacgttttgtttcctcttttcttcctcttcctctttactgtacctccatccatccttttatagtgccgctttcaccttggtgtgtgaacttgccgctgacttcccaaatgagttctgagaaccgatttcctgtgctttgtgctctgtgatggttcagcccactcatcacacctctcatggagatctctggcactttggtgggccctacttagaaaccatcttcctccttgatccttcactaacaagttctataatcttaacctcccagggtctcagttatactacctgcaagatgggcagaagaattccagcctagatccccacacaaatgtaggaaatccaaagacaataatatataagggcttggagaaaagaataaaactcagactgcagtgaggtgaataattcagtgcatcctccttatgcagctggagttaattccaaggaagcactttgcaaattctcaggtactatgcatgttctttctttctttctttttcttttcttctctctctctctctttctctttctttctttcttccttcctttctttctatttttgagatcacgtttctgtcttgtcacccatgctggagtgcaatggcacgatctcagctcactgccacctccgcctcccaggttcaagtaattctcctgtctcagcccctggagtagttgagattacaggtgcctgccaccatgcccagctaatttttgtatctttattagagacagggtttcaccttgttgaccaggctggtctcaaactcctgaccttaggtgatccgcccacctcagcctcccaaagtgctgggattacaggcatgagccaccacgcccggccacatgtgctttttaacatttttattatttcatttttggagtcattattatttttgttacaccacacaaattgcaataacattaagagattgagatgatgatggtatgagggtggtgttggtgatgacagtgatgatgacagcaatgttgctgatgttccatagtggtaatggtgaagatgatggtgatactggggagatatgatggtggtggtgatggaagtgatgcttacattacaagtccactctacacacacatgttctttacaaatgtggatgaaccctatctcctgcatggagtgggcagcacagattgtggaggaagctgttttccttccctggcatcttctgttcttggaaatcaatgaatgtccttcattattttccccatagttcctaagaggatactttcctgcttctgaaacattcactatttctataaagtcagtttgtcttcattctgtaagctcctcagcaaccctcactatttgccatgatgctggtcaccgggcctacaagacatagatcttgtctttgaaaagcctgtgttcctagggagagaaacatctgaaaagtgaaagaacatgagagcaaaatagcatgcatactgcattagaaggtgcaccctcattccgcacgggtgtgtcagggactggcagggtcggggatggcttccctgggaaggtgcctttcaagctggccagtgactaaggggtcactcatcctccagggaatgggtggatagagagcactctaggccacaaacaaagcagagaatatacactgctgtagggtatgatctgagggatatgggagatttcaggggaaagagcttactttaagttttttgaagtgataaaatatttgaattttatcttggaagaactatggatccgttaaaggtctctcagcgtaggaatgaaatgagctgaatctgcatgttacgatgtttcctctgtagagcctaaccccctccacttgtgttcccaagagccccagcatcactcaggagcttataagaaatgcagagtcccaggccccattgctaaacctcttgaataagaatctgcacttttcaaaagtttcattttctaaattactatacagtaaatttaattttttatttttggtgtaaagttctacgaatgttagtatatgtgtcaatttgtatagccaccaccataatcaagatacagaacaactctgccccaaaaactatcttgcattatcctttatgatcacacctatcacccctacccactaataaccactaatctgtcctctgtcactacagttttacctatccaaggaagtaacataaatgaaattgatataatatgtaacctattaacgctggcttttttaattgagcaaaatgttgttgagattcatccaagttgttgcttttatcaatagttcattcttttttgctactgcatgtattcatggtaaggatgtatcacagttgttttagccattcacccactgagattcttcctagttttgggtaattatgaatagagatgctacaaacatgtatatgaatgttttttctgtaaacttaagttttcatttccctagggtaaatatctagacattgaatttctggtaatatgctaagtatatgcttaattttataagaaaacttctaaactgttttcctgaatagcaacattgttttgcattcccattagtaatgtctgagagttccagttgccccccatcctcatcactacttggtattgttggtatttttatttcagccattataataggtgtgttcacatctcatcattgcttacacttgcatttccctaatggctaaagatgctgatgttctttttctgagcttatttgccatccaaatatcctctttgatcatgtgtctattcaagtcttttgcccattttccagttgggtagcttgttctcttcctgttgaattttgagagttctttatatatcctggctataaagccttctgtaatatatgtgatttttaagtattctctcccattatgtagcttatcttttcattctcataatagtatctttcacagaataatagtttctaattttgacgtgtctaagtgatccatttttcttttgtgaatcatctttttggggtcatgtctaacttacctaagttcagatcagaaagattttctcctatgtgtttttatcaaagctttatagttttacacttatatctgtgatccactttgagtcaatttttgtataagacatgaagtttaggttgagctttttgttttgttttgtttcatttgcccttggatgtccaattgttccaagaccattgtagaaaagactccttctccattgaattgtctttgtacctctatcaaagcaattgaccatatttgttgtaggtctatttttggactctagtctactccattgatctatgtgtctatccctttgccaatatgacactgtcttgattactatagctttatagcaagtgttaaaatcaggtagggcgattggtgatttcttcaaatatacacttctttttcaaaattattttacctattctagttgctttgccttttcacataaattttagaaattggtttgtttatatctgcaaacagtcctgcttagattttggttggagttacattaaatctgtagagaaatctgggggtgagctggcaccattactaggatgagtcttccagtccatgaacatggtatgtcttgccatttctctaggtcctcagaatctgcatcttaacaagaatcccaggtaatttccctgtacattagagtctgggaagcacagctctagagtggaaatgacagtgaagtcatctgggaggatttacaaaatatggaagcctagacctcactcagaccaactgaataagaatctctgaagggggacctaggtgctggaattttttctatgtcttgtaggtgattctaactggcagccatgtgtgaacctctactctaaacccagtctgggctcttgtggctctggccctatgctcattaaatcaatctgattaaggccatcagttcattccttttcaaccctagatgtatattggaatcctttgaggatagaggttacttcaatgagaattttcaagaaaaaattctagttgacagattcaccaaacttcctctgaggccccacctatatttgaggattacctttccctgcccaaccccaggagctagaacaacattccagaagttttaactctcaactctaaaaacctgctctctttttggaagtctctctacaagttactgaggcaggaggagacagaggagagagggaacatgtgtgcacacaagagaaatgtccaattgaatgagtctgatcaataagatctatgactcaaaaatacttgcttcatggcaagggaacatcttttgctttcatatccatctcacatacctgctgagtcaaggaaacagctccatatttaggagaaaaatcctcttctaatctctaaatgcaatcgaaggttttctatgtctttttctgtggctccttggaaatgttaaaggcatgtctcagctacagcaaggtggggcatgacatattgccccccaaaatatgaaccaattgaatgtcgtctgaagtcagctctgtttctgttatcttttaatggattttaggtaaagaagtgttgatgtagataaaatagatataaaaccaaattcttctgctttggatgtgcaccaaccccagcaggctaaaaatagattcaactgcatcaataatatttctctttaaagttgcaggtcctttgggggtttggaaacattcagagaggataaaaggggagaaagatatgaaaacagcagaagctgcagtctaagcctccaggtgggggccttggggacagccatgctggaatgcctgatttttacatgtccaagtacctatttcctaccaaaaaaaaagcccttccacatatgataagaacacatcttttcttgcagggctgtcaagttcattctaaacacccctgccgctgcctgtttgagattgatgcctctccaatctctagctctttgtttgaaattaaacatccaaagacctttagaataaaaaaagtcaacatacaaatgaaatgcatttcaacatgcatctcaactgcagaaccacagcatgttgagactggaccaagcaaaccctgaagaagtttcccctcttgctcctctgtggtagatgacctatccaagttcacacaacaggtaacatggagcatgtggagagactcagcataggccagtgcagtagcggggtctactggaaaagacttggcctttgaagtctcattccaatcccagccttgcattgaccaactctgtgaccttgaccttgaaaaagtagagtcacagtgccctctacttcacagggttgtttggagaattactgaaaatgtgcacaaaatacctgatacacagtggggcactcagctaacaccagtcattcctgtaatccaggtctcccaacttctagtccagtgctctttgcacaacaacaccatatgaagactctgagctatccaaataagtgcacttgaaccacaggttaaatccccttcctctcatcagaaatacaggctagcaccgcccagcgttctttaaagacagccaggaaaacaaaccaaattcatactacttacccaacactgaacgagacacgctggctccctttcctttattttgtttcccttctatttgtcctgggtttgtggttctcgggcaaggtgaactctgctcagtatgatatgtgacccctggccacagttgcatatggccctgcctcagttgctgcctgctccttacttgattctccaggtccacactcctttcctgtgccatcttcccctgtggcacctgtgtgtaggaatcttcaacagctgcaccgccaacagagaagccacaagctggagccccacaagtttccccccaggccccatgcatgggtcagcagtcttgacccctgggctgattttaatattttaattaaattgacaacatgtaaaaaatctggagatttcacaacaatgcagatttctgacttcttttgacaaattacaaactggccaaatgtccacagctggccagagctgtgaggcagctgctcccttcatctggaaagactcttgctccactggtcaaagtccccaccggtcccctcattgcaacctcaccattccctatcaacctctgagttttccacccctgttatgatatgcacttccagttctccagctggacactcaagatgtgtcaccacatggcccactgcacttattcaatctcttctcctgggaaccctggaaaatctctctgcttctaggctctgctgggagcaattcccctcctacaatgtcctccttgctcttttatttatccaacccaatcaagagtatctctgcttaaaaaattcttgctgaccacccaagccacaaagagctctcctttccttaaagcatggagtcaacagttatcttacctaccttcacatagttggttcttcctgtttgcacatcctgtttccctagctaaattgtaaacttcttgagttcacatttgtttgccttccccagaaggcagccacagactttccaaagggaaagttctgaacaaagattaattgtttggtcaggagctatcaaccatatcatcactcagtgcaagaccagtctctccagcctcttttgcctccactccacttcccttgttcccctctcaaatccacccaaacccccatcctcctggaatcactccaaaaggactagaatttgtttcctgttttgcccacgattgttcccatcgctgccactccccagggctaaacacagaacctgccacataacaaaagctcagcatatgcacattaaatggaaagtgccttactttttagtccctatatcttaacatctgcagttcaccaggctgaccatgcccttctcccttttcaccaacagatctacgggtcttggaaatcccagttcagtgttcctctctcaatctttttctcttcctttactcagccaagtcactcctctctctaggcgccgcagtcctttgctcttgcctgccacagccattgccaaatgttggtgcaattgtttgcccacacctgtttttcccttggatgccaaggtcttccggatccaggattgtgtgatcttcttccatgcgcttgcctggttccccaagtcataactggacataattagtctggtggagaaggcaagtattatggccctcatttttccaatgagaaaatggaagcaaggcaccaggctccctgcatgcagcagagagatggaagaggaagagaggagcagcttgggtgagaagacttggttctattagcaggggtcaagcaatggaatggaaatgtgtcatgtcctttcaaggtcatctgtggagcaatgtttaacagcctgcccaagaaatatttaattacctagaggaaagtaagtacctttgttgacttgatatttgctaccaactaaatagccagattatgtgaagttacacattaatgtgtaggattttgcctagtagaaatacaaatgttttctgttcaggagaaaagataatctcaaagtttattaattgactcccgtgtaggacattaaccagttttgtttctaatttagcaatctcattccaacactcttcctccagtgcctatgtaaactcatgctgccatcttgttggtttcctcattaatgagctaaatgcatttttgacatgtccacattctagatttgtatgagtcacaattttaactttttgaaaattatactttgccacccaggtgccaccaactctgggagtgtgagcaagtccctccctcccctcttctggactcagtttcttcaacagtaacatgagggcgtaggtctgcatgggaaattacaagccccaggaatatttgattttaagcctgaatcttaaaaagaataatttcctcatagggttgaacatcttacggagttattttccaaaataacaacaataatgggacagtgcttcatacctggggctaagtattttaattctcacataatgagatggggctattgttcctagctctattacaggtgaggttaggaaagctgaaacagtattttttttaacgaggagacactatgtttgtccttccactcatgtttccttccattcttcttttcacctgtctggtcatccatgtttccagtcatccatcccactgatgcaaaaagaaggtggtttccattttcactctggatctatctaattgactatttaattgatgtggactttagtagaggcagtgattgcttccagttggtgggcccaggaagactgtgaaaaaggtaccactttcagcttgaccctgaaggttcaagcagaattatttagggataggttgaagaagcatctttgcctgaaggaaccatggcagggacaccagaagacaaaggagggagacatgcacagtgaccagtgggtggttatggctgtgggaagggtggataatgggagatgagatgaaaaagattgattggtcttggcatatgtcaatggctgattgagaatcttaagtttccttgatctgaagccctgtccacaatcacccagactctgagtacttcatgtggtagtaagaggcagagacaaacccttccccaggtgccctgatctggccaagcctgggcgctctgactaccagagtcctgaactcttagaagggagagctgcaaacaaccatggcgggaatctactccagcctcccttcccgaacatgtgggcctgagctaatttaagctagtctgagctcactttgcaagcagttgtcacaaggtgctacatcaaaagactcccaaggcccaaatatttaacaaccagaacactccctccatccatcagtttggtaattctatccacacaaaaaaactattggggtttcatttctggcctgctcatttcttataaacatgccagggccatttacagctcacaactcactgctctctaaacatttacacatttctccctcttaacacatccttggctatttgattaagtagtagatcacaggggatggaaggcaaggccttggcatctttgggttttctccaaacctatcttgacatgggttcaatgccagcctccccttccagtaaacacaaggattattgcactcctgggcacagacttgctgatgccttggtcttttctatcccttctcttgcagtttctttaggtaggagggaatacaaaccccaaaaacaaacagacatgagtccattttaccagctgggtttaatgggaaagctggtagggttccccatgacccctaggactgaatgagtgcccacatttcacaacaccctgattccagacaggaagcttggagaagtatctatatttgggggaaggaagctgccccagacacagcttcctggactgttagcaaaggaatctcacacaaggcctaaaccagtttccatacaacttccttgccttttgggaaggtgcaatctcacaggactggtgggacttacccaatgcagtcatccaaaaacagttatggccaacacctaagtgctgagaaaagtcaagaggaagaggaagccccaagggcagagaaagtggtgaaggtcacagaaaaggcatggagctgtggcaccattggcgggggacagctagagtccaggcacagagctaaaactgggtatgagcaagggtaggagaggggacactgctgaacacccacaatggtcctgctcctgttggctctgccttcaatctcaaaggcaattatgaataaaggaaagcacactgccttcagagtccgacctaagtttgaatcctggcatctttcccagctggccgtattacccctaggagctactcaacacttcagaacctcactttcttcttcagcaaaacagaggtgcaggtatatatctcctaggagtgacaagggaattcacgcggctgttaatgacctggtgcctgcctggggctaccaagcagccaccacaagagtcctccataatagcatccaccgcactgcagtcagggcaacagcactgcaagcacttcatggacagagaccaagcctttccaacttgatctgccatgtttcaacacagtgcctcagccattgagaaaatcctgtgacaggcacagacccccttcaagaaggacttgctgctcagctcgtgagagggttgtcagcagcttcttcagggcttgctcagttgcagagagctacctggccagaggtcatgcccttcaggggcagcccacctcctctgagtgatgggagtgatggaataaaggcccatgtcagcccatcccagcactcattccagcacaatgctggcaggccatcttggtgctcttggggctggctgtggctgcatccagcctgcatcacgactcaacctctgcacagtcctgctgccttcccctcctcccgtgggtatgagcctccagcacactcaacttcgtgtcagagcttaccttccaagaaccctacctgcaatgaacttggtatttgttgatgagtaaatgtctgaaacaagatccccaatcttctaaatccagagttaaaactcagacaggccacggtccttggtcattctaggtccaagaggctcttgctgctggcatggccaagagatacaggtaagtaaaacagtatactgtggtgctatgaccacccagggggctgccgtgtcccactcaggaaaatcaggtacctagttggcttccaaaagaggctggggaaattttaagttgaggttgggctctgtagaccttctccaccactaaagcccccaggtttatcatttcccgggagaataggtcctgggggagagggggagataacaatggaacacaccaaaagggaaccctgtaatggaacagtgcccactaatgtttattttatcccaggagtcacagaaggcctggaatggctgcgatggagataaaggatgaagggtagtcccctcagggtgttatccaaaaagtcaccttggaagaggaagaaactcctaccaatatcagaagagcaacaaacatttttttttctagaagataagtggctaatttcaaaataattattttatcaactgccacataagtttttttttttttaattcattaaaaaaaaaaaatgaggccgggcacagtggctcatgcctgtaatcccagcactttgggaggccaaggtgggtggatcacctgaggtcaggtattcaagaccagcttggtcaacatggtgaaaccccatctctactaaaaatacaaaaattagccaggagtcgtggcgcatgcctgtaatcccagctactcaggaggctgaggtgggagaatcacttgaacccaagaggcagaggttgtagtgagccgagatcgtgccactgcactccagcctgggtgacagagcaagattccctctcaaaataaataaatacatacatacatacatacatacatacatacatacataaaaatgaaatgcttcccttttcaaatgaggagtgggaacacttagattacagtgctaagttctttttgtctgtgaggtaaggagaagagcctgcgcctaggtgaccttggcctggtcagagatgctgggacagcctggacgtgggaaagaagggatctacgcaggtctgtccacagcacattccagggcagcttcctcccgggctgcttctgtgccagaacctgctggcctcaggagccccagctcacctttcactgaccttcagcccacaggagaacagcatttcctacctcccccacctgctgacaaggcctctctctttcccacgccaaggacaaagatgacctctgggggattccttttagctggctcataaaaggaagagagatgggccaaagagaaagagctgctgggtccttccccaactagaacatgggaaatgatgattttccagtagggaagtggtggccaggcaggcaggcgtcgactagatgggtccctctggggtgtggtggaaatgacctcaacttcaaagagacagacttccagagaaggctggcattagcatcctgatctgctctactgagaatcccaagggttttgcggaactcttgctgggccatgaggatacagtctcctcctgaccccaatcctctaaccaaagcagctaggtttcagttagtgtacacagagctccaggcctctaagagtgtgaaagccactgcctcaggagatatcccttgctggagatcctgggaagtagaggctatggaggcagaccacttaatagctgtgcaaccctcagcaagtcattcatccactctgagcccgagttccctcctgtgtaaaacagcagttatcacagtgcctagctcctagtctgggtgtgagagttcaaggtgaggccaaccagttgcttcactccgtgcctggctcatagtgagacctcagtaaatgtgagctattttctttcaatgaatatttgccctttccagcatcacaaatacatgagcttccaattctagggatacaaagacagaggggctttatttctttcaatgagttcagagaagtccctagcacttaaactgctatacactgagagagtaagccatagttctgaaaatgctctgtgtgctcattcacctgaagcagcactgggggtcactgcagcctcaggtgccaccgagccgacaggccatgaaaagaacacccactgactcactcatctgggtggaatggtttcatggggacccaggtgaggtggtgaggttgctgcttttttatgtattggctttttctgcctccccaatgccccacttccgtcgcaaaagtgtctgagttctggagcaaaggctcagctaggaaaagtttcagatattttctttgtcttaacccttcagggagaggaaggaaaatctgtctcttgccagggtgagggccaccaagcgggttagctcactctgccacattctgcattttctaccttcaacacaatggacagtgggatgtctctctcttgccatatgcattcaagagaaaagccctggtttgggtggggctctggtttgggtggggtttgcattgggtctacagccactagcaacttgctgtagtcaaggcaaatgacataagctctctgatcctcagcttcctcattgtaaagagagctcttagctccaggtctcattactttcagggtatttaggatgtttagatgccaaataagacagcagaaggcagagcaccttgacaagcataaagcactgtatgcaaacataaagcatggtgcaatctcacaggactggtgggacttacccaattataaacaaatttataatcacatggcaggaagggtggaatttcaagatagaattattattcattgtaagatgacttgtgtaatattgtaaatgactgctcttcaccccatcctctgattcaaattaaaatcctcattccatggcccctacatgtacgctcattttcactgttcagttacaagcaacaagatgagacattttgacgcccttggtaattgtctggtttctagaagttcttggttcacaggcctaagcatgtttcatttgatgtttggcaccatagaaaacagtgtatgtttaatgatttctgtgttaaactgaataatgaataaccaggaaagacaacagaccaaatagcaacttcttgatacacctgcttgacggaattctgagcctttttcccactctatcaaggacaactgcctaatggagagtcagaatatttttctaatacaaataaagtaaaaaagcaatgtaatgttattatcttttaaagacagaaatactattaaatcctcaaccatttttaaattaaagcataaaaccctcttctacccaataagcaataagaactcacttgaattccttttcacaggcatttaagggatactaatgggtacagacagaagagggaaaagtacagaaaggaaaacagcagataaatatatagaagcagaaaacaagagtaacagaagagaagcagaagagactaaggaaggcatctaggatgcagttgtgaagagaaaatcagacatatgtaggcagaaaagaaaacaatcaaacaaacaacaataataaaattagaactaaagagaaactttcttaaaggaacccataattttggaagcttatcagtagattttaaaagtagactacagatttatgactacaggagtaaagggtgtgttactcttagtaattgtttccttaatgacataaaatcacatcaagactatatccagctcatgggccagcagctccccatccctgccccataatgctgcactgtattatgtttcaatacaaaacatttggtgtccacttgggtcagcacctccatcagactgccatcactaagggaactgagccagcctcccacgtcagtttcctcccctatgggctccactgaatggggatgaatgcggtacctactctcatagtagggatatgaggattaatgaggtgatgtagaaaaatcacctggtattgtaggtggcatttagtaaatccttcataaacactagtgttcattattagttggggttacaaatagttactctcagagggggaaaaatgaatgaaagtgtgtgaacaggttaaacaaaatattttggaaattttatgttgtcgtctgaaagttctttcatgtgcatctaaaggcatcacactcactgtcaccctcttcacatggtgggtatcaatataaagaacattcttcaatttctgcttgactgctacatctcatttctgtctctaggtttccactgagccctccagctcaaggggcctccctccgcatgagtcgtctttaggaagcccagcctggtctctaattttgagaagcatttcccttatttcaggtcttcattcagccagtggttcaaccactgaaccacttcagtttccttccttcattttattcacaaaggaatcctttcatctacagcccctagctgggctcctttgaagagactttctcttcttgcattattttcttggtcagccttccttaggaaggaattaagacacatttcaggaaacgggcagaaaatgttaatccttctctccctcattgtcctactcataaacgcttactccctcaaatgcacccataaataagctgtagatccacatctggttctgagcccagcacatagtaggagctcagatgaatgatcacgcctgacttctcagccttgcttctgccatcccttcccctgaaaaatctgctcctctctacttaacctagtagaaccctcatgaaagctgttgtccctgttgaaggaatgatgccccaagcatccagcgtgtctgctgtttacttcatgcaccttagtggatgtggtgaaatgaaatgacttttccatttccaaagagaaagtgcaaagtctccaaacttatgacctctttctcagaatgccaatatttacagcttagccctgggcaaccctgtgcttttctgaccttagattcccatttggagtggaaatggcttttctatttctccccaaggttctctgaattagatgaccaaaggagaacttacttctaccaagatgggtctatgagacccattcaggctctcatccattcgttcaacagattcattcattcagcccctactgtgttccaggaaataagtgtcaaccatacaggagtgacccagacaaaaagccctgcttttatggagttagtttggattttagtggagacaggggaagatagatgataagtaaaataaataaagtatatatagtatattagagaattataaggtttataaagaaaaaatgaaagatacaattagtagggaatggggataatttaaaatagggggaaatttataaacataatggaaaatatgcatgtaagtaaaattccttccaaaaaatggaatatttaacactaacttgcggtgtaaacatgaacacatcatgggctccctccaggcctcggtttccttctcggcagtataaggtggaactacaaggtatctctatggtagcttctggcactgaaattctctttctctacccaatagatagcaatttgaattaacactagagcctgttgggacccagtgattgtggtctaagtttcaatgactttttttttaaatccctacattccttggggttcccagcaatgtctccagtgggctgctggtccaaattaattgtgagagcaaccacaaattcccttgtttatatttttgaattgttgacttagaatcagttttaaatctgagcccttcttccccacagatactctcaaaacagcctcctgataggcactaacccctaagaaggtcatcaagtggggctctgagagcaaggatgctgggcaacccggcttccaatgccacttatcctagccacatgagtactcataacaggcttgacgtcaattaaatcatactggccctgagaggcgccacccaacaaactgtttcttcttcgtggactttttgttccctctttatttattttccactgagctacaacaaggctcaggaggaggcccttcatctaggaagagtcatcttgggaccatctagggaggaaaaggcatccatcaggcactcatcagccacctctgatgaaaagcttcctttggggtaatttctctgcaccaccgagtaagccttctgcctgctggaggagctgtggtgagcatgtgaagggaggttctgaaggcttcagcagcagccaccagtccccctgcagcccctaatgagaggtgatccttgttcaactcctgctatgtgctagacacattctaagcactttacatgtattaactaacaagtctatgaaacaggtgttatcattattcccattttacagatgaagcaagtgagacacagtgaagcagcttgtccaagatgacagtttgtaattggaggagaagagcccctatcagcatcgctgtccagaagaaacataagacaaaccacacaggtcattctaaattttctagaaggcacatttctttgacacttattttatttacaactctatgcaaatttaaagacaaataatattccaagtggggccgggcatggtggctcatacctgtaatcccagcactttgggaggccaaggcgggtggatcacctgaggtcaggagtttgagaacagcttggccaacatggtaaaaccctgtctctactaaaaatacaaaaattagctcggtgtggtggtgggtgcctgtaatcccagctactcaggagcctgaggcaggagaatcacttgaacccagaaggtggaggttgcagtaagccgagatcacaccattgcattccagcctgggagacaagagcaaagctccgtctcaaaaaaaaaaaaaaaaaaaaatatatatatatatatatacacacacacacacacatacatatatatacatatatacacatatacatatatatacgtgtgtgtgtgtgtgtgtgtgtgtgtgtgtgtgtgtatatatatatatatatatatatatatatatatattccaagtggaggaaagaagttttcagattgctctcacttgtaactcccatacattaattttcttgtacatttttctttaagattataatgttgattgcctcctaacagtcatttccatccccctccctcattcagagaaccctgattttgttcaggggtgcaggtacctcaccaaaactgatgctggccccactcctgggcagacctcgattagtctgagcaagccctggtgctctcattcttatgccaacaattggcttaggaccgacctgtgactggttcttgacctgtgaaataaatgtgcaggtgtgctgggggcttctagaaatgtgggccagactgctgaagaagaggcctggagagatggttgcttaacctcgagatttttttttttttttgctttctttttagtatgataaaatatacataagataaaatttaccatttaagtaatttttaagtatacagctcagtggtattaagtacattcacatggtcgctcagccatcaccattatccatctagaaagcatattttttaaaagtaaaaagaaaaaagtgaaattaattttaataatggagtttaatctatacaaaatattatcaataagtaatcaatataaacattataataaggtttttttacagtctttttttgtactaaatttccacttacagcattgttgcttttttagagacagggtctctctggagtgcactggcatgatcatagctcactgcacagtccttgaactcctggcctcaagcgattctcctgcctcacctccaaagtagttgggactacaggtgtgcactactactcccagctttacagcacacagcaattcatatttcagatgctcactgaccaccggtgttggactgcccaggtttaaagtttctcaggcttgtgcgtgctcagccagctcatgggcatctccaagggacagcagcatgctgtatgtttatgaaagatttgtgcgtcaccatcagctctctggggcagtttgcgattcaccgcaggaccctagatggtgtctgactctaatggttctagatcagcctctctaacccccgcggagatcactggcatcacgctgatggacaatacaagatctgaagcctaaatgagagcttttcctggtggagcaaataccgtgcctccatcacccagctgtgatttcatctcccagttgagaacatgacctcaatggcagaggtagggacaacacctatgcagctgcacaggcactcccaggttggaccaataataaataaacacattcctacttggaaagagggcagcatgtgtgcagggttgaggcaagccgtggttgccatggaaaccagccagcatcactccagactttttccctggtgctcggatcattggtggctgacgaagcccagtggagaggcattgttcctgtacttatggaaaccttccaaataggcccattatgatgaaagcacatcaaagagggaatgatgacgtacctttaccatccatcgtcacatccactgtttgtcctgggtaatacccaaaagagaagaaaataaagccactcttgccacagagggaaataactggagagcactgaggtatgacactaggggtagcaaggtggtccccaaaggggaggcaatgaaactgccccatctcaccaccatagtgaatgctcgactggacaaatggttatggcttcagggatttgctacctgcccaagctgacttacaactcactttctatggcaagcctctggtttgctctctttctggagccacgtatgtttgagatcttcccattcattcattctttcctatgcccattcattccttcactcattcttgaatgagaagcaccatggtaacatgaaaacagcctgggtcatcgagtcatgagatcccagatttaaatctcagttcagatgcttattggatgtgtgatctcacctaagctattaaagattctctgagccttggttttctcacctgtaacatggggacaagagaagaataatgtttgccacttgtcttctacacagtcatactcaatgtgtttatacatgatttatatctcattccattttgatcaacaattacccaacagagagcctggtctctccagatactcaataagattattgaattattgattattgaataaaaatatgacaatgtgctttcacatatatttcttctctctctctctcttcaaatttcattttcacagcaatctggttcaaggttgtttcagcccagcacaggacaaagaggattataaaattaaaccacatgtttctgactctcagtgaacttacagtttactatgttttattaacaatgtatacaacacttagtctgccccagctactgtactaagtactttataaatattaggtcatgtaatctgcataataaccctatgaggtaagtactacgattgtcttctgtcactggctcagggtcacactagtacatggcagaacaaaggtcaaactcagccagtctggctctatagcctgtgctcttaaccactcagcctcattgcctttagagtggataagtcacattcacaagtgtatgcgaatactctccaagactgatggattcagaggaggaaacactatgcactgcatcttaaagatgaggtaggatttgaacacatggagtgcatggaggagagcagaagaaggacaggttggaaagaggataggggccctgaccatttgcttgaagtgtttgggctttagaccttggaaagccactgaaggtctctgagccatggggaaacctaagcaaagctggctttggggaaaattcatctggcaatagcatgaaagatggactgaagcggggagatgggacaaatgaggagagtgacatgtagctgctataatgagtgaaggaaggggtcacagggcttaagccaggacaatggaaaaagaagcatcaagggcaaatccataggacgtgcctcctaccaggatgtaatatgtctccccgagtttcccaccaaaactttcacatcagaaacaagttccaaggagcactcactgggcactttcgtggccatccagagtggcacatgggtgctctatagcactgctttcctcaaaggaaacatggggtcatcttgagcagctggaaacactggctgagcctttcctagttgcatgcagccatttactgaggccaagggggcaaaatctaatcctgacaaagaatcctggccacctcaaatgcaaaagatagccaagtacaacgaaccatagtcccgtttgttataatgtcctataaatcacagcctaggccttacagttaatagggctttctattccaattcccattatgctggaaggggaagaggaagaattgaggaacgaatgaggagtctgagagtgagttacggcccaagaatatgacttgtcagccgtcttccaagctctaccaattgcctgaaattctctatccagtcgtaggtttgcataaattcctggagaaggctttgtctgataccacagtgaaacagatgccagggtgcaggcacaacaggtagactcataaaactggtaaagagaactttgctttgacaaaagctggagttttccttgttatttatctttcctatttgaagccttgaaatcccattttcatcttgatggagatgataaactcttagaaaacttttatggctcccaggatgaaactgaggactctgcctctgctccccactgcaattctggcaggcttttaaattcaagtcagggcagaaactgtttttggtcagaggcaaaatgtatttatctctgtaagcacagccattaagatgtgagcatgaatagctaagagaaagaacattaagggagaaacaggaagaaatagaaggtgaggctatgatggaaggaaatgatgacgcatcaacccccaccaaaagctttttacagtgccgggggagtggggcacagggaaaggcatctgcagcgattgggagaaagaacccgggagtgggctgaggggaaggctttgcagtgggagggctgtgatcagcgtgtgcttcatgcaaagagaattttgagagtggacataacaaacaggaaaattgtgcttgcatttctgtttgtctgtagaatcactgtggctctgaaatccaccccctctgctctccaaacactaaagaaagtctccagatggaaaaatctgaagtcaggctgcaatatgaaaaaagaaaagaaaaagaaggctgctacaggaagctgacaaatttgctgtttctctgaggtctaacctatgcagctggggtatcaaatactagacagggtcaggagacatgtctgaaactgaccaaatgaccttggacaagccccactttaatcacacataatgtaaactttagggaatgtgacctagaacaggtagctaaggcacaaataacactagtactaccaccctccaagctggcactcatggcaggcatcattagtcagtcatggaattgttcttttcttttcttttcttttcttttctttttcttttcttttcttttttttcttttctcttttcttttcttttcttttctttcttttcttttcttttcttttctttttagatggaatcttgctctgtcacccaggttggagtccagtagcgtgatctcggctcactgcaacctctcactcccaggttcaagtgattctcctgcctcagcctcccaagtagctgagactacaggtgcctgccagcatgctcagctaatttttacatttttagttgagacagggttttagcatgttggccaggctggtcttaaactcctgacctcaagtgatccacctgccttggcctcccaaagtgctgggattacagacgtgagccactgcacccagccctcggaattctttagagcagagccattatgactgtttgctgctgaaccttaaatctttggccaaatattctctgtagctgctactgatcaatcagaatgaacccagaagatgaaagctgatgaaagatgatgaaagttcaccattgctagacttgatctcttctaatccttaaacactagagccagataagattgcatgtcatgtgtaatctcattatagacatccttaactaagtcctaccttggttttcttttctctttggccttctttccaagtcttagcagccaaggctgtgaaataagaactggtatgaaggctcttcattcaactccacatctgaagctctgaaagtgaccttgtgcacttttcttgagcctctttactttacgttcccccattctgccacaaagctcctggtggggctggtgtctcctctactctcctgctgatttcatcaaggtaaagaattctattccttttcaaatgctttgagatcatgggatagaagacagcctggggaagttcaaagacgtttaatcattagcctcagttcttttgaaaattattaaagagcccagaattagaaattcagatttcctccaaatccctgagaacaaacaactctcttgtaaatggcttaatgtgtctgtttaatgtacacaaaattatctttcaggaaagtggattgttttttatatcattttgcatctctaaaatataccacctatggcaaaaggattgggattcaaagtctgacaaaatctacagcagaaataattagcaccagaggctgtttctgagagttaaatgaaagagaaactggttatttatttatttcttttctctctatctgtatctctccatctcagccccgggaagaggaattgtatctcttggtgctagaagggtggcttgctgaattgcctttacaaggtttttttctgtaagacaacaactgagcccccaacacacaactccctgtgggccgcagtgctatggaaacagctgcagtgctccaactctggggaaaacaaccagataaacccactggtttgcaaactaggcacaagggcagaggaatagtgatgttttctaatttagcatccagggaggcaagggggagtctttgcttaaatcatgttaatgaaattggaaacacttgaaatagcccattgagggtctgttgcccctgttttttaaagttcatctaaaagttaacctacaaggaattttcatttggggaatttctgcaatgtcaactccactgatcacccacagtgtttaacacccttgctataaatttgggggctagcttggcagctcctgccacccccctgagtctgctaccttgctccagaaataaaaaatgactttggccacagtaatgtttcctcgatcctcagcccctcctgggggcctccggcagtcattattttaaataaacatgccttttattgttttcaggtacacagagatggaggcgcttctacctctggaggagggatggactttcaggggccccatgatttgcagcagttcagtcaaaagcaatacaaagagcaaaggataggggctgttatctcacccaagagctcctcaagcagaggatactcaattggaaaggaggctcttccagtcaaatttggggctagtggggtcaccacgtttgataccaactaggaacaacatccccttagaggcttccaactgaggaaggttccaaaagagagctccatggctgaaatgattcaaaagaagccaactccttctcattgagctggccctttggaatatggccccctcctcccacggcatccttccccctgcccagtgcctcaggcccatctacatgcttctacctataggctttgcttcttctctagaaaggagcaaagaaggaaaagaatcattggaggtgagtcaaaagcaggcaccgtaactcacggggccttgtaagccagggacacagtttcagattttacttcaaatggaggcaaaaccatgggagagccatgcagagacaccccttgatgaactctgcttcacgccaatcactctggcagctaagaaaagtgcattctctctccttttgcagttctcctggtgcctagcacagggccaagggcacagtagatgtgagcctaacacttgtggcctttgctgatgaaggacagtgaaggggataagaaaacataaagatattttgggctgcaagggaacgaactactgaaaaactactgcggccccctctatttatggagatgctgaggccttggagagggaattgacttgtccaaggtcaaccagaaaagtgatagcaaagccagggttagtatccaggtttctgctgattgcagctcctcagataaaagtaagtgacttgcctctcttctcccatatccagaattgatctcaaacactgtcatgaatccccaagggccagagagacacacagcatagaccaaggtgagtaaactgttttctctctttctgatgatctgagctttttcctggagagatctcaggtggccaagaaaccaagttgcccacctcatggttcagaggaaacaataacctcctggcagcttccctgggagcccatgcaggtgcctcagggattaaggagctcctgaaaacaactcctttcctttgcaggaagtgattttccacccctgaggcataacaccaggcagaggctctatcagtgcctgctgatataattagctctggacagactctccaaccaaggcagacacaaccaggcccttgctctagaaacaaaaagaatgttctggacctatcccagtacacttccaaaccccacgccttcctgggcaagtcggggctcagagaccaacaaacccaacagacttcagcagcagccagggagctggcagcctctgtcccctgaaatgccacttttttttttgtgattcagcctctgtttcaagctatttttagtgtaagcaaaggctgcatctgagggaaggtggtgtgggaaaggggtctttactttctctctccttttcaatgaactgtcctgtttcccttaggacagccatttcaccaaaagccacaaaacatgtggggagggaggattaaaaagaaaaatgggaaaaaggtcaaaattcagcctgtttgctaaaagtctgggaacagttctaggaaggtgatagtttctcgatcctttgcgttaacctgctgaatcctgggctgctcctgccagtggggaaccaatatgcccagtccatctaccttccgaattaaccaacctccagtaaacaaggaaggcccagaagtttgctctcccagggacgtggtgcaaacaggtttaatggtcccccttgatgccccagggaaggatgtgtgcccttggaggcttgtgaacagagaagcaagcttccgctcacagaggaccctggcttcccaccctcaccccgtctccatcatgtcagcacaaggccaattttacaaactgaaattaactggatgagcaaaaagatagccttggtgcttaagaggcttgggtacatttaattgagtttccaagtgccctgattccttaagaaagccagagaagccactgttatgtcctagatccctcactactcaaacaggagagaatagtttttacaataaaaattttagggcaaatggtggctttctgttgttgtcatttccctgaagtaggttttttgtttgtttgtttgtttgtttgtttgtttgtttttttctggaaaaagcctcactctggacccagagtctaaaaatgaggcttttagtgcaccaaattgggctgtttggggcccgtaggcacgagtcagtctgcctcctcctaaacatagcctcgtaaactaaacttggaagcatcagcttgcgtgtggtcccgagtgtgactttccaagcatgcactcccctgcaacgacaaaggctgatgactttgtcatcatcatctctatttttgagtctccctgctaaacaaactttctcgcagctgaaatggaggctctaaggatatttttctgacaaaaacggagtgctaagccatcagcaccctctgaaggccttgggggaaaacctgggtaagaaaagtctcccagcccaactcagtagccgcaaatacagacatttcatttcctgaaatgcctccagggggcgccagctttcatgggttgggaaggagggagggaaggacggaggaatggaatgaggcgaggaaggaagggagggagggaggaagggagggagggaggagggaggagtgggggaggtgggagggggcagtggggaggaaggaaggaagggagagagggaaagaaggaagggagagagggaagggaagggagggaaaggaagggagggaagggaaggaaggtaagggaggcaagggagggaagggagggaggcagggagggaaaccaactactcacatatttgcccaggcccctgggattcagctgcagaactgcacaggatgtgcaatcaggactagaatgtctgagctcccaggcctgtccaagggactgagagatgggtcacaggttctgacttatcactaaaccctacttcagaaaccttgccaccccaaatcattctagaaaatgcaagcataacatttccaccttcaacactttggatgactgcactttgcagcttttgctgaatgaaccaacatatgtccagcacattgaacagtatctgaccccgagcaggtgctccagaatgtttgaaggaatggatgaagggatggaggaatagctcagaggagctgcctcgcatgtgcagtagaatctgggtctttatcttctggtgacctcacacgctttcccatctcctttcaatgaatgtgtggtcactacctgtcaaaatgtacatcaaacccacctccccaaatactggtgcagatgtgccctccgaaaccagcctgtccctgccctgtcagcctcgccccacctccagggagaagtggatacggagaccacagtaagtgcacttgaccctttttccttaagactcatctgttgtcctgccaaggcatttcctgtgacacatgcgcccacaacgtacagctccagggagagcccagcccgttctccagtccccagccagctcagggaggctatatgaagtgagaatttcctggccaatttgacaatggtgagtcaggctggcatgagccagctgcaaagaggacgcagcctggacaagcctgaattaagtgtgtgcacagagcaaacatcatcatctggatggatccaaaccagggcttgcctggggcattcagagcctttcagatggccctgcccagagctgctcagcactcttggaagatgtctgggtttggggaggctcaagggctgttcttctacccctgccccagaaaaggatttgttcttcaccccctgacccgtctgtctccataccagcccatttcctccatgacatggtgaccgggctcacacacacaataacaaaaataataataaccatgcttatcaagcactaaccatgtcagaggcactgttctaaatattttacatgcattaactcattaagaggcagggactattattgtccccattttgtagatgaggaaactgaggtatgagacaatgaagccactcgcccagggtaaaagccaagcccctgagacagatggagctgggagtcaggagtctgcagaggctgggcttccaactgcccagccgcaccacacacagcagctccttcccaagatgggtgtcccagggagagaggcaatgcaagagctgaagtgagttttgaggctgctatgggctccacccatcctccttgtttgttccaatcaagtgagaacgagacacaaggagcaagatggagatcaaaaaagagtaggagctctagttcagatcatgatgcactgacaaaggggcagggtttctcactcccaggccccaacagagactgaagcaaagcggacagagacaagacaggaccggcagaagcaggccggactggctgctgactgcacagaggctgcaagtgctctgcttgcttaccaggcccccactgacctgtgctacgctcagttctgtatactagggaacaccaatcaatgtcggtggatcacacaggtggatgaatggacatagatggatgggcagacagacaatgggatggaaggccaaagcaggcacccacatgcacctggaaacttcagaggagagggaaaacagccatgccagcacttgccatcagagccctgagggcctgggagccagagatgagtggccaggatcaagtgggctgtccctggaccaggaggctcttcctcactctggagccaactgagggttgatttctgaaactctccttcattttcacagcagccctggggagggcagaggagccaacacaccagctagtaaaattaacagctgctctttacagggcgtgccggagagcccagcacatggctcgaggcctgcagaccagaagctgctgcgagctgaggtgcctggcctgcaggccctgatcaggggtcctcttgggggtaaggcttagactctgagctgccagcagggcctggggtgtgggggctgccgaagcagtgggcaggtggatggagaaactcaaggaatgatgctgctacaaaattctcagacatattctcctgaccttgcgaagtggaaatccatatgttcaccccagctgggaatctgctatggaacttggggacccacctggctctggcctctccatctctaatgcagtacttagttgagcttggggaagtgaatgtagacacgtccccatgagaaggggacagatgttatatcttatctattacctatgccataggtaacttatggagcaagtcctgtaggccacttgaagaggaatattgacaggcatacagggagtggcaattgtttctttacagggacagatggtaattattttaggctggtgggtgttttggactccggatactactcaactctgcctttgtagcttcttacagaagcagccacagacgatacgtaaatgagtgagcatggctgtattccaatgcaactttgtttatggacgctgaaatttgaatttcatatagctttcacatgtcacaaaatacacttattttgatttttaaaaaataaccatttaggccaggtatggtggctcacatctgtaatcccagcactttgggaggtcaaggtgagaggattgcctgggcccaggggttcaagaccaacctgggcaacacagtagaaccccatcagtacaaaaaatttaagaaaacatagcatgtcatggtggcctgcacctgtaatcccagctatcagggaggctgaggcagaaggatcgcttgaacccaggagtttgaggttgcagggagctatgattgcaccaatgcactccagcctgagcaatagagtgaaaccttgtctctgaaaaaaaaataaaaaaatgtaaaaaccatccttagcttatgaaccacacaaaagaggcaatgagccagactgtcccacaggctataactaactgatccctgggctaattaaatgtttcccaaagtgagtgctatgtgatgcccacaggtattacatggggaaaggattccacagggaaatgaaaatggaaaatgctgggcaaaacagagcctttccgctttctgactgcaggacttctgtaagtatttatatgctgatatgcattggcaatctcgaggagggggatgagaaatgaagtctatccaagttcccagggaaccatttttatccgggaacaattcgtgggtctagtgttctatggaacctaattaaagccatgaggataaagtctaaccaactgtcagcaacagcactatgaaatgcgatcctgctgctctttgaatatttctagtaacaggcagctcactacctgtcgggggagactgctcaattcaattatttctctgactcatgttttctcatctgggtaaatgatgttgagtcaaaaataacaaatctagtgcaaatctagtgtatctttcattagataaagacaaaatttcatgtttaatagtaaaaaaagaatgtatcttctttgactttttgactgatacccataatgtgatttcagtatctatgcatgggatgaaatacagaaccactattaagtcctggaaggaaattatcatatggttcctttaaacagaagcctcccttaggagtgttaaaacaatgccaataaaactccaactgattcccaatagcagagagcaggacatacctattcactatgggacattcttactaaaagtacagtcctgtgaaacctctagtctttctgctacacaaggcattggccaatgatgtaagaattttacatagatttgcctaaaatataataaaagctggggcatagatgaggggggtgagagacagagacagagacagagagagagagaagtgtgtgtgaatttgccaccaggcaccactgagaaagaaaagtagaggatactgatgggaaatgtcacaacctccatagggcacctaacagaagtgaatgcaatgaatgtgatatatttgattatgtgtgtgcccatgtgtactcccactgggttcaaccagtctaatttcatgcgcaaacagcacatcagtgaatgtacatctatttaactctgttaaaccaataggattattcctatttgaaaggcatatttgacacatattttcttttgggcccttggagataaagatgaaatggtccaggctatgtatataacgttaatgtaaaatgccacacatgcaacatatttagggggataaagagagaggctgatatttttctttcttcttacatcgataaatcatccctatacattcaagcaagtagcatatgctttcagttcatagaattagctgtgtaagcttcctggagcaatacacagatgtaacagcataggaatatggggaaagtaactacaaagagtgattctaagggctctctctagctttgctcaggagctggtagctattttggcaagaccagtctttgaagagacacacaaaacattgaatctgtcagggggttgaggtaaagtctaggcagtgtagatgtcgctcccaagttgaggtgaggctgtccttcaccacaggacatagtttccctagggagacagttgctgtgagatcaacatggaaatgaatatgaacatgcagaaactaagtgacaatgtggatagtgagagtatgtgtgtgtgcctgtatttatctttgtgtgtgtatcactgagtctgtaacgctcctttacaaagagtgtgacactcttgctactcgaccttagagaatctcttcgcctccagccccagactttcaatttctttatatataaaacaaggggataaattagactgagtcagcaaactatggtgtgtgaaacaaatctggcccaccacctgtttctttttttaaaacgttgtattgacatataatagtgtacatattttgggggatgcatgtgatattttggtacatgtataatgattagatcagggtaacagaaaaccatcacctcaaacatttatctttgtgttgggaacattctaattcttttctagctattttgagatgtacaataaattactgttaactataatctccctattgtactatcacatgctggaacttattccttccagtcaactgttttctctaccccctatttctataaatacagtttatttgtataaatgtaaggagtatgagtgcagttttgtcacatggatattttgcacagtggtgaagtctgggcttttagtgtaaccgtcatccaaatagcgtgcattgcaaccattaagtaatttctcatcactcatcgccacctcccacccttccaccattctgagtctccattgactactattccactctctgtccatgtgtacacactatttagctcccacttattcatgagaacatgtggtatttgacttcgtttctgagttgttccacttaagataatggtgtctagttccatccatgttgctgcaaaagacatgatttcattcttttttatggctgaatagtatcttattgtgtgtgtttgtatatatataaatgtaatatatatacatatataatgtgatatatatgcatgtgtgtgtatatatgtgtgtatgtgtgtgtgtgtgtgtgtattttttttttctttatttaatcatccactgatggacccttgggttgattccatagctttgctattgtgagtagtgttgtgataaacataggagttcaggtatctttcttatataatgatttcttttcctatgggtagccaccaattagtagaaatgctggatcaaatggaagttctgttttcacttctttgagaaatttctgtgctgtttttcatagaggttgtactaatttacatctccatataagtgatccttttctccacatcctcaccaacatctgttattttttgtctttttaataatagccattctggctgctgtgagatgatatctaattgtggttttaatttgcatgtctctgaagactagagatgttgagtattttttcatatgcttgttggccattcgtatgtcttcttttgaaaaatgactattcatatcttttgcccacttttaaatgttatttggtgatttttgttgttgagttttttaagttcctcatgaattctggacatcaggccattgttgaatgcattgtttgcaaatattttctcccattctataaagaaagtttactggaacaaagtcacaccaaggctgtttgtggctgctttcaaactactgtggcagagttgagtcgtggagcccacatggtctgcaagcctagaatatttactatctggccttttatggaaaaacttaccaaccctgaatttgactaccactgttgactttggcttatgattctatacagcacaaccaaactatactaaaacctacaccatacgtttcttgccctctttatttagaaaccaccttattcttagggggatttaatttacctgacaaaaatgtatggaacacataactgcatacatgtaaattccaaataggagtaagaaaagtagggcaaagggaaaatgagaggagagatgatgaagacaagccagagcaggggtgcaaagacacagagcgcaaacctgagccactctgtattttccataagccaccgacttggctctgagcagccaccactgagagacatgatccctttctcgatttagcatgctcactggatgttcaccaggaaaaccacaacaatctctggtgcaaaacactacttatcccatgagtctgtgcataaagcaggtaacatgagatgcagtgaacaaagtcctcaatgacacccaaacagttaagagaaatcctgacgacattgactgctatatccaaatttccctccgcatgagccgactccaaatcccacagtggaatttatcagcacgtcttccagcacatttcaatttttttaaaaaaagcaaacatatattacttttataatcagaaaataaacatttgtttagttaagaaaaaaataaaaggaagcagtactcttgacagcctggtgttcactttaatgtagaatccctcagccacgtgctccaagagaaggctctgtccagtcctgctgtttttggccagttgagcctgagtgccagggtgagagaggaggcaaagacaggctattctgagatctggagccggggggtcaaggaatttttatcatgtggataatcaggctccaggcgttgactataaaaagcactggtgaatggcaattatcatttgtcatttcttaaattgagctctgcatccttatatctagtttatcaatataaataattcacacctggatctctgttgctcactgctttatgcccagtgccttgaacagtgccaggtacagatgagcagtaaacacttagtgaataacggatgtgctcgtctgggagatcctacagatattctgaggttgtattggcaaattcttccccagctggaccttactcatgatgtcccagcttcgagattcacacctgtgacaattagacaggtgagatagaggcccagatgaggaggccaagctcctgagcgtgcatcaaggaaaacaaattaaaaattgaaacgggaaactgaatagccagctgtctggtcttgctttggtcccattgttgcagggataaacatttggacggctcaagacaaacacagctttgggttctgaacaggcagtgctgctttctcttgcccgccattacttaattgtgaaatctcttctttgttcagtgcagggacctgcctgctcctaaagggcaggcctattctcaggataccgcctggagctctgagatgcctgctttctgtgcagcaggtcccacttgctctgcatggccccaacagcctgggcaggattttctccaaggagaccttcagagagcagctggcaccttgggcaggctcaggcaaagaggcctgagtggaccatgcttctacatgcaaatgtttaacaagcaggccaagcatcctcaggaccaaattggctaaaagatggtaatgtcaaaatgtcacagccaaagtgacagctgtcagtggcttagaaaagaaaaggcattatcttcgactgggaagtaatgacacaaaaggagcaccagactgggagacagggagctggcaggtactagcctggctctgtcactcaaagctgaatgtttttagacaaataattgcccttgctatatcttgattttctcaactgtaaaacagagatgaattcactgataagattggcctgttttcttgtaatgaacccctacaacacaacagcaataaggagatacggaagaaatacgacattgtccttccccttcaaactgatcataacatataaggttagcacagtgcctggatcacaagaggcgttcaacagtgtgattgccaggagagtctcaaggtggccgctgggtgtgctgggcccaatgagttccatttccatgatatcacccacatgggctacctgcatcttctgcttggtgtcagtgcagaccgtgccccaccaggaccacatcaggaatctgctcccatgccatcactaaagcagtagcttactgccctaacttgtcctatagcctccaagctctagcctcacccattcagtctccacttgtcccccagctctctctgtacaacaccccctgcctcaaaatctccttgttctacaaacttcaaaaattcatttttttttttttgagacggagtcttgctctgtcacccaggctggaatgcagtggggcgatctcagcagagccgctcactgcaagttccgcctcctgggtccgtgccattatcctgcctcagcctctcgagtagctgggactacaggcacccgccaccacactggctaattttttgtatttttagtagagatggggtttcactgtgttagccaggatggtctcgatctccggacctcgtgatccacccacctgagcctcccaaagtgctgggattacaggtgtaagccaccacgcctggccccaaaattctttagcatggcctttaaagccccaccaggctgtctccaggacacttccccagactttggggtctgcaccccccatttcccagagcgccaggctccttctctgtttttcctgctcctcactttgaaggctttcttctcctttaactctcaagatcctaactcacacttaaaagctcactgcaaatgcattctgtcttattaagtattcttcacaaattccagcccacctagtggtcattttcttgtgtttaagcctggatatgtttttattttttatatcttcccgccataaagcagctcatcttgaaatgggagttttagttcaaagactttcctccctatgaaagcttttctgatcagccctactttcccctacagcccctccccacactccacaagtgcacaccgtgtttgtactcatagcacttatcctccatgcattccttcaataacttccgcatatggtgcaatagaatcaggatccttccttgttttctccagagctgaaacaaatacacttggcccagaattagtgttcagtaactcttgcaatgctgatgaagaaaattagaactgtctataatggccacatggaaggaacaagtgtcacatttgtgcagctaaactgtctgctgctccccattcactatcaccaccatacatatagaatacactacctccattttgtccccatgaatacccagactcagaattcaacctctcttaagtttccaatgcagaatccactcctcttcaagcatgaaagagcaatggagacttcagtcaagaggcaggaggagagatagaggtgctgttacacagctcagccaacagcaagtcacctccaagtccccactagacactgtccctcctgggtcacaccagactgaattgtctccctctctgccttcctccaagcagccactgacctcaccagtttctctctcctcctccaaaactccaactttaaatgtcccctctttccattttgccatcaattgacatcagccatggtttcataaccagacccttcagcacacagctcacggcagatccctcggtgaacagaacctgtctttcttgaaggctgtgtggccagcacctttgattactcaagcaccacgttcattctctcactccttcccacaaaagtgtgtgtgatattgatcccagacataacattgagttctccccaagaaggattctgagaagtgaaattctcaccacctccctccatctacagtcacctcttcactgagtttttgctgtgagactcagagataatgactgttttccagtgtccctgcctggtctttgagcctcgcaggcctcaggatgtccctactccttccatctatgagccaaatgactcttgactgagccctagcttcatgccaggacaggtggcccaaacaaaacagcttccagaatcacaatgagaaatcactccgaatgcaatatccttctcagggaaactcctgacccagagcagacccaagaaagcaagctagggctttcctagagcatgggcctggctatggcgaccaattcatccctgtttgcccaggactttcccagtttttgcactgaaagactcatgtctcatgtacccctcagtctcaggcaaactgggatggttgatcactataagcctgtcccagtaatgatccttgacaaaaaccaagggctcatgaggccagccagtgaagccaagcttcatataagcagatcagagagatgttggaaacatacagagaaggggcagaatcagccctggttgcaggtgggcttaggagacaatctcatcagaaaagggcacacaagcgagctctaggtacacgggccaggcagcctcaggtgggctactgatgcatccaccatcagcatgactgatttctaccgtgcacagggcccagctcacacactgcagaaaattaggaaactgctgcaagagggggtccctatgggctaccacaggacaagaagaacatcccccgaagaccaccaaacacacactcactcagcactccccaggatccccgcatttgtagcccttccatgagtttctggtatatttccttaaccctcttctcctctccaagatgatggagggtgtgtgtgtgtgcgcgcatgtgtgctttagcagaggaaatgtgctacatcttcccaacaacccttctccactgcaaatcccactccttgaaaatccctccacaaaccactgtacacaaggaaccgagcctctcctccatgaccacgcgggagcacttgctgctcacccccacctcccaatagccagcctcctgcagaagaccctggggaatatcacgtctcataagcaaagccaccttggcccagacagcaaggcctcctggtgtgagaagtgggtggagactcaccaggactctgccagtcagtgtctgggcggatatcatcacccccgcccagtccttcacggaggtcatccagccgacctcggcggccactgcctcctctttttcatccactggtttgagagtgccatccgcctggcttgagccattgttaatcttctgggcctcctggcaacagagagagcaagagttaagacatagggaacaatggatttaaataacatgctctacccataaagaaccagagccagaaggggtccccagctgagatggaaactagcttaaaggtataggagtaaagcagaaggggtaaattatgcctttgatttttttaaagcctttatttaaaaaagaatattttctttatttcctcttaaaatatcttagtgaaacaaagaaggatggtattattctattctattttattttattttattttttgagatgaagtctcactctgtcacccaggctggagtgcagtggcgcaatctcggctctctgcaacctccacccaccaggtgcaagcaattctcacgcctcagcctccctagtagctagaattacaggcgcgcggccaccatgctcggctaatttttgtatttttagtagagagggtttcaccatgttggccaggctggtctcaaactcctgacctcaagtgatccgcccacctcagcctcccaaagttctggtctcctcccattttaaagaaaaagaaaataccaaagcaagaggaaacgcaatctgtctaagattagggcatgctgaggagggaggaggaaagtgtgggagatgtcctgtggtctttgcctacccagcctctatgccccttttcacagcagcacccccactttcctttaggaaaattatctcttcctctcagtctatgtagttcaaaggggacagatggcctcacattggctccaacattggagtcctttctaccccctgccaacagcaattgggccattaataatcacatgatccatgccaagccaataagactcaagcgtggaacatttgcaggaaagaataggaaaagtcatccttccctgagaatgaagccactgcagagaaaagtaaaagtaatagactactgatgtcatcatttgaacacccggatccagctgtgcctgaaatctacaccagacctttccagttacaggagacaatacattccccttctggcttaaaatgtgcttgaggaaacaaggctgatttcatcagataactgagccccacacaggggccgaaactgtaaacctttgcatacagtgagtgttctgcctggaatactcttctcccacagagacttatggcctgctcccttaagtctttgctcaaatatctccttttcaatgaagtcttccctggccacctgtttaaatttgcaacactttctttccaatagcacttttctgctttatttttctccatagcacttaaaaccgctaatatacttaataattcatttacttctttcacttactgtctgccttccccactgctgcagccttggtgcctaatagagtgtctgggacagagttggctcaataaccatgaatgaatgactagaaagggctatgagtatcagcccctcgttagctacaaaggctgggtttagtgttgccagataaaatacaggatacccagtaaaatttaaatttcagataaacaacaaataactttttagtataagtatattccaaataccacatgggacatgcttatactaaaaccttattatttatctaacaatgtacatttaactggaccccaacacaaatacccactgcaactatgactgcagatgaagatgtttaaaaagatgccagcaaattatgttcatcatttaaaactctggaattaattcccaaggcaaagccacactggggatcattgtgatttggagtaaggggaagaaccaaagacagtggtgaaaagctttgtctgcagtgacaaagggggcggggcagagggaggccaggcacgtgggaggcaggtggggagggtgcactggtgagtcatcctcttggggacttggccacggcaggcaggaagctggtcccgattcctgcttctctccctctggctgcctgtggctcagggaagctggggaagagaaaagtgggacctgcagccctggacgctaatattttctttccaaatgtgttaagccccacagagctacaatgatccaagaggaggcccaggagggggaggccactgggcagatgtatctgggggctgcctgctgacatgtgtgggacctgctgcccaagcctcccaggccagcctcagataggacctgttaggtcttgccctggtccctgagcctctgccctgtgagactctgaacaggagggtatttaggaggatggggaggccctgatacagggtcaaccatggtaactgaaggtgtagattcgggggaaaatccagctctgccaccgctgtgggacctcaataagatggggacagtactgccagcccctcaggcattgtcaggattaaacagtgtccaatagcacaaaacacaggttcaagcaattatcccagcaccccttgcttcttctcgtgcccctgacaccataaagcaatggttatcacaatgagcgggcatcataagcacaccagagggcttgttgaaacacagtgtgctgggcccatcccagaacctacattcgaaccaagatgtcaggcacttctgatgctgctgggcttggaagcctactttggggaccacagctcctgactaccctagtatggctcggtgactgctgaaatgagacatggatcttcacccccagctctctcctggcctctcccttcacccaaggacagaaccacctgcttgtttcaatattggacattggtggaggggtgaggaaaagaggagggcagggagatcgtcccacatctgaggctctagtgtttccttttgagtcaagcctcccaggatgtttctgaactggtccctggccaccacgtggggacctggaagatagctccctgctcctcagtcctgggggcccaagttccacagccccttggtagaccctggagaggagaaatcaacgtgaaaaaggctgggaggcaggggggccctccagtcacagtggttaactgcatcagtaattcatagcacaagaggtatgtggcagataatgctatttcgccagccctcttacctattgttttacaaggcattcattattttaattactttatgataggcaaggaaaaacacagactaaagggagataatgcccttgttattatttgcttacactagatgttgtgagcttaattaccatgtgtgggaagcaggactgggaggagtgatgggggagctatttaaagcctgatgccagccggccagactagccaccaggctagccacagatcttgtgcctggaggaagaggcccctctctccaccactgacttcactctggccaaagcacctcttatggggagcaggcattataactccatgctccaaagaaaaagcagagaaggttcagtagccttgctgggaacatgcaggggcagagtccattataagagtgttggccaccattgaacaagccagaactaggtgccagcaactaagaattaagtgttttctatgcattgtcttgcttaaaccttataatacatccaacaggcaagtgaaattatttccattttacagacagggtaactaagagcaggtatctctcagaaaaaggcacagagcctgagagctcaggctggaagcagagagcccacctgggcttgtacctgctccagaacttccaagctgatggctgtggcccatcaacccttgagtctcagcctcttccatgtaagatggggacaaacatgccgcctcattaaggtggtggggaagctgaagcttggcacagtcccgggcacacagtggttacagctgccctgatgaagcacccgctgatggggctggggcctctaagagtaatccactgaagctgcaccactttcatcaaccagtggccctgggaggcacactggccagagtgaacctttaataaataatcacagaatggaggataaggaggtgcaggttctaacactgttatcctccaatgagcaagaagtccctataaggcaaggtgctgtgactcctgcagggcttctagtaggcgctgtgtgaccaccacccaggacagctggggcagggattcccgcacagggtggaccccagacccagtgacatctcagaccccttctgactcgccccattagatcaacctcccatttttaagatgagaacgctgaggaccagggagaggctgcctcctgagtcccagcattccgttcttgctcctggccccacaggatactgcctcacaggggaacaaatggtttgttccaaatagcaaaggggatatgcagccacgcccaaaccttccacctcccactgcagaggaccctgtccttacacaggaagcacttcccagtaggggcagcccgatgtcagtcaggaaatcactgagtgcgtgtgctcacacatgtgtgtgtgcatgtgtgagagtgtgtgcatgtgtgtgcacgtgtgagagtgtgtgcatgtgtgtgtgcgtttgtgtgcacgtgtgagtgtgtacgtgtgtgtgcatgtctgagaatgtgtgcatgtgtgtgtgcatctgtgtgtgtgctcacacatgcgtgtgtgtgtctgtgtgtgtaagggagagaaaccccactggctgcagcctccagctaccccagcttcaggaggacaggccaccagatcttctgaaatgcaagaaaagatgtcttgggaaaagaaaggaacatggagggaagaatagggagaaaaatgagaggtgaggccatcgcgtggggaggccatctcagaaagaggaggtcctgcaggagccctccccctgcccttggcagctccctgagaaagggattcggccttgcactggaggccactctggatctgcctccaaccctgccctctctccccactagagccttgtgtaaagcaggccacagctgcctctcagtggcaacagtgacatctaatttcagtgcccacatcagaaggtggggaggaattcagggcaagggtgcaggcacaggaggcagggaacaccagagagaagagtggccacagtcccctcccgacacccaccctaccaggcaacctctcacggggctgtgcccagccttacaccctcacccctttctatgccttctccccattccctttagtggtgttccccacgatgactttttgttgacatggccgcagaggggctcacccttcctatgtcacctggggccaagggcctgactgcaccccatcacctggtgctcaagatacaaacctcatctgatgcgtttgggcatttcccgctgaatcacaagatcaaagaccaaagcttgagaagggaccttagcaattcctgaggatccccaccaccacccaactaccacacacacagtgtacagatgagaaaactgaggcccagagggaaagccacaagctcagggccacccagcccagccaggtgaccaccgggccaggaagcaagccccagttgctctgtttcccttatctcttgttgcctccccgataagacaattgctccaaatctagcccaagtgacagtcactctgctgccccagcctggaacctggagttcagggtgttcctaggactggcagaaggctccacctagcctggtactgggttcaggtgtgagggtcacgacaagggctaatcctgcttgtcttcaaagggcccagccttccccagccacgacagctgctctggtctagcacaggagagcaagcttgtgctaatcctaggaccccacagccccatccctcagatttggctgtctccgtctctcatccttgctgaattagacccagtatactgggactctcaggtctgtggtgtggcaggaagaactatgaaaatcaaaagatactctggaccaagtccaacttttctgggtggcctccagcaagtcatgtcattcctcaaaccctccatattctcttctatgaacagggatgagtcctgccttgtcaccctgcctgattcttgcaggagccctaatctggtaacagagcattgcctttctgaaagcaactgctttacaaacggcaggcaagtggagtcactgtcctctggttctgggcaggaagcagggctgctctggagaaagaagtcctgtgccacaaagccagagccctcacagaacgcagggctcaacactcagattcctacccagctgcaacttgcagggcaggtcccccgttgtcaccctgcaccctaacaggatgtcaaattgccaagtctcagcaggtgacctgtcatgctgggcacaccctccctgacagggtgagctgctgccacacctgctctcacccggttggactctctcacccccaggcacactcctgacacctgtcaagctgaaccaggcaccaaggtcactgcaggcaccacacctgctggatgactgcctcaggcatgagaagctggctgggcccgccttgaggggatcccagggcccctccctgctgcctgcctagagccaagccttgaagctccaagtctgcctcgggtttaactacgtgtcagttctttggacactggttcctcatccaggatctgggaagttgtttaggcaaaggccatctgggaagaaaaatacttttcaaaaatgtaactgaaatcatgtcactgttgtacccaacaccctcctatggcttcttggcccattcagaggacaagtgaagtcttcacacccaatcagccccactcgtgcctgtcatcctgcgagtctgccgctcactagctccacttcagatgcaatggcctcctcatgctgccaggacattccagacccagtcccgtctcggggctgtctgcactggcctctgcctctgctccagagatccccgtggctgcaccctcatttctctcgagctttggttcacatcctcactttgtccatgagctctccacctcatcccgacctctccctgtctgtgctgtcttctccggagtgtgtctgccacctgcttcctttacttcatcattgtgtgctgtctgcaagctgcatgagggaaagagtttttgtctgtttctttttgttttgtttgttttgttttagacagagtctttctctgtcacccaggctggagtgcagtggcgtgatctcggctcactgcaacctctgcctcctgggttcaagcgattctcctgtctcagcctcctgagtgctaggagtataggcatgtgccaccacacctgtttagtttttgcatttttagtagagatgggggtttcaccatgtctgtttcatttatggctgtatcttcaatattgaatccctgtgagctcagagtaagcacctgacaaatcttggtgggtgggagggaaggaaggagtgggggaaggaggagaggagggaggagagctacagcaaatggaaagtcagttcttaccatgcacaatctagaatagatattactagtaaatagtactactaacaataattatactatcgactactgttttttagcatgatcatagtaactctatgacgttggtactaatgtcctccattgacagatgagaggttaagtagctggcccaggaagacacagtgtgaatttaaatccagctgtctgatgccaaaaagggacacgtacccatcctgctgtcctcccgggaacagtgtgagcagcagacgggagaatgcatgtgcaaggattattggctgctgcaaagtgcccacgaaaggtttattaacatgaagagcactcaattcatgccacttctgggtactgcttgtaccatcacgacccttcttccagggccctgtgcctatggagggcagttccatcaaggacagagaaacacagttcctttctctgccaagaacctgcccggaaccataaattcacccttcgtggagcagagtatcacattggaaatgagcgtggccaagctgacgggctgtgaagccctcctgctaagaaccacggttctctatgcagatgctgctaaaggaagatttggcttcctccctcgccatgcgtatccttggagtccttagcacgctctgcccagcggtctccagcactaagaggctgagctctgccgggcctgacgcacctgagtgggaggtagggttctgacagggaacaggagagatcaggttagcacaaaaccatctccgctagcccttttgggaccagagtaggggctgggaagcccctctcatccctggaagctggatgttctgcccagcaccctggaaccatgggatagtcccaggatgcttgacccccagagggctgtgagagaaggaagggcctcatgcctcacagcccctttgtcctcaaattttcctggtcaacatcagaaggccatttcccctgagccttcattgatggactgcgctctgagttactcattccatctgccaggagccccaccccaccctctccctggccactccattgccccatctcctctcgtctgttgaaactgacccagcagccccacatgctgctgtcctcaactgggcacaatgcagaagggctccttctctcctaccaaagggtgggggcagggggaagccttctggaccagaagctatgaagccaggcacaggctgtgtgccctgggccagtcacctaacctctctgagaagagtccctatctgggagacgagagggggtggtgagttaaatccacagttttctgtaccttgaggcccagcattgtgaggtgccccaggggggctggttaccaagggagggcagaggaggcagggccccggaccccgcggaaataaaagcgcctctgcattgagcaatttcacctattatggttctgtgctagactgcatctgagtgaagggattttctggggaaaaacattagaaatcccctgagtaaaagtccataggcccatgttagcttttttttgttttgttttgttttgttttgttttttgagaaagagtctcactctgttgcccaggctggagtacagtggcgtgatctcagctcactgcaatttctgcctcccaggttcaagtgattcttgtgcctcagcctccctagtagctgggattacaggcgtgtgtcatcatacccggctaatttttgtatttttagtacagacagggtttcaccatgttggccaggctggtctcaaacttctgacctcaagtgatccacctgcctcagcctcccaaagtgctaggatttacaggagtgagccacctcgcccggccccatgttagctttttaaaaaatgctttgtttcatgacaataactatgacatcctgtggcacagtttggcctaagatccagaagtgtctgaacctcaataccttaggaagccctggggctgctggtccctccccgcgggctgctctcctctccttcgcctcaggttttcaccagccccgaatgctggggctgggtcttccgtgtcccccctcccatgccaaagaggacatccacccagcaacctctttcacctcctgggcgggtttcccagccacgggcattctcccaggtaccaataatcctgcatattagggtattaggcagattacccaaagcagctcaagcaaatcaagcatagcatgggcaccaccagctggggttttcatggcaagagttctgcaaagggaatggatggaggaggtggttactctgagactcaaggaccagagaaatagggcaacaggggacccaggtctttcctagagctggtgtcaggagtggcagagttcacttctgcccctgggaagttgcatagtccaacctctccctggctgccatcacttctcctgctctgcaccccggagactctgcaccagcagggcttaagacatttgcactgattaattcacctagcagttactgtgtttgctaactgtgggctgtacctttagggaagggacacactgtccacagattcaggcaacaggaacttataaagaagctgggacctaaccgattaccccgagctgtcagaaagccctgtgagtttactgggtgtctcggctggacctacagtgctccaccattgaggcatttttagccattgctttctgggtgccctgtccagattctcactcttagaagcacccctgcgctgggtgtgaacaactactctttggaagtcttcatggtagaaaaaggccaggtgacctttaacaagtccttaccatcttgtgcctcaggtttctttgtctcaaatgcagggagccatgtaaacactccccaaggtctgtccagctctaaactgtctgacccggaggcctggattgttaagtcccttactttgcacgcactgtctcagctctgtaaccctgggcaagtcaatcaagcatcatttccctcccccgggaaatgctgcaggacagattccttttcagctcttctcagagccaggttcaaagctgctctcccattccctgaggaccaagggggtcaactggtgctcaggagatcactgatcccctcttacatctactgtgttctgtccttggtgattttacaccaacttaatcttcacaagaagcctgcaagataggaatgttttttctttttttcttttttctttttcttttgagacagagtctcactctgtcgcccaggatggagtgcagtgatgcaatctcagctcactgcagcctccgcctcccaggttcaaacgattctcctcctcagcctcccaggtagctgggattacaggcacccaccaccatgctccagtaattttttttttcctagtaagatggggtttcaacatgttggataggctggtctggaactcctgacctcaagtgatctgcccgcctcagcctcccaaagtgctgggattacaggcgtgagccaccacgcctggctgcaaggtaggaatgtcatgaggctcagagagattgggtaattttccaagattacccatcttgtaagtggcagagctgaaatttcaatctagtccattctaactctgaaggccatattttttctctctattccacactgtcttgggataggtccaatgtgcaagaacagagatggaatctccatataaaattctgtttactactactactgaaacaaccatctcacaacctatggcttctaagtaacaaaatcctgtagtacagacatctaaattcagttataatccactatgtacggacagagagttggagaaatgggctaggggacggggatccaacctgggaatacaatgctcattagacattagatatgttctcaaatggccacatatgctgcctaaaattagtaaggcaacctccaaactttcagggctaatacatacatcctggccaatgtgccgtatttgtaaaataacaatctccttctctttcaattagcttaataaaattggaaaatataagtgacagtccagagtccactatcagagccatagagactttgaattggattagtagagtcctcagccaggatgaccctggcagggtccaagacagcctgctgtccatcagagactcggagactcagctgccagtctgcagggcagcccatcctgccccagaagctcagctcaagacctgcccagacaagaaaactgtggcaggggcccagcaggaaggcaaaaattacatttgtttctcatcagggcagactgggatatggataaccaaacacacaggaaatcccaaaccctcatgttcataaaagaatgcagaaatcttcgtgccaagttaacttttaccggagggagcccattgccatcctgtagaccaggaggaggatccagcccccaaggagcctcactctcctcagcaaaggctcctgcaggtagctcacaggtgctctgttcccatgggtcctgcatggccacagggcagtgctgcccctgatgtggtacggaatgaaaagcctcagtacagcgcactgtgtgtgtcagtggaagacaactgatgaagggcctctcccaggaagaactgtccttttctttgacattatatcgttactcctttgttgggtattaacatgtccttttaatgaaatgacaatggtggcagagctggcatttgacagtttctttttttatgtttttgcttgtcaaaataaaaagctggtggccttgtgatattctgttttataaaaattcattgattatcccacaaaaagtctaggaaccactcccctagcccaaatgcctcattctacaggcaggaaatttaaggccccaatattccacactcatagtggccaggttcccctcgaaaaatgtggctttcagacttcaggggcccagggtgtgtctgtcacactagccagaggcagccttggggccaggaaaggtagggtctgagggatggaggcatggtctctcagggctggaggagctctgcaagctgctggcccacacaataggggaaaggggaaggcaagcattttcagagctcagggccataccaaccgcctgagttcctggcatctaatgccttcactaccactactgcaggaaatgcacagaactataacaacctcccgggaaatactacaagtgttaccgtggccccaagccaccacccaaggggcaactgggaagaaagaattcaaccacagatagcagataggatgaattgtttatggttgaatattcccttcagagtcaacagaggactccaagcaatttggagtaaaaagatgagtaacccgagagcaatgtaagtcacagcccagtgccccacacggaagggaacacggtcatccccttcgctgctgttctttgcttcccaccactaccaccttcatcacacacgtgtgcttattctctagcagtcagggcagagtctgcctgatttgcccactccacatcctcaaagcctgaacagcacctagcacacggtgagcatttcacagtgcactgaaataataaatgaagaaattctgttttttgttctgtcctgctttgttttcactcttcgctcatatcttctggaatctcaaaaatcctgccaagtccacaatgccctaagcatagaagtcaaactcctcaaggcctgatcttcaaggcctggagctgaggctgccggctgccctccccactcgtcactgacctgctcttccacctgacttctcggctatgacttggtcctcctgactgccacacctccgtgctggctgttcccactcctgggatgctctccccattgctccccaaccatcttcatcctccctgatcaaatcccagaggtgcagtgaagttctccttcctggctagatctccccaaagctctccctgtcctgtctccagggcccacatctgctcccccaattccacatgggacaggtacttagctgtcttttggtccatgcatgttgcattgccccagttagcctggacaatccttgaaggcaaggcctatataccttttatgcccaaagtgtttggcatacagcaatgtgcttaacagacacgtaccgattgagtaaattaaatctctgctcagtgggcactggaaaagcaagagctttcccaggcatcactgacgtctgggtaaaccaggccagtttccatgacttgaagcttaaactgggggttggctcctaactgctgttcctcagggcagctacattttcaaataaaaacactaaatcccaaatgagatcagatgacatggagcttctgagaggcacatgccctaccaggcatgtcagtcaaaagaaagatgaatgttcttgtttacaaaaggatttgtcccgtgccaggaaaatttccaccatgatttaggacctaatccagtctgtgcctatagacctcaccaactgaacatgttcccgcttcttccatttgctgaacttggatggggcttggcttcgggtcaaaagagctgtcccaattaggtcgtcagacagcctttccccacacttaagatgatccccattcaggaaaccaagggctagcaagacagacagactttgggaggcagaaagatggccaggttaccaggcatacagcggcagtcaggatctaccgctccgagcacagcccagcctgaggaaccaggctcccagagctgccctgctccctggactctgcctctgacctcaccccttggaagaactggctgggttccaaaacttcagcctctatgtccctgggttcccacacaccctagtttggatctaggtctccaacacagcagccaaacacaagagagtccagagcagttgctaatgtgaaataaaaacaattcaacagcccagggaaaggagacaggacttctttttccattggattcagagaactccttctccttttccttctcgatccctaatgggagttaaggatggcaagcgcctggccctgcaaagcctcaactctctacttggctccgctagacccatcaatcttctctccatggcctgggacccctccaaccctggacgtcgagagagactcggcagctgtgagaaccttctttctcaagtaaggtttttttccaaaattatatcaggtttccttctaccccagcttgtcagtgggggactcttttgcctaacatggttgaggaatgtcttagaaactggtgtgattcaatctggcttctgatgaggttttccacccagacagagctcaccgagtgtctggaagtgtcggttccctacacccaggggcatccacaccctgtccccatctccagacctcagtgaggaggatacccttgacaaagtggctggtccagccctacgatgaagttggatccagaaaaagagccaagaggaagccaaaaggacttgcccacacacttgcatccacgggggcctccctcctaccatgtcccctctttcccccaactttctaaattggtgaatctacttgcaacacacccagtataaataattgaagagctcccgatggaagtggctcaataattgaaatctcaaaaggcacacacctttcttttagaagagagggccacctcattcagacttctccaggggaagtcgttcttcccctcattccttttcagactggcctccttctacaaatacagattttaaccagagggtaattgttagaaagtgcagtttgcaaaaatgtcagtaacctgaatgccaagtttactaatgaattgtgactaggctgttgttagtgccgccacactctcacctgaagacccacaatctcccctggacagagggaaactggctgtccctctgttactgctcagctactgcactgaggtggggtggcaccagggggactggcatgaaggtcacatgaggggagagttccttttacatctcagaagtctcttattataaggatctgccaactgcaaggagagaagagccctgcagagcagagggacctgccagagcgctgcaggcatcaactttgctggcgtcttggaaagacgccccacgtctccataacaactaaccatccagcccttagcactgacagggatggagaccttttttggaggagcagatccggaagaaaggtcaggtggttacctgaatcccaagtctctttgttttgttttgttttgtttttctccttttgcagctgtttttcttactagaagctaggcagaaagagttgttactcagatttcttgaacttgagacgtcaaaggtgagacgccagccaaggagaagggatggtcagggaagcttctggggataccgacagtattttattttttgaactcagtggtagtgacacaaattttctataataatttgctattttgtaatttttcattttatagacttttctgtctatactatttttttaaagtctttaaaaaataaattgggcaaactgctcttcagggacccatcgtcattgccagcatttattaagtatcttctggcacaggacagaaatcagtctgcaaatcaccctgtgtcacagccctggaaagcaggactgagaaccagaaaacttcagtggaagtcattggtcccagtggccaaagcaccaaactgaagaagaaagtgaagaggtcaggggcaatcacaacaagtcataggatcaatgggctagaggccccagagaacttgttgatgcagtttgctgttatcccagctttagagctctgcctataaacaaagtcatagagaggggaatgtgattcatgatttgtacctgccttggaagggcctgaagtgaattggggtacgcagggccctggccatcagtgaaagagtgggtcttctgctgccctgctgatccactgctgagggtaactcatggtcccagcacagccttcactgaactgtcaggcacatgaagcaatcaggagtctagattgagtttccaaaacaggagcacctctttgctctctgtaagcctccactgatggctcatgccagccacatggctcccctagcctcccctgcacccaccggaggctgttaatagacctgtcattgtgctcatgttggattaatgaccactgttctccttcccaaatcctacacattgtttaagagaaagcctaaacgctgcctctgccatgaagcctctccagacctcttcagtagagctaacgtctccagggctgtttgctcaatacttcctttcaggtatcagtcccctcagatatcacttgtttctctgcttatcagtcctcattacattctagtccagtggctacatccatcagtctcccggctaagaacctgaggtcaggagccagggcttattaattcttatatttcatagcatctagcactgggcctggtggatttgtagcaggtgtgcaacaaacaatcaatatttattaatatatcagggtccaagagcacagacccagtaaccaggaaggaaggttctttaggttgtcagagaacacaaagggcctggcaggagggaggccaagcatcacagagaaccttcacctttcaaatctacccacttctctccatctcagcttctctcccctggttgactcctaagcttcataatcatttacattgtatcatgcaatggtacaattcccacttagttctgcccctcattctccacactgaagccagagagataccacaaggtttctatcagtcacatcatgcctgtgcttaaactcttctcagggactcccccttgctcttaggcaaaagttaaggccctcagcatggccgtcgaagatgctctggcacatctggcctttgccaggcatctggccacatactgaaatactcttggcctcacctcccttaatccacagcaatactggacattcttgcattccttcaatgagcactcctcttttctaattcagggatctgcatgtcctaggtttccttttcctgtaacaaccttcttcacacagtcatattccagatgtcctactcatatttaagatctctccccaggaagcctttcctaactcaccctccacctccactccaccaccaccattgctatcagtcaataaaaccttccaatcatgtggtctttgcactgctccttcataacactcaaggcatttgcaagtacttgttcagggcctctttgcttcactagactagaggtgggcaaattgtttctgtaaagggccagataggaaatattttaggctttagcatatggtctctgttgcaactattcagctctgttgctggggggcaaaagtggccttagacaatatataaacaaaggagtgtggttgtattccagcggaattttatttagagacattgaaatcagaatttcataccatttcatgtttcatgaaatattcttcatttaaaatttttgttcaactatttaaaaatgtgaaaaccattcttagctaatgggccatacaaaaacagatggcaggccagacttggcccacagcctgtggtgtgccagctcctgcactagactatcagtttcctagagacggaagccacgtcttgttcacagatgtatctctccagcacagtgtcttgttctcacaaggcggttcataaaaattcactgaatgccttgatatgtggactagagccatgtttcccagtgtaaattcacggaacaccagtctgatgggaaactccatacaaaagggacacttctctttgcagtgaaatctggaaatgccatcattcctcttctaacaaatgttcaatgctcactgcatacagcatagcaaaagctcagagatagccttcagtcaaggaacctgttcaacatagaccaatacaatgctgcccacactcattttgaccaaataactttcttctttaacccaaaatatctgccagtgtccaagggcagccccactgaaaagtgatgcagtgaggagagacggcagaatttagaggaatgggtctcaaactttagtgtgcatcagagtcaccaggaaggcttattaaaataagaaactaccccagcccagagtttccaattcagtaggcttaggttggagcataagaatttacatgccttacatgtttctcagctgacgctaatgctgatggctaggggaaccccgttttgagaaacactgatctgcagaataaatgatttcaaggcttcggtcctctagctggagtttgctcctccatccaaggatcttattcccaggtgaactccaacttgtccactttctcacactggcagtagcagctctgacccatctttctagtcttaggcacctgtaatgggttgcagtgtttttttccaaaagatttgtttcaatagtaatccccagttcctgtgaaggtaagccttatttggaaagaaggtctttgcagatgtaatcaagttaaaatgaggtcatactggagtagggtgagctcctaatccaatatgactggtgtccctaggagaggaggaaagagacacacatagggagaacgccccatgaccaaagaagcagagactggagtggtggctgcaagtcaaagactgccagccaccagcagaaacacggaagatgcaaggaaggagaaaccctacaggcttcagagggaggctggccctgctgacatcttgatttaagccttccagccttctgaactgtgagacaataaattaacattgttttaagtcaaccccgttgttatggcatcactaagaaacattctagtccaaggacagataaagctctggccaaggccttattcttggtaggtgtccacatgaactctgaaggaggaagccacgatgtcagctgtctgttccctttgtcatcactgctagacagtgggtgtctgcgctggggtctgtttttggaaattagattatctaattaatgtgatgttttgttggatccatgccttagggctggatttggcaaaaagcatgtgattattttttactcttaaaaaaatgtcactaaataagataaggagacttggctttgccctatcttgggctccacatgtcctgtttctcactgagagaccctggcaaggagtttctcagtgacaaagaaatggtttcttctcctctagttctgagctataaacaccttctctaatcgacatagaaacggctaagcagtagatattttcagtcagagtaccccagttttagtcataaattatatgcctctccttttggaaatataaggggtataatttttattcttgggcagacatagtcctgtgcccgataccttaggaaagagccaaaaagagaatgtggacacagcttgtcatggtggatggagaggaaggagacaccaggggtagggactctgtattctgaagctctgaggccacaggatgaaaaatcagagccaagtgaatgccttctctgcctctccaatccatgccaacccagggctggctgctcacatggggtctgcacaaacttgaaaatctccagatgttttataggggggacaaagccacgctttctgctgcaacagactgtgagacttttaggatgctcaccccaaggcccttgaaaaatgagagaggggtctgattctttgagatgggtaaggcagaggcaccccgtggaagtcaagcattccttctctcttccctcccaaggccagcatgtaatttcaaatgtccagtccatccatgaacaatatgttagcctttggccaggcggtgagcttccaaaatgcaaacatctcagcctctgtctgcagaggtgagaattcagcttggcagaggaatgggacactgtcaaggaagacaagcttttggagtcagacaatcccaggtttgcatattggccttgttttgttggtttgttttgctttgtgttaaaatctaatttattctgcaaactacagcaggttagttaatcctttgaaacctcaggtttctgagctataatacaggaataattataagtgctttgcagcagatttgtgaggattctgagagttgttggatgtgtctagcacattccttctaacttataaagcattatatgccaagtatgaatctaagtaatgcacatgccctaatcttttccatccttacaactatttatagcactgcccccatatggcaaatgaaggctcagagaggtcaaggcacctgcccacagtcacaaagtcagtaagcagctgattctggagctggtgctctcaccacagggactgctatatacccatagtggaagcctggggctaggaatgaagatctgtgttcattcattcattcattcattcattcaacaattcacctgggcatctctgagagaggattactcacaacaggttctcagacaaaaaaaaaaatacaatctctccttccaggagttgaagatctctcaggggaaacagacaagtacccaaaactaaatcaaggtagaatatgacaccagggaggaagagagtatggcagaggacctgttaaatggcaggaacagactgatttaatgaaggtggtggtatttctgctgagcctcaaaggataggcatgattttgacagatgcactcagcctggttcagtccaaattagggcccccttgttctttctcatcacaacccattcatttcctttgttggactcactgtgattttaatttcacagctatttgctgatttatttgttcaatgctggtctcccacactagaccatgagcaggaaggagaggcagcatgcaactgtgctcgttgtctacacagggcctagcactgggcctgggccagggcaggcacctgggaggtatgtgctgaataaatgaatggatggatgggtggatggatgggtggatggatgagtggatggatggatggatggatgagtggatggatggatggatggatggatggatggatggatggatggatgaggatataagtattggcaggctggtggcagcttgcagaaggagagcacattatctataaacacattgccccgatttatttaacattgtagtcactccaaatcttggttaccctcacctgaattttctcttttgggggaagttttacacaaccaccccagtttccctaaatgccccctccctggattcctgcagcacttgaatttaggcttctgagcactggtatctccccaaatagatgagactccccatgtgggcagcagccctgccttctccttcatgtttgtccacagtgcttgggtgagatctggacatgtagcccacactctgttgaaacctgcccatggcatgcagctgaggggccctgccttctccttgtcctcatttattgccatcagtcaaccaccaatcatcccacatcgaccccagaggcattggtcttggggtctccctggtgcggcaatgtgggctgccttcccagccttgtccaggtggcaggacttctgctgctgacaacagggctgtgatactcagctccccaaggctgaactggatgactaagagtcctaatgattctggtattttttcaggacctgtctccaaaggcaggaggacatttaaaaatgcatgggtctctgctaggtgacacatcctgcttaggagtctgctggcctccagtctgggacaacagagcacttcaaataggcacctgtgttcatcgcggtgctttctgtccacacagggccttggtttctgaggctgagagaggataagctaagcaaggggcagaacaggacaccaaccatctccagaccccagtacaacacagatggcaggccaaagagggactgtgtcgtctgattcaagagtacagactacacagccagaataatcggggcctggcttggactctctttaaatattcattcctcatctgtaaaatgagcatatgagtcccacttcaccagactgtaggacatacgtgaaggactctgcagtgtctggaacatatttatggcccctgaaataaacagttattgatgacagagatgaaaagaagaagatccaatggagtaatcttcaaggcctgcttcaagtcttgccttggtaaagctttctattgggcactcatataaagcttatatgacttttttttgtatataacagacatgtatatatgatgactgtctactgggtatggttctgagcactccctaaatagtaactcattgaatcctcacaacaagtttatgtagtatgtactattattatgcccattttacggatgaggaaaataggcatgaggggttaggtgaacgactcgaggtcacacagttataagaggttgagctgggatataaatccagacagtctgcgctagagttcgtgttagttaaagatggatacagtgtgctgctgttattattcttgtagatgttgactattatagtctcttgtcttgcggagcagagctagtctctctcccactttcttgacaaatggtaggggcctcccctataacatctctgaagcccctgcagcacttcatagagccagtcagagtgagtttgctgacccacttgccaggacttgctgtgccctctgccttcttcaaggcatccccagcagagccttaaagggcaaagcctgcacacctccctctgcagcactgctgcatgccccacctccttccagggccacgctttccaacttgtgacctggacccaaagtaagaaatacattttacatcgtgacccacacatacctactatacaagtaattgcaacacaggattcatgaaacaatacctacactattacatggaatgtactttgatatcctgtattttttaacattgattacaactcactaaattgatttcataatccacttagaaaattcctcttaggggagttcagctccaacatctagcacatgcaatttctgagtgcagtgcacagcaattcttcccaaaggcagcccttcctggtgcacatcagcatcatggtgctgtcccagcccagatggtcacttatatattccccagagccctgagcctggctggagcacccaggcagtggaaagtcaatacaggctgggaatcaaggacccattcaaaacaatgctcacagcagacacagagtgaagaggcttgctttagagtatgatagaactgagctcaaatctcacctctgctagttactaactcagatgttattggacgggttcttaacctctgtgagcttcagtgccctcccctggaagggggcactatcaatatgcaccacagagggtgttagctgagatgtggagatgacttggcacagcacccagatacagatactgaatcagtgccagtcagtggtggtgggaggtctttgctaacacctcacaagggccttccctcccctctctttttgtctctatatttagagattctacaaccttcagaagaaatagcagtacttcctagcacataggtaacactcaacaaatgtctgaaccaattaagcaagggcccaggcttttgcccaataagtcatccaatcctgagcatccatccattcatttatttatttatttatttatttatttatttatttatttatttattgagatggagtctcgctctgtcacccaggctggagtgcagtggcatgatctcggctcactgctgcaacctccacctcccacgttcaagcaattctcctgcctcagcttcccgagtagctgggactacaggtgcatgccaccacgcctggctaatttttgtatttttagtagagacagggtttcaccatgttggccaggatggtcttgatctcctgaccttgtaatccacctgcctcggcctcccaaagtgctgggattacaggtgtgagccaccatgcccagctctaagcatccttttgaaggaagatgtgttttataatcccttctaaattcagtggccaataaagtctgctccgtgaattacactcattcaatcacagctgatatctctagatcaaggacaatgcccctctctacaggtgggaagacaaaaccaggaggtcccaatgtggcttctccaaggttcccccaaagttactgtcagtgcagagctggggtgacagagcccctgctcatcactgcctatgttgccttccaagagagaagcaagttgctcaataaatagctcatcaccctaaaaataacgaggtctctgatgagacttagtctctaatgaaactaagcacaggactgagggggtgaagagcaagcagaaaatggatttccaccatgggctagactgttcacgtggcccagtggtggagagaatccttagggaaagcctaactccgaagcccagagaaggaaggaaaactaataaggagtgtgttttgcaggctgatttttctgaagttatccataggaaaattcatttatgtgagaggctaattagtcatgacagtgctttgctccagacataattgcattggtcccatgcagtctctgtgggtcagcctgtaatggaatttccattacctattgtgttttggttactggagaaaaatgtgtgattggggaagaaagagggatgaagagaaaacatgaaaggctggaataccttgaatatccataaaaaccatctgtgattttaaaacttcataaagatgatggatctctaagagccagatagtcttcttggaatctgagctctgtctgcgggaactgctcctggcaggcagtgggttttgaaatccaagtttgtcagaccacagagcaaagcgagctgccccagcttggccactaggggtggaaacaagacccaggaaagggagactaaatgttcttctcaactagccaccagctctcaggctgccaggaatgctgggctgtggtaaatgaatatatagatatatagatatatgggtctggtgccagaaatgtgcaggtctgcagggatgagtatgaaaggcctcacctctcctgccttctagagaataatatacagttcaagagccaaagatgcctgagggtgaactggtatgccaagttcggaagggtcaccaaaccacctaatcccccaagtgttagagccaggaacagaagggggttttaagttcagggtttctcaacctcagcacaattgtcactttggctagatggataaactttttgttgtgggaggctgtcctgtatattgcaggaggtttggcagcatccctggcatctatccagtagctattctcctccattccacccccatccttaattgtgacaactaaaatgtctcccaacatggccaaacgtcccctcgagggcaaaatcgccaccatttgaacatcgctggtctacccttacaattcccaaagtagaattccaaggaatattaatttcataagcttctccccaacacaagtattctatggtcaactaagtttgagaatcactgcatattgtaccctcttttggaaattccccatagtagtctattaaaggccctaaaaagttctgcaataagaagaacactatttaattgttttgtttgacctaacatcttgcaagctttctcaaacaaaacccctttattcctatatttgcatctttcagagttcctgttccaaagaatattgtgatttatatatatgttaatatgtatctatcatatatgtatatatatgatatatcaggcaacccaacctttccattgaacaagaggaactgaagcaataagcaagtcagggttcaaaatcctactaagagatgagtgtcagagccatgcatagaagctgaagtcctgattcccagtctacctccttctcttacacaaatgatttagattaatcctcaagaagatacaagatacaagaaaccatcctctcacagccatgtcacaatttggtttgtgaaaggaaagtaaaatcttgggaccctcaactcactatgccaaaagaaagagtgaactttgtcatgcaaaagctgctttctctttgttcctaaacagattgctgcaagagagaaggtcacctatctccccaggtagcctctctcaccctgacaatgtatcttcacaggtaagggacaaagacaagactagaaatcatccctctgcccacctcaagacaaatgcagatctgacttcttcttcctctactctatgtttactttatcttatgtaaaatacaagatttactgagcaggagccgaatgcactattgagtgtccctctttttgctccttcccactctcctgcctttaaatactgaagttctcaaaaccctctttggaaaaagcacaggccacagagtctactgtagcctttatctctttttcctgggctcatcctcaaccttggcaaaatgaacctctaaattgattgagaactctttcagacatgttttggtttataggctccaccaccaccatccagaatactcacctaggaacaacgcctagtgaaacatcagcatttctgttccccaggagaacagacaaagcaggcactttttgcagacatagttgagaaggacctcacagtggtcataacaagggagggtgcaaggaggcgccatccacttacatcatgtccatgcacctgctaatctactataagtacaactcccatgagaatcactaaagctgattcgtctttgtatcaatgcaatacatctttgtattgtggcgagcacagagtgggcctccattaagttaggtggaaggaataaactgttaggcaacacatgctaaggacttgtccatcaacatgccttgattataattcacagatcgtcaccaacacaataaagcctccccaatcctctctgtcctcttcatgattttcttgggaaatattctaccctggcctctccaggctgcagggaactactccttttaggatggcagctccccgcttccctgacacatctactgtcatctcttcacttgcgccagttcagaaagataaaagatcaatttccagctcagatcagccagcccaatgtccctcctgaagacagtacatcaagggaccagtttcctatcattctaggtagaaaacatgcagtgactggtcattcagtctcttgatggtctctcttgccaaaagcaggcactggagaggccatagattggctcccattctcagattgcaaacaatagaactaatattgacagagaaactggatggtatgacattctacaattttgcatggggattgaaatgtaatcataccttgaggcctctggtattccaggaatcctctttcagccctgggaacagaacagtgtcctagggatttctctaatccttttatgacattctaagcagagtgtatggatgcaggaacagccaagagtctcagccagagggcagacctggggccccctcttggtttaccttggctccagccagtccaaagaatacacaggcagcttgcagaccactgagttgagactaagggctcagccctagggcagctgcaacacaaatgcagcagcaactgctagatatttgcagcatgcccctgaagtctggtctgttgtaaaaaaaaaaaaaaaaaaaaaaaaaaaaaaaaaaggccgggagcggtggctcacgcctgtaatcccaaaactttgggaagccgatgcggatggatcacgaggttaggagattgagactatcctggccaacatggtgaaaccccatctctaaaatataaaaaattagccgggtgtggtggtgcacacctgtagtcccagctactcgggaggttgaggcacgggaatcacttggacccgggaggcagaggttgcagtgagccaagatcgtgccactgcactccagcctggcgacagagcaagactctatctctgaaaaaaaaaaaggctcacagcaaagggtgtggaggttgggatgctcagcttcggggcaggagaagcatacagcaagcctctcacacctgcaggactccaggctcccagagccacagctgcactctacctctctcctttcctttccccttctgagcaccttcgggttactgggataaagtagtgcttaatgagaggccaaagggactttgcctccttgaggctttttgattgctttgcacaaaactcatagaatcaccttatgttccttcacttaatcagtcacttatgagcactattctaggcactgcgtgaggctgggaaggccctgctcacctgttactcttactctgttatgctcttcgtaaaatccatcaaaaacaagcagtcatcctgcttctcttatttccccatttcacaactgtggaacccaagtacagccatccagtgtcagactcatgaacttcagaagcagaagcctgaagatgagctttggagtcactgtcacagcaacaagccaactggcatgcagaaatgaagagactcactcaaatgagggacctaaatcccttctatggtcaatgagaaacagaggcccatgaaagggaaaggccagatacaccctcacacaaggaagtggtggcagagccaggcccagacagcagagatctcaaaggtccccattttcaatgttgtgtttcttccatactgtcatttcaaaagagccatttaaggctgggacactctggtcccactcaaaaaaaacaacaacaaatcattaaactttcaacttttaaaaaactaccaaacaggttgcaaaacactttcttatcctacacctgggcgagagagacttacagagggggaaggggcagggagggaagaaggagagggtcatgaatggtgagggggaagggactgagtgagggtggaagtgttcatgattgggatggagtagagattagggagccttgaacctccctgaaggtgagaaaagatcacggatatctgttcatgaatttaaaaagactccgcaacttcatattcagagaggagcaggactcaggaatcaggcaatggtcatgaggtaagtttcaatttttcaaaacaaaggtgatttcatttttaaaaatttgttgtttatttgtcaagagaaactatttatttttatttttattttgagacagagtctcactctgttacccaggctggagtgcaatgctatgatctccgctcactgcaacatccacctcccgggttcaagcaattctcacgcctcagcctcccgagtagctgggactacaggtgcacaccaccacatctggctaatttttgtatttttagtagagacagggtttcaccatgttggtcaggctggtcttgaacttctggcctcaagtgatctgcccaccttggcctcccaaaattctgggattacaggcatgagccactgtgcccagccttaagaaaaactatttcttaagccacatattcatgttttatagttcaagaacacaggtcagtgacaaatctctaggtaattcttcccaaaggaatactttatattccaaaatcactttgcactctgaaagatacctcatctcctcaaaatctttcatagaatcataatttctgtagaatccgtgtatgccttcttttttagttcagccacagcaaagttacagagggttgcaacccccagggaaataacaaatgcgccaacaatatgaaatcacagatgctcagccagaaggccatgtatctgaggttttgtcaaagcaccggaagccacagtagttattatgctcaaaaggtatgtcagcctcaacaccagcatccttcctggctgatcgatttcattttttgacagatgagtttgacaccgccaatcagtggcaccaagggactgtatcataatatcctaatggtcccgaggctgattcccacgccacaagggtaactgcaattccatcaagccacagccaaatacagaatgcctcccatttaggaagctcagttaaactttttatgtcaccaacacgccccaacctcagagttgtcccttcctcactcaacacacgggacatttatcttcaacgtcaccacctagcttcaagcttccttcggcttccccaaccacagtccccactaactacaagctcaggccagcgctacagcctgctgaccactggcaaggggccttggcacatctagacatctgcagccaggcctgcctctcaccttctaggctattttctctgtagaagaacaaactgcttgaaaatcagactgcaccagaacaggcattcttcctgctgctgtggaagtgtgtctcgttcctgtggaaaggaggtatcttgttctggacagtgtgggctggagctgctggcggtcagaacagggaagatcgtgttcaggaagaacaccatccctgagagaaccagtctcccgacacacatctcaaggccagcctgcaccagctcaaccctctcctaagcgagaggctcccctattagcgtgatgcatgtcttggaccattatggattgacatacattcttttgtatgaagatattcaatgctgcacatggcatctctcacgacaggacccccgaacccagaacacagctgctgaggaacaggtgctccatcaatacgggtgaaatagatgaatacgtccaagtgccggtgtcgagcactggaaatacaaggacgataaagacaccacccctgcctccaaggagttttttggctagtgggagattcccccttgttatttgtcactggtggggtcagaaatggagtcaaggtcagcgggttttggactaatctagaagaaggactggatcagtgcttcttaaatgtgttattcacatactcccatcacaacttctgccctagctgcatgactcctatgctattcactaaacatttttctttcaatggagtcaaattttttaactaaacaaagatatcttttttggggagagagtctcactctgcctcctaggatggagggcagtggtgtgatcataactcactgcaggctcaacctcccacttcagcctcctgaaaagctgggactacaggcatgtgctaccacacctggctattttttttttaattttttgtagagatggtgtctccctctgttgcctaggctggcctcaaactcctaggctcaagcgatcttcccgcctcagcctcccaaagtgctgagattacagcaatgagccactgcacccagcttaaataaatatatcttaaggatactccgtaacattaccacatgtgaaaaactggtatcaccagtgaagaaatagaagataaccttcaaaataaacaaaatagaagaaaactttcaaaataaatgcaaaacaaaaccagggtatgaaattctaggtagatgcctccgtttgcatgcagtctcaatgggggctgttctgtgcctttgttcaaaagggagacaggcaagggttaagagatgttcaaacagtaaaccgagactttctccctgagataactagaaagactggaagaaaactggaaatgaactaaatccctccttggtgactcagggtcctgtccatatatcactagaaggtatctgctacaccacctgtggtgtggggaaaccataaagctgaaatgagctttaacatttctttcaacatccaggtcctataacaccataagcagattatttaatgtcaaagaaatcaagcgcatggaagaaagacagcacctaaacaacacaggtctgttgactgaattagatttccaaagtttctggccctcccagattcattatatcctatggtcttcgggttacaaatgaggacagaaaagcagagagagaggagggaatgtacccaacccatccacctggcagtgacagagctcagaggtcttcattttggatgaaccatgggacccagatgcctatgaaaggggaggacttgtaatctttttattcccgatcttagactacctgtgtgtgcaatatgtgtttccaccactttgtgaagttcagccaaatggcccttaagaaatgaaggcaatgacttggtggaggccctgcacgtagagaacgtcagaaaaggctgaattggatccccagatgttcctaagacctgctgggggaagcttgcacaagtctggtccaaaatccgtttgtaaggaaattggtgaaaatcacagcaaagctggccttcacaggccacatacccaggccctgctctcaagcaacatcaggcttggatagatttttccagaaccccagatagagctgggctaacttaacaggttgaattcaaggcgtaccaaactttaaaactggaattggagttgactatttatattacaagaagattcttcactctccaaaagcaaccctttgtcgtctgagcacccctaaagacttaagtgtttgttaacagattactaaccatttggcaggagtgcaagcactaaagaaaacttgcagagaaaggaaggggagggaactggaatctctgcaccattggttcgccaagctttgtgctacatgcttcacttacagtatctcatttaactaatcctcccagcagggttaagaatctccattatacagaaaaggaaacagcacagagaagtgaagtaatttggccaaggtcacacaggtactacagcactagaagcaggggctgtttccagcagcacatgacatggaacttcctaaggaagtgccatttgcattttgttatcaccatctactaaaacatacccctctggcacacagtgcaataactatttattgacatgaatatacataaatgctaagaatgccatacacagtaaagatgaccatatggagcttaaaatttattacaggtcagaggtatcaaaagaaaattatctgaatatgccaggctagcaagggaggggattcttggtgcctaaagtcctactattccagtcttctttctttacacacacacacacacacacacacacacacacacacacactccttcagccaaaatgttccactttagtggagggaaaagagagcctggagccataagtctagcttattgctgatgcctggtgttccccactctgcctcccaggatctggaatttatcttgaccaccagacagagcacagaactccattacctagggtgggccagggctgccacggagcagcattgtgtggctgtaccctccagaaactctggatgtaagatggaaggattgtagtacctggtggacaataggtgggaaaggatggagggtaaagaaaagcacaagacagggagaaaaaggaaggggagagtgggaggatgggaggcaggaagttcggttaaaatatactgtcagtggcaccggataaaaataatagccttttctgtgattgaaagcatttctaaaaatcaaagataggaacagctgctgtgctatggtggtgggattatgactgcttttgtaaatgtcttttaatgttcttatatagttttacagcaggtaaaattttggagcagaaagatataaaaacattcatggatagaaaattcagaacaagtcaccaaggggaacttggtttgtgataattttataaaacagtgttacatacattcctaacctatccccaggccccctgagagccacaaccaagacccattggaccaagcttctgaatttcacagagcttaatgggcttctgatggcaggggctagtcacccacaaagagaggccacaacatacagaggcaggaggcctgcaccggggccaggaccatgctctgtggacaaaatagatgatttcaggcaaatcccttacctggctgactcgggtcgtcttccttaaagtaagaggctgcatgcgatcaggagtgacaaactcaaatgctttaaagagttaggctgggatcacagaactgaatgggccatcagagcctatggtggcctggaaatcacacacccggaggccaagggtgcagctgctacccagacctaggtgaatgctgggccccatgctgccagtgtagagaagttgggaatctatacttttttaaatgtttggtttaattttaattttttttgtttttagagatgggatcccactgtgttgcctagagtgaagtggtgcaatcatagctcactacagctttagactcctgggctcaaagtgatcctcccgcctcagcctcccaagttgctaggactagaagcatgggccgccacaccagaagaaaactagactttcatgtgggctctaatttttctgttggcatccagtttctaaaaaacgtagtaccaagcacagtgcctgaatctgtaattccaacactttgggaggccaaggcgggcagatcacctgaggtcaggagttcgagaccagcctcaattaggagaaaccccgtctctactaaaaatacaaaattagccgggcgtggtggtgcatgcctataatcccagctacttgggaagctgaggcaggagaattgcttgaacctgggaggcagaggctgcagtgagccgagattgtgtcattgcactccagcctgggcaacaagagcgaaactctgtctcaaaaaaaaaaaaaaacaaagaagtacttcaaatgtattatctcactactctatgatatgttgtaagattggccccatttttacaaatgaggaaactgaggctcagagacattaagtaatttgcccaaggtaacacagctaaaaaggggcagagccaggattggctactacaaagtccttattccttctctccacaacattttattaagaaaatttcaaacaaggccgagtgtagtggcccaggtggctcatgcctgtaatcccagcactttgggaggccaagacgggtggatcacctgaggtcaggagttcaagaccagcctgaccaacatggtgaaaccccatctccactaaaaatacaaaaattagccggggtgatggtgcatgcctgtggtcccagctactcgggaggctgaaacaggagaatgacttgaacccgggaggccgaggccgagcccagatcatgccactgcactccagcctgggcgacagagcgagactctctcaaaaaaagaaagaaaagaaaagagaagagaagagaagagaagagaagagaagagaagagaagagaagagaagagaagagaaaagagaagagaagaaaagaaaagagaagagaagattccaaacatacaacaggttgaaaggatttcacagacaatacctgtatcccatcacctagattataccataaacattaaattttactgtattgctctatcacaaatctatccaaagattgtctcctttggttccatctgaaaagcaacctagaaagtacgttagaggtggagcccagatgttgccatttctgaattagaaataatttggcctcttctgaaacccactcatcccattccctttgtggctggggagtatgggggtgggaagggggcaggcaggaaggagagtgttgatccaggaacatctgcacacatcatcacaacacacatcccaaccagctctgatttctcccctggctcaaagcagggagagatgggtatttgggaaaagctcaccaccccaaaatatctccctaaaccctgaaggctaagtcaacccatgggctctctgaaagtggccaggggacagcaggagaggcagtactcggaaaagggcagcggtacctatcttcggagccctttcacctgctccagtgggattttattctcactctgtggccctgatacctcctgtgtcttttagctgcattcgtgggatgggagggttgtcagggaggtttcccacctggggcctcttcgtacacctcaaggggataccatgcccacagaatgcaatgtgaatggtcctcctggagtcctgcagagtggtggcaatcttcaagtccatctgattcatgcaaaagttgttcgagcataaacagcagctttctccagtgtcccacgcacagtaaagaccctgcaagagggctgcctatgaaaggccttggggccagggcgggggctgggagtgctggactctcaattctgacaccatagcttctccaccacttcttgctatgtgaccttaagaaaccttcctatcctctctgggtcagagctttacaaatgacgccacaccaaaggaaaaaaaacaagcaaattctggccatctcctatgttcaagacagtgggccagatgctgggtggaggggaaagaggcatactaaggagctcagcagatacctcagagccctggtctaagcgctttgcacgtttttaatactgacatcaactctacaaggtgggtgtgacttttatccacattctataggtgagaaaactcaggaggagagaaattaaaactttcctaaggccacagggttaagtaagaggcagagcaagggtgaaacatgggcaacagtttcagaagcctgcacaggtgaccaccacaaaacgctgcttgctagagaagcccaagaccccctctctgacctccaggaagactcggtccaggggagggagcaagacaaaagtgaagatttaaatgctgataaaatatttaaataattctttgagataatagtgggaaagatgctgccagggagaacatgattaattgtcaaatgaaagtgttcagacaaaattgctctaacggtccagaaaaggggaggaaaaaaacccctctaccgtgagctcattctgagttggaggaagcctgggaggttaaatgtcactggcttttgcagagtgagcaggacttgaacaggagagagtagggcagaaagcattccagcaagaatcaaaattctttttttgtttttgtttttgtttttgagacagagtctcattctgtcgcccaggctggagtgcagtggcacgatcttggctcactgcaagctccgcctcccgggttcacgccattctcctgcctcagccctccgagtggctgggactgcaggcgccagccaccatgcctggctaattttttctgtttttttttcagtagagacggggtttcaccgtgttggccagggtggtctcgatctcctgacctcgtgatccaccttccttgacctcccaaagtgctgggattacaggcgtgagccaccgcgcccggccaagaatcaaaattcaaagggccagctctcatgtttggaaaggtgaagggccctgaacgactgaagatggctcaggggtgcaggaagggtgagctgaggctgggtctgaactttgccttataagtaatagggagtcatagaggaatttcagtagagtagaggagcatcatgacccaaatgtctgctgatgacacactggatacactaggggtgcagggagaaaattaataaattccccaaagtgttggccaaggagtccttgggtcttgacagaggaaagcaagaagttaaggtcatgatactcctcagagactgaccaaagaaggaagaagggggatacttcagctggaagtcttcagctgggttccatcctaaggactttagaatttggcactctgcgtcatcagggaagcaagtaaatatgatccaaagtccccccaccccctcgcagggttatatccagagaacagaattttttaatgctatttttaatctttctgttgaccaaaaacacactgagaagaaatgaagcatgaacatcaacaagaggctctacaaactctctcccctctcttccctcctgttaaccactctgcgaccctgcagactcaccatatggtccaccagctagatggccccttctgatcctggaagggctgatccgcttaattatttggcagctataaatagaagcattggacaatagcctgagatcttttttttttcttctttttttggtcttgcaaacaaagagagggtccctagttggcaggattggagagtaggatttcactccctccctccaggccattgtcttccacctgagccaccacagcctcagggcggcttcagaactgtcctggatgagctagggacagccctgtctcaactgcgccagcaaggagatgtgctggggtcactcacagttcttagagtcagggtgggttttaggaaagagatcacccaggagactcgaaaggtccgtttgctttaggcatgtccttgcctatggggccaagacctcactctagccacccacagcttttcctaccttaccactcactgcacccacattcagccttcactctcacccccaccccattcccaggcgagagcagccacctggaggaatggactcctctggatccagagccaggaggtgagcagagcaaatgttcccagtgcctgcaggaggaagccaggcacccagggttccccttgccacctagacccccgccacctccccatctaggatgggctttctctactccacacataagcactctcctgccccagctcctaagctgttctccctacccctaatcttagcagggacctggcatggaagtcagatgagcctggcttggcctcttgggtctgctactttactagttgtaagatcatgggcaagaggtttcattgctcagtgcctcagcttccccacctgtacaatgggcacaataacgatactgacctctagggactgcttatgaggacctatcgagagagcaggtaaaggttgtcatctagagcctggcacacagcaagtgcttgctaaggggtgttactggcagcttttctctgagtccaactcccatcacctatatgcatgggactcagcacacatttgctaagttgttggtttctccacgctcccctcctcctccttcacacccaagaggaatgaccaggtggccacaggagtcagcatgtttgactttggtacctggggctcctgaccatccagtgtgaatccaaacgcatttccctgactgtctgacacctgctgtttaatctccatcaccttccctcctcctacctggctcagggtccctcactccgcataggtggccaaggtgtgggggagagccctccttcctaatgcttgtttgttttttcgctcatgtgtttgctcagagacaggataccatggtgacacccacgatccagggtggctgggtacacacacatagacagggaaatcaagtgaaagaaaaagcccatgggggccaccatcatcccacgaggggccagactggctcccaaaagagggggaaaggctgtccctcccaggggcctacatatgttttcccaatggaaagcttttctcagtggtcccggcaggcttccaggacactcctgcaggccagggactggtttctgtttgtctagaagccctgcattcatggtctagcatagccaccaacctccttgagatccatcactatccccccatcatgggcatctgcagagcattcatgggttgtggtcatgacttggaaaattattcttaggctgggagtatggctggactaggcttcacagagaacacggagggcagggtgagacgctgccagttggagagaatggcagcccctcatgaagttcagagaccccagcacacgaggaatctaccctgcctggcactgcattggctctcgtggaacatggagggagtgggctttggaatcagaggccagggatcaattcctagctgtgccacttcctagctaggtcaactgtgctgtttcctttaacctttctgagccaaattatttctaattcagaaatggcaacatctgagctccacctctaaagtgctttctaggttgcttttcaaatggaaccaaaggagacaatctttggatagatttgtgataaagaaatactgaatgctaaaatgaaaataaaaatatcttctgcagaaataagacctagagtttgatagatcagtagggtgactatagtttagaaaatattatatatttcaaagtagctagaagagaataattcaaaggtttctagcataaagacaaatatttaatatgatagatatcccaataaccctgatttgacctttacaaattatatgactatattaaatatcacatgtacatatgtacatttattatttatcagtaaaaataaaattaaaattataaaagggagagagacttcctgcatatgaaatagagattacaaatcctttctaagtacacatgggatactgacctgtatgctaagtcattaaaaaaagaaatccttctgcaaaggaccgttttgagactatgaggctctaatttagaaaggtgacaagcacattgcaggaccttacttaatagggctggggcttgccagcatacaaaattactgcagtgacttgttcagactcctgcactgggaaaagacttagtccagagacttacccaatgttttgccatagtaaattctccaaggatgaagaaaggaggaggagagaaagagaacttttctctgtcttcttcaaaagctgtagcagccagatgaagtacggtgtaggtggccaagcagccagatccctaaatagcaactaatgactttgattgaaattaataatgaaacgacacctgttagctcacttgtagccactttagtttgtcacatggcaattatattcactatcctatcagctggtccatgagctgtaaaatgctataatgccatgccatatgcctctcttgtctcccatgttgagacgggggctgtcctcagggtggttatcaattccaggcctcctaaccactctggagattgtcctgggaacttccccggcattcaaaaagacttgaggaccaccagccccagtgaacctgctgagtcccagggagcagctgggcagcctctttgaaggtggattcccccaccgagcaagaggaaaaacacacccaagagttaccgagtcccttctgtggttgggtccttgaaaagccttgttgggtgatagagggaattctccacttgagcagtgaacaacagtgtcaccatccacattatctccccagacagaggcaggacataaagaactaaacaggcccccagcaggccatgagatttggtttctatagcaacccaactgaggttgcatgagtgcctatgagatagatgcccaaggctcaccccagacagggccagaattccagaatcccaacggcaaggaccacccagcagcgtttagagatggaaagcaaggtttgttcatgttcagaaaaacccagggaagccacaggaaaaaaatggggctaggatccccactttctataaggcaagctccaagactatctggcagcccaaagctggcatgcagagctgaggcaggccccacaggtgagctgagccacgctggggattttaacagaaaataatcctccatccacctctgcatcgtccatattctctctctctctctctcacacgcacatacacagacacacacacacacacacacacacacacacatatgaaaaataaaaaaaatcttgcaattattcaaaagaaactatggttgatttgttgatcagaaaaatatcaatgaatgaccaattgcaacaaggtccaaggtcctttaatgaaagtttctaattaaccctacctttgaacacttctattactctatctgtagagtaattgttattttagcgatgcaatgtttcctaataagaccaagcattgggagaaagggaggaagggagggacctgaaacccaaacccagccccaggtacaagctagcacaattagcagccagtgtactggcttctcgaatgctgatatggaatagctcaggaaactcaatcccaccagggacctgcttactgtccacagatgtcatcacagtcatcggtcaagctgagagaggctagcgcaaacaggcgatggggccgctctatctctcctcctccatcaaatcacaaaatgccatgacaacacccaagccagggcctctgaggacacatgaaaggaaatccaacttcatgcaacagggactcaaggtatggcccttttcggccaaaaggcagtgtgggctggagagagagataaacacaagaggctggaaacacagacagggtgagtgggaaagcttagaaggcacttagcaggtaaggctggcatcgggagggagctggctggaccctaatccctgaaacctctctccctgaaacctctcttcaaagagatctacactttctaaatcctgcctccatgagatgaaacttctgttcggtgtcccactcttacagcccctgattcccccagggcctagctaaggaggcccttggaccaccagtgaaactaaacagagtcactgcctatgaagtcccttcagtctggagctgtctgaggaaacagataagccatccaggccaaagaccagcctttcaccatctgaggggctattagatgcccagcaaatatgggttgcctagctggtagcttctggcccagatgccagtccaagagctagagtggcctctccaagcttgggagttagggaagctgtacccagatccttggcacccaccccaaaagagcccatgaagagaaatgaatgaaagggcccagggagattctcaaggccccggtcagccgccctagaagtcacctcaatcttagtcaaggatgagctgagccttgaaaatccatactctgtgcaagaagatgcagataatctgcccagttgcccaaggcaataacttggaggacaaccaacaaaggccaatgggggtcacttgggaagacacatccctaagttgacctgacttccttagagtgggcaggaaagacaggcttcagaagatagctagaaagtaacaccagagaaggtcaccctagaggtggcccctggccatttctcaaggtgacagcctctctgcccaggcgtccacactgcaatgttttccatattggcacttccttacaaagtcctctctttctacctccatacctttgttcacactgttttgcttagctggcaagttcttcctgctcctctctgcctaccaaagccccacttgcccttcagggtcaggtcaaactcaagctcctcatcaagctctgcatgccatggagatgtgctgcccccaacctcacctcgaagaaggacttgaggcccagcttcagggagacggctttgcaaacagcccccagctgtcggttccttcaggctcagcctcagctacagcttcagccaaggtcacccttcctgggacagcctgcatctggtgacagagtgaggtggggtacagaagcacagcaatttgggcccaaagggatcatctctgttggataaatccactccagagttgtctgctgggttggccgaggttttgtggaagctgcatcagctctcgacttgtccctcttgtcactctggcctctgcctctcccttctcagaggtggattcctaataaacatcatgagctcaaactggtctccaccagtacccatctcccaccagaaattcaatcaatggtcattattattatagcccatgtttctgccacaaaaggtgctcaataaacctttgataaacacatgagataatttagcatttctacttgctgacggagctcttgcagagcctgccactctttcaggcacactcacagcagctgctgatcaggtagaccaaatgacatgaggccaatgaaataaatatgccatcacaagagcatggcttcctctggctccctaggaatcacacagcatgctggctcctgaagaacacacaaggagatgcctcacctgagaggttttggatcctgggatcaagaacaggggctcattggtacctctgtgtccatcctaaatgatggctcacttaagaagtgatggaaggtcagctttagtgacaccttctcatcagcaatgctgctactaggtgccaacagcatctctcaccacggcactttaatcaggatggcatgacaccactgtaaatattaaaaaggttataattagagacgcagttaaaacaaccgagggcttagtgttactaaagatatttgcagaatctggtgcaatataaatagcagggtttacggtgtcatgcctaaaattttgagcaggctgatgttccaaggggatgttcagtgaatgcccatccaagctgggatttctctcaactgattgttttctctccagtgtcagagttctcagaaatagatatccagagtgtgcccattctcataaaggggtgaaaagaccttgctactcaaaaagtaggacaaccttgcaccaggacacccgttgaagctcggtggggcagctgcagcccctcaagctgctagaaacactgtctcctgcatggagaggtcacagccttgtgattccatcggctccaaatttaaagcaatcttgcagaaaagggccaacatttatcagaatgaggaaattgttttctagggtgatatcaactggagtctgctgggtacacatgacacagagaacaggcaatcaacctaccaacaaagacgataattgtcacagtgcctgccaccggccaggcctctgcacacattcactttttcctcaccacaatcttacaaggctattgttgacatagtcactttacatatgagacaatcaagactcgcaacatcataaaactgatcagcagcgacatctaaatttgaattcaggtctgtccaattccagggttctttcagatgtgagaagggaggttcagaaagggcccctttttcttctccctccgtgtacttctgtattatttgaaatttttatcaatagtatattttcttgtattactttttaaatcttcaaatcatcaaaaagaatttatgggcaagagaaatggtcctatttctgttgaaaatgtatcttaatttgatgtaacaaaatactactaacaggccgggtgcagtgctcatgcctgtaatcccagcactttgggaggccaaggcgggcagattacgaggtcaggagatcgagaccagccagactaacatggtgaaaccccgtctctactaaaaatacaaaaattagccaggcgtagtggtgcatgcctgtaatcccagctactcatgaggctgatgcaggagaatcgcttgaatccaggaggtggaggttgcagtgagccgagatcgcatcactgcactccagcctgggcaacagagcaagactccgaaaaaaaaaaaaaattacaaacagccattgaaataaaaaaaaatctgttctttgctacaataatttcatttctggaaacctatcctgaaaaaaataagcagagacaccaaattatattaaataaaaaagctgcctttattttgaagtgttacctttaataagaaataaactggcaagaaactcgacacccaacaacagaaaataaagactggatatcctcatgataaactagggtgatgctattaaaaatagttttgaaatgtcagcaaccacaaggggaaatgctcattacatgtttctaggtttaagaatcaataaataaactaagtattcacacatgtaaatgctggtatatgcatccctcccaggacccacaggcatacaaaggaatttagaaagagtagacatctttggagagaggtttccaggattagggtgggtggggtagggtgggcagaaaacttttacttttcattttatatttttataagttatttcaatgtttaccatatgtgttacttttatttcatttcactttttcaattttttttttaatttttaattttttttttttttttgagacggagtctcactttgtcgcccaggctggagtgcagtggcgggatgtcagcccactgcaagctccacctcccgggttcacaccattctcctgcctcagcctcccgagtagctgggactacaggcacccaccaccatgcccagctaattttttgtatttttagtagagacggggtttcactgtgttagccaggatggtcttgatctcctgacctcatgatccacctgcctcggcctcccaaagtgctgggattacaggtgtgagccaccacgcctggcctatttatttatttttaatttaaaatagagaatgtgtctcactctgtcacccaggctagagtgcagtggtgcaatcacagcccactgcagcctccaactcctgggctcaagtggtcctccaccatgcctggctttattattcatttatttatttatttgagacacagtgcagtggcacgatcttggctcacttcaacctttgtctcccaggttcaagtgattctcctaattcagtctcccgagtagctgggattacaggtgcccgctaccatgcctggctaacttttgcatttttagtagagatggggttttgccatgttggccaggttggtctcgaactcctgccctgaggtgatccacctgcctcggcctcccaaagtgctgggagtacaggcgtgagccgctgtacccagatttattttttaaactaagtatattttaaagctttacatatattatgtatattaaccaatatacatattaacatttatatatattaaccaatctaagttttcagaataacatttcattatataataataaaatacacccaaatgtgatttctgcattgcagaattacagacattgctttctctttataatttttctgtatttgccaagttttctcccataaaagcataattttattatcataaaaagcctccttttcaaaactttaaggtatctcactagtaagaggatatactttctctaataagagtttgggtttcaccaccagtcatgtccagcctcagacccacccaaagagtcatactatcatgagtacaggggatagaagggccccatgagactcattccaggaggttaccaaagtagtagacctgaaatggtttggctctgtgtccccactcaaatctcctcttgaattgtaataattcccatgtgttgtaggagggacccagtcaggggtaacagaatgatgggggcatgtttttcccatactgttctcattatagtgaataggtctcatgagatctgatggttttattaaggggagttcccctgcacatgccttcttacctgctgccatgtaagatgtgactttgctcctcatttaccttctgccatgattgtgaggcttccccagccatgtggaactgtgagtccattaaacctctttcctttggaaactacccagtctcaggtatgtctttactagcagcatgagaacagaataatacaagacacaagccctactggcttagcctagagcctcagctgaagccacagccctcagccctggacccctgagatacaagaggagcctgaccagtgacatcccggaattaaacagggggagaatcttcctcttattgtcatcctgagcaatacactagacaaaggccatcgggcagataaaaagaggaaccctgtgcccctgaagttgatctgaccaccagcgagaggtcacatctgctatgtgcaatgccctgcaggggtcacaaagatgacttcaacctcgaccctgtcttcaaaggagagtccagtccaggcgagtaggtgagaaggcatgtaccaactcaaatcccaggtagaaagtgagcagagcccgaactacagaggtatgaatacagggcaattgaagttcagaggacgaaagctcgcttccagcctagggtgcaaggacagcttccaaaggaggtgattcacaaactgagtttgaagtctaggtgtattcaaatacaggccaagtgtgcccctgcccaggagtaggcagtctatgcaacatgtgaatcacatgttcaagcacctgcctcacctgttttatgggcaagtctgccagctacagtcctatcagggcacctatatttctaaggacctggatgcctggatgttttttctccccagggcatatatctcaattacaaacctgcaggaaacaaaaagtttgtggagagtcacaaaacatatttgaaatgtataagactttcaccacaggaaactaggcctaacaagtattttcctgtggaacacccctggctttgatgaaactccccattcaatgtctctttcctcctgcaaactttgctaatagcagtgaaaataaaagcacagatcctatatttacttaatgatcttggctgctttagacatgagatagcattccaagagagcaaagtgctttttaacaaaattcaacaagaccctgccctttcccccgccctcccacctggcctctggaaggaggaaggaatttctcattctctgatcttttcgcctgccatgacccccagggcaatccagacagtaagactggccatgcctcctggtcatgtcccatacctcatgtcctcatgtgagaccccagatgggggagatgatcacatttgagttacatttgaggcggagattcaggtgggggcccaaaacatggctgacatccagccagcattctttgctagatggagctgggaatggggggttaacttttgtgaaagtttattagagaataaagtaagtgagttaattaaattggagtgtgaaagacatttgggtggtgatgaggaggcgaggtgatgatttatttataattgacaaggttgcatctagctactgggatagtaattatacactttataaatgcgcaaaaaaagtcctttcatgcgatggaggtttaagggaaaatcctgtcagggaagtttctgtctgcccatgagtatgacaccacctcaagagctgttggccacttggcttctgccaaccacagctgtaagttggggactgaataatctctaaatacccttctaaaaatgaggccttttctgggaatcagtacttagcctccatctgcttctgatgatgttttcttatctcaattcagggacaaagagggatcctttatcttgtgtctgattctttgtttttgttttactgattcatattcaagttccagctcttggatcctccctaatcaagatgataagaaagatgctgcccaatgcggcatctcatttaagggtgagcagatgtgaattcagaccctaaatttgggaaagttccttaatctcatctggaaaacagggatgggggtacctagctgacggggttgctataaggacagaacctggtgtaaaggcaagcctggtacccagttaacactcattatcatgcaccttaggttaagtcatggtaaaggaaacgtttcaggttaacttcagtcccttgataactggggattccagcctgacctgtttgcatagagtctagcttggcccctgtgaccagcatttgcctctctaagggctcctaagcactcagttttaaaatccaatcaagagtatttccagagataagccacgacatcattagaatacagattacagcatccatcttctgacacccactgagaaattctaacaagcacaagaagttccagaatgctagaggtaaaaaataaataaatataaataaataaataaataaataaataatcttatctcaccattcaaagattctccaaagaagtagcatggactagatctctcctcccacctgaaacaactaaaaattcagacaagacaatgattttcagacactggagctcagtcaggggaagacagcaatccctgagagaggagaaacgaagtgagccctacagttgcctcaacttcctgtctggagagagcgtccaagtcacagcagaaagaaggaggaccccagcagggcccagatgtctccctgagttgaggagatgaaggctggattccagcaaggccaaggaggctggaattcacaggccagggcagcaaaaagaactgcccagtgaatacttgaggtcagcagagggacccccttgagtctttagctaagtattggtggacacaggcatgtgtgaaagctatccaaggtgggggagagaaacaccctaaaggagcagacagaacatttcccagagtttatacagggctgggaacggttcaccttcccaccagccagagtggaaacctcaagctcacagagcacctggtagagtactgagaatagcagcgtctctgtagtgggaaaaaattagccctagattaagagagctctggttccacctaataaagctcaaaggcaagacccaaaaaagatcaaactgtttccatacaacttgatcatgtcccagaaaataagctcaagaatgttttataggagtactaagatatccagcaaccaacaaggtaaaattcacaatgtctggtatccaatcaaaaactaccaggcattcaaaaaggcaaaaaaattgaacccataatgaaaaaatagtccatcaaaagactccccacttctgcaaccacatctacagtgtatttcaggacccagccatagagcccctctggtcctagaaatgcatttcaaagtgcctctctagctctgtgcaagagattttctctttttcattctaaagacagtaatcctaggtagaaacaagagagagaaaaaaaacagaaatgctcactttctagtttgtttctctgtttgctaacagtgtcacatttcccaagcagtgatactctcccatctcgttcatcttctaattctctgcctataattttacaaatgtctgtggctatctttagcagttttcaccagttttgtgttttagccacctgaccccctttcactctaccctaagttagatgactcctcattcctcattcataaagttctgtctgttaaacctagagttgatcagcgatcacgatacacgaacatgctctcttcttcagatgccctcacattttccttctttacttggggattaacaatttaatttttaattagtggagcatactcaaaatgtcatggttgcagccttccatcactcttgggctatattctctcttaaggtcttcatatggactgctgtctaaaacaatctagaagagcaagaaatccaaaaatgggcccaagtatcctagggctgtggatccaaggcatccatccaatgtgaactagataaactgcagtctgtctgcaccattgatctttctgagatgagggcacctgaaagagtgggccaagccactagaaccctggaccctccaccacaggtaccttgtggcagttggctttaacttcctccctatccttgccatattaatcttcattccctgtagtcataaagttctagaagaatatatcagctttgatctctttcagttattcatgcattctttcatttaagtaaacagatatttactgagtacctaccatgtgcttggcaatactttccaatcttcagaaccgggctctcacaccaagcccaagcacaggcagctacccttactcctactcaaaaatgtgaagaggctgaggcttctaaaatagaaaaagtcaccagctcagggtcaaataattaatggaactcgaacccaggactcctagacccaagcctctcctggccaagtctcattcactgcaatcacaggtccagcctggtcacgatgatgagtgggactgtaccctgccctccctgcccagcccattctaggcttcctcagaattccctactttgagtgctcctttgccatgtgaggctcagtgatttccttctccgagtccactcacatttgataggctcctatgaaatgtaggtgagcttcacctgaatctgcacctgtcctcattgctaaggtgatgagctagtgtcaagaaaggctgagggatccaaggatgaactcaggcagggcttgaggccactactcccggttcccctcctctcttccccatgaatcaccttcaaggacacttccatcaaacctgactcacacagaaggcccagacctgagaaatgaccagcccctgggccagagcagagagccagaaggcaattccctcccccatcactgctgcactgggtggaaattgggtcagagctggccagcccattcatttaatccaaacgccccctttccattcagctcttagtcctcagagctttcagtccaaggaagcactatttcctctgcaaaataaacaaaataaattaagcccatgctctttgatctcagggcttttgtgtggctgatgaattgaacagaaatgatctgccatcctcctggcatctcaaagacactgcaaaaattcagctgtagcttccagccacctgccaggcactgtgctgacaaggaagcatggctaaggaaggcactctttgccacccattctcccagggaagcaagaagagtctgcaggaggcacgacaggggaagtcaaaagagtcaaagactgtgaggcaggattcgtctttggccacataggcatggattcttcttcctctgctcattcccaccccagggactttgcactggcttttgtccccatgtggcatactttctctggagaccttggaaagctggctccttctcatccttctcatgtcagcttgcacaggacctccggagagaaacctttcccatcaaaagtagcccccagactctacccgcatcactgtctgccagccccctactctattatctccacacttatcataatcagaaatgaccttgttgctgcatttgttctcttgtttgttttctgtttccacttctacctccgtgacagcagggacatcatctatcttgatcagtgccatatccccggcagttagcaaaacgtctggcatatggcaggtgcaaggcaaatgtttgctgaaggagggaggctgcatggaggagactgggccctctttccagtgccagctctgcctgcatcgagcactatgtggcgcatctagaccaggatccacatccatggtgtggtttccccaggctgcagaagtgcactgtggaagcaggtctgtgtgcttgagatcagggaaagctgaccaagaagatgggacacagttgattctggagaggcagggaacagacaggggactctcctaacaggctggatcttccaggacagttgaaggacaacatccagtaggaccctagaccaagagtatagacactgtcgctatgggtgtttctctgagccctgagacttcccatgtttaagataagctggttggattactggttattgattatgttgaatcttttggtggcacagaccaacttgagaatctgaagatatcaactttctttctggagaaatgcatgtgcttacatagagacaaaatatgcctgcacttcctagaagggcaaggacccctccgaagttcattcacagccccaggatgacagcctctcacttaaaggctcttgggccgccctgctagtcattggcctgcttgctctgagacccagtctttacccctcgtctgtagactgtggactacactccccaggctccctcgctctttcttctagggaagtttgttctattcagcaggaatgcaggcagaagtctgcagggtgggggcaggcagaaaccaggacatttctccctccttctgcatttggtggcatctccagatagagaacatgtccatcattatatctatcacctctgggtatcctgccctccccagagtcctttcctctgtgatcctgcccagcccagcaggccttctgtagttccagcatccgccaggtgctgctggatcctgagttctagaaaaccagctcctcccttccccctctagccctaggatgctagcagcttcctgccattgctattctctgggctgcctctccattttttgcttggctttttatctccttggacacctttataactagttccccatataaactccttctactagatattttggcatgaactctgggtttcctctggggtccctggtgggatcagcctccctccagcacgggcattctgagagcctggtagcttcctggaaaggccaatctgagctgaattaacaaatccctaggaaggtcaagaagatggaggggctgggaaaacccatgttgcctgcgagtgcagtgcctccatcctgtctggttccattccaggaaaaaaagttatataggaaaagcctcacaatcgcaatgtagttaaaaactgtttactgcctttttctaaatgagggaaacaaatgtaaggcccagagcagcctcccatcaaatcatgctcttgctcagatcaaacggcagcccgagtgaatattcctagagttcctacttgggagctcacgctagctactaagtcctccctgccaaaaagacccgattatacaaagtggggcagcaggaaagccagtcttgtagcatcaaagaaacacactgtctgaattccatcagccacaagcaggcatcctccacccagggataatgcagccagggcactgtgccccagaatggccccacccatgcaggagggcaccttccctcctcactgtgctggcttcttttaacaaatagccctatctatgagctcccttgttccttccaaccattctaaagatagggcaggcaccaaggccaggggtatgggcaggtcctcctccctgaggaccaaggcacagagagtttccaaggccacacagccacttggaagcagagctgggattagaaccctgcctggacagggaatgacttcaacttacacacatgaacaaacacgaatctcaactccctgttatggtggggttccccagacacacatgcatggtagagatttcagtgcaaatttaatcatttgaaaatactgacattcaaccattttttaacctcaaaaatggcaatttcatgtggcttacatgaatagtttatttgggtagtgatcccaggggagaaccagctggggagtggggaaataaaatgggaaagtgagagggcagggtttgttaatggtcaggacactgctgcagacaaccaaggctcaatgccactggagacctctgggagatggggcagaaccaccctgtccaacatggaaggcaccagccacattgagctatctacatttaaattacttgaattgaaaaacttagttcctcagtccactagccaaattccaaaagctcaataaccacagatggctggtggctatcatattggacagcacacatacagaacatttccatcattacagaaaatcataggggtagcactggcatagaccatgcctcagagctgtgtcatctgaggggtagaatctggggtatttatactcccattagggtctatcattggcaagggctgcacctgggggtatttgctgcaggcacttccagatgtcttggctcacactggtagggggagggaaggcactgacagtaggggcatttgagtgggataggaatagagtggcctgggggcatgggcagggcattcacagcctctgccacaatcaccagcccttcctgcacatcacctctgctcttgttgaagcacctctggatgcaggcattttgacagcttcttcgcaatgggaatgtggccccagaatcctctgacctgatgacaagccattctccctggagacaacacacagagagagacacaatccaggccttccaagcatttgtgatctacagcaggcagctgggacacagaccacagcatgcagcaactatacaaacactgactaataagctaaaatcggaaatctttatggagaaacccttgtgagcagtgcctggctaacagcatgtaggtgttgcctccaagaactgtctagcatttgagagacacagttggagactgagcgtccccattaggcaggctggtccccgaatacccacattattgtggtaatcaaaacacagctttgagacatcactgtgctggtcacaaacctggcaaggtcaagaaagtgctctgaagaccagcacccaaaatcttcacagcttagccttcctcccaggggcccgctcttggcatagcacagtggccagaacacagactctctggagcccactgcctgaggtcatgtctcatctcctccttcctcactgcgtggccttaggcgcactatttgatctctctgagcctgcatttcctcatctataaagtggacacaataacaataactttccaatatggttgtcaagaaaattaaatgagcccatgcttttaaagatcttataagaaggatggcaaactttttccataaagagccagatagcaaatattctatggcattgcaggtcacacagactctcacaacctctcacttcggtccttgtagctccaaaccagccataggcaatatgtaaacaaatggatgttccaataaaactttatttataaaatcaggtagtgagccagatttgccctgcaggccatagtttactaacccctatcttagaatgattcctgctctacagtgagtgctatatgaatgttcgttgataaagtctgctgcgctctcccacctctcagattcttcctgtattattattctctctgcctccctctccacccatcctttaagaccaagctcaagtagccttcctgaaacagtgtggagatttctcaaagagctcaaaatagaactactattcaatctagcaaccccactaatgagtatctaccgaaaggaaatcattagaccaaaaaaacacctgcactcatgtttattgcagcactactcacattagcaaagtcgtggaatcaacctaagtgtccatcaatggatggctggataaagaaaatgtggtacacacgtgcacacacacacacacacacacacacgcacaccatggaatattactcagccttagaaaaaaaatgaaatcatgtcttttgcagcaacacagagggaactggaggccgttatcctaagtgaactaactcagaaacaaagtcagacagaaagtgatgggtacactaaaagcccatgttgtcacttataagtgggagctaaactgagtacacatggacatacagaatggaataataatactggagactccaaaaagtgggacggtgagggggtgtgggataaaaaattacctattgggctgggcatggtggttcaagcctgtaatcccagcactctgggaggccgaggtgggcggatcacctgaggtcaagagttcaagaccagccttgccaacacggtgaaaccccatctctactaaaaatacaaaaattagctgggcgtggtggcatgccactgtaatcccagctccttgggaggctgaggcaggagaattacttgaacacgggaggcagaggttgcagtaagccaagatcacaccattgcactccagcctgggtaacaagagtgaaactctgtctcaagaaaaaaaaaaattacctattggatacaatgtacactatttgggtgatgggtgcactaaaagcccagactttaccactacacaatatatccatgtaacaaaaccgcacttgtactccctcttttttttttttcaaaaaagaggcctccctggaccctccctcttttcttagccacatccttagaccacttccaagttgctcttctgtggtgacccttgccccaccctgctatttgtggggcaacttgtttcgctgtagaatttcattgttcctgttaaatgatgagatgatccaatgtcttcattttacagggagggaagcaaggcccagagaagccaagcgacttattcaaggtcacacagtgacggcagagtcaggaccagacatggatgtgtcttgattcatgattcagtacagtcttgggcttaaggagatttcaatactgaggagagtggggacacagatcacccagccttctacccttgatttagggctggactaggtcacccctccacagaggttccttacttcctgcctcagcacccctccaggcagaacacttacggggcttgttgccccaactagacaggtctggctcacttctgagtctgtcacatatccagcatgggcccaggcacgctccagatgcaatagtgttgaccctgtgtgctttgtcttcctcttccttccccgtgagtctgcccattgccccggggacacccaggacagactcacagatcttccccaggggacatgtcctgttcatgcctatctaagtcatcaaaggcaaattccagagcagcctatagccagggctgtgtggggactccccactgactatggggcttcacagaggcacagcccaaagtaccatgctcacagacacacaaattcagacacacacatgcacacacacacacaagcagacacatgcacacactaatataaacaacacagacacacatacacatacacacggacacggacacacacagaaacatgcacacactaacataaacacatacatgcacacacatacacgcatgcacacaatgaaacaggcacacagacacatgcacactaacataaatacacacagcacatatactcagatagatgcacacacctaaacacaaatatacacatgtatacccacactgatgctaacacatacacacatgagcacacacacacatacacagaaacatatatacacttaaatacatatatgcatggagaaacaaatgcatacatgtgcacacacacacttagacgtaaaaacacatatatttacaaacaaacacaaatgtatgcactcaaatagacatataaatacacatgcatacacacagacatgtaaacatacatacacgtaaacatacacacatctatagatgctcatgtgctcacagagacccttatatacctatgcacacatggataaacacacacaccctcacacatgcacttacacactgtgtgatgtttttagcttttacctttacagacagacatgggagctttccctggaagatgtaaggtccctgggaaagggactgtgccctgggctctcccccgggagagagtcccgcccacccacagcatctgcctggtgtcttgaacacaactagtgctcacgtttcctcaatggacggatgaatgaagtcgtctcatgcctgggccttgggtccatggggagagcttggctcaggaagccggtgctgcctctatcacctctgagtttccaagccatactctctcaccccatcccagcttgggaaacagccagcatcttgctggcctcttggtggagtgttgctgatccatgcctctgccagaggtgggagaaacctcgatgaaactcaaaccaagtcttgacttatctagggatggctgaaggtcctcctggggtggggagaaggtggaagaaaccactgactaaagtggtcctggccccattctcccagcatgtaggttttctggctggactttacaagtaaaaaccacagtgaggagctcacttctacctgaggtaacacagtgcatggcccccacctgcttcccttcatatcactatcttgcaaaactggctcagagagagcctcctggccctgcgtagcctgggaagataccacccaccatcatttgttacctccccacagtgggaaggtgaagggcttaggagacctgcttcttggcaccatcacactgtactgtgttgtcaccctatctggacctcagtgtttcctctgcttctataaaacggggtgaataacctttgcctcctaaataccaaggatacagcatcaaggagaaaggactctgacctcacaggaggtgggaccaaggagaggggcaactcacaaaagcctgaggaagaacattctttggtggcacctccctgatgagcagagaggagccgctctgcaagttaagtaattgatggagcacacgctaaaaatacaaactaggttagcactcagggtggtttattgctccaagagggagttaattcaggcactcaaatctccatggaacagggactgtgagcccagagcagcagactcctgagccaggaggcctcatgcaacccagctgagaagtgctgtttacttaaaggctgagcaagacggaaccagagaaaatgggctggggaagcatagggggtggcagagaagggagtgcccaggccttaggagcatgagggaaagaaaggaggcaacatgcaaattagtaacaggaagtgggacaggcgacaggagctggaagggctactccctcctagattgggctgcaaagaccccagcctcccagctttctggagccccttgctattccaagtaagctccagagaccagcggcatctgcatcaccagggctctcatcagaaaaacagaatctcagaccccaccctagacctcccgaatatacattgccacaagatcctcagatttcctgtgcacactaaagtttgagaagcacaagattaggagtcaaaatccctgagttcctggtccagctattgctatcaaattgctgtgtggttttgcaggacttgcttgacctctctgggtgctagaatttcttcctctgggctacaggatgagtgaggcttgtttctttctcctgggttctgagaggctcaagtcagacccttcatctgcaggcctcggaagcatgggagggcctttacagaaaaacgtttccattttctaccaggctgcccccttccgctttcttggagtcattagtacacagagaggtagatggggagatgatccttgaaggacacactgcagtcaggaagaagacttcttaatgtcattttaagccttgatatctctccattaaaaaaaaaaaattataaagcagcctcttgctaatggggaagcagcgggtctgagtcatgctaagtaagccagagcatttcatctggaaatccctggtctggtgttacccattgcctttgggacattcaatatcactactgcacttgagaaatgtggcttctggggctcagagaggttaagtgagtgggtcagagtcacacagccagtgagaaacagggccaggacgggaagccaggctcccggccctctaagagaaactcttttaagtacctcaaggtgcccacgtccttgacagctgacccagactggtgtgaggacaggaagggaaaagacattctgactattgcctgagttggacagagttaagaggataaatctgggaggatatgatatcacaagggttcagatagaaagtttctaaattattgcttaacttgtttcatcaaatgaattgcttccctccattagcccagggctgaagtggccaattacctgccttctgcacaggacgacggccgtgtataaatcaacttgggtaggtaacaaaggaatagccaaaattctaaaacaaaaatagatgagagacttaagcacaccccaaaataaaacacacacacactcggtaactcaagtattaagttctgagacggccaggcctgagtccctctcggcctccatccagagaccaaacatacagtctctgatgatgctgagcgtggcaatgaggcctttgcataggccacgatccctgcagcaaactgcgttgccttccctgggctttgggaaggacacttaaggctggagattcaactaagtgcaaagctggtacctgcagacccaggggcaccagtcagtctacagctatggagggtgttttaatgcaaatggtaaggcaactttgctggtccctccttctggctccaggatggcacctcctggggctgctgggcttttcccaggtcttaaaaggaattctggtattacagaaatactcagagttttggagttagaacagcctgagtttgattctggatgctgccactcactagctgtatctgccttgggtgagccatttaaacatactgaaccacagctttctcatctgcaaaatggggataataacaatgccagtgtcagagggctatcaagaggattgaataaggttaacatatacaaagcaccctatcggcacctggcaaacagcaggcatttaatgagtgtgggctccctccaacatagactagaaaaactggtcgaggggtagcctctccctaggaatattctcttcctttatacattacattaagagggtgaaccagtccaagccagattcccaattccatccttcagcccaaggctgctccattgcacagcttcaggaggcactgcccatatggtggtctagatgtgtgacgcttcccggggctgggcagtccacaacctgcctcagcctatggagacacccatgggatgctaagagggaaagaagagatccaaatccacccttggcagaaaatgggaccatcccaagaaagtgttcctggcaggagctcagtgggcaggaagtaggatgcccagcaagggcatacccttggcgggagcatcaggaactaaggcaaaaatagaccatgaggcccagggctgcatccacctcttcctggcccagacctctctgcccctctgaagcctggctgccctcactcctcgatcctcagtgcctagcatggactctccacacccactctccctcacttcgcctggtctccctaactagagagcaagctccctgtgggcaggggagtaactgatatcactgtggtcctcttgagccaaacacactgtgctaagaaagcccaggcctgcatcatctgctggctagctgcttcttcatctccaaagcccaattgacacagccacccatgtatctcagaggatggttagagagcccaaacgatgctcactcagtctttcaacaaacatgcattgagaacctactgcatgagctctggagtgcaatagtgaaataggcagaaaggattcctgtcctcaaagagcttattctctagtgagagacaaaggccaatcaagtacacaaacaaatactacatattacatatatgttaaattgtaatcaactacaagaaatgagttcactgcattatataatcaaccattgaaggcttcaatagtcacagaaagactgatgcaagagacaggctgaatgtagctctagtgagagagtaaggagccagaaaggtaaggaggggagaatatgagcaaacaagcctcctgtgcaggacatttccgtctgctgtgaccacccttcacagaactgagggcttgcctgttctgtcacgtgggatgctgatgtccatgagggaggcaggttatcacctttgatttgaaagccctagaggcagtgaagttgcaatcagatagacaggacctgaaagaaagaaaaaagggagggaggggggaaaggggaggagaggaaaaggaagaggagaaggaaaaaaagaaaaagtagagaaaagaaaaaagaaagccagacccctgtgctaggaaaaatctagctagaggaacgcagagcctagcctgtgatcttaaggtgacttctaggccagactgtgaagggcaccatgtcataaagccattgccacctccatttgatgtgcaccatcacctctcctggctcttggccttatagattcaccagtttttaaaaaaactcttacattgcagctgcttctcagaggctgagactcagtgactgtgtcagttttcatcttaattcatgtctgtactgccacactgttggcaggacatgtttcacaccaaataactacactttaatcaagctctctgttggttgcattttttgatgatggaaagtccgtctccgaagcagttgtcttcactaatgttgactgagcagtgctcagcagatgtaatgctgagcgaataggggatcccaagggactccagggtgccagtgcgatgatccaacagggttccagacatggcaatttagttggacttcatcctcagtcatagaatccagtggcagaactctatgtcacagcatcacagttgtgtggacacacagagctgccagagactataaaggccatagccttttccaccagcgcctgcatttgcccctagggaaagccaactcgaggtcaaggttagttcccaagtttccagacttgagagaggacagtggtcagagagtccagaagtttctgaaaggctgctccaaaagggcagggaggcacagcagggccacttggccactcgccgagttctacattcacagggaccacgaattttgaccttgaagctattcctgattaggttatgtacacattcctggagatgtattcatggaaggaaaaaatatggcattgatcatctgatttaaacttttatcctgttaccagatctcattctggtagtacactaggaattaatatgaagtttgcaaattaagtattatcctttgaatagtacaatcatattgtttccttgtttttatttttatttttatttatttttaaattttttgacacagagtctcactctgtcgcccaggctggagtgcagtggtgcgatcttggcttattgcagactccgcctcccgggttccagtgattcttgtgcctcagcctcccaagtagctgggactacagatgtgcacaaccatgcctggctaatttttgtatttttggtagagacagggtttcaccatgtgggccgggctggtctcgaactgtcagaactgtcaggggattctgtcagaaccaggggattctggagtcagaatgcctgccatcttctcctatagctctgtgtctacacacaagttacttagcccctctgtgcctattaagggctgatttatgttccccaccaaaaattcacattgaagtcctaatgcccagtacctcagaatgggatgtattcagagacagggtattcaaagatgtgataaaattaaaatgaggtcattagggtgggtcctaatgcaatatgactggtgtccttagaagaagaggaaattaggacacagacatatacaggagggagatgatacatacacagggagaagaaggcagtcttccacaaggcaatgagagagtcctggaaccgatccttccttcacaacccagagaaggaaccagccctgccaacaccttgatctcagacttctggcctctagaactgtaagaaaattaatttctgttgtgtaagccacctggcctgtagtactttgtcacagcaggcctagcaaactaatacagtgcctccctttcctcatcaagaaaatagaaatgataatagtcccttcctcacagagatgtgttgagtacccagttcccagcactcagtaggtgtccagcaaatgtttcttgcactacttgtgattagtacagagtcttaacccaacctggtctctgcatgcttcatcttactcttctgtgtgagaaaagaggcttataatgaaagcagagaacagtaaattctgcagacaagtcacacacttcacaatccccaccaccctccccgaccacttcgccccaagcaccttaaggttgaatggtttgagtcccaaatctgcacttgcataaggtttcttttgctctagccatgtactttgctgactgttgtaggacccgcctgcccatcctgtgttctctccacccaataccttcaaaggccacaataggaaccccgctactccttggtttatcaatattagacaacttaggatgcagttagagatccacacgccatccaagtccccacattacagaaattagaagcctctccttccagtttattggagaaggaggatttctggtcaagacgtccaccttcaagatgaggtgaagagcagacaccactctggacagtttgcctggccacctaaggaaaacacagcgtttagagggcagcgccagaactgtgtctcctcaagaaatttgtcttgagaagggtccctgaatataacggttgccagaggggactccttggggcctagagcaagcttactgggggtcctggaagagttctcagaggtgtgtgaactcactggcagctgactgagaaactgggagtggcacaaagacctttagaaaccaataaggacttcagaggtatcacccacaagcccagaagtgtggccaaactgaataccccagctctctgctgcctcagcaaggagccagggattcagtgatggtgtcttcttccaaacctgtatggcatggtaattaaaatcaaggtcatttagaacccagaaaccaaagccattctgactctagagggaattttaatttgttaatggatcttccggctgatggctgggggaaaagatagcaattcacaatgggtttgaggccaaaaatggcaccacagtggccgggaagccgctgatagctcctcggtcagtcttcaactgcagcaaggaacaggctgggctacccagggatacagatttttttttttaactttttaatcagctaatagcagatgaagacctaacaatgctgccaagattctgctccttctgtcagcagtggtgagaaggaggccagggtcggatgcgtccggctgcctttgctctctgaggttcttttggagggatgtaggaatttggggctgaggaggaaaccccagggccatcttctccactggtcaccaactgcaaggatccaggaaagggaaacaggtggaattctcagttccctatgccaatcctgggggagggcctgagacatgtactgtattaatttaccccacaaatgattatgggctgcttaaacggtgccacagatgtaatggagactcagcaaactgaggaggtgaggcccggaaacgtgtcactaaagctgcttactgtgtgccgcaaagggaagactccgggtggcctcagacagagggagggtagggcagcagaagagcttcatccagaaatgtaaaccaaaggcccggcaccctaccttgaacacccagtgctgccggaagatcctgtccccacatgagggctctgggcaggggatctcctcctaaccagcgccagcgaccacaaagggtgctcttcagtggagaagaaaaagaagaatctaattcctgacttttatttttagctgcaagtcagacagaagagcagaaagaaggcacttgaccataatcctgatcatactgaacgagtaatttaatcatttttaaagcctgtgtgcaggctccgccatcttactggggtctaacttgggaaactctcacctcatttcaagcaaccagggtttctctacaagagccatcaaaaactacttctttagaagcacaatttctaggcatttgttttgtccaaaaacttggattctcttactttgttccttgagctaaatcaagcacaactatgccagctgaggcagtgaggagaaaaccggggtggggaatgaagcaggcaagagggcctcctgccctcagagaggcagcccggctcatccaatggatagacgcacaccatacacacaccacacaacacacatgtaacacaacacacactacacactgcacaccacatacataacacaactcatactacacacacaacacatatacaacacacaatacacaccagacatgttacataactcacactacacaccacacacataacaactcacactacacacacaccacacacaacacacaatacacaccacacatgcaacacacactacacaacacacattacacacataacacaactcacactacacacacaacgcacatacaacacacaatacacaccacacatgtaacacaacacacactacacagtgcacaccacacacaactcacactacacacacaacacaacacatgtaacacaacacacactacttaccacacacaccacataacacacatcacacatacacacaccaagcaccacacacaatgcaactcacactacacacacaccatgcaccacacacgtaacacaatacatgctacacacacacttcacaccatacaccacacaccatacacatacacacagcacacactacacacacaccatacactgcacacactccataccaaataccacaggtcacacacacacaccacacacactatacatatacatacataatacacacccaacacatatagacacatcacacactacacacacacaccacacacactatacacacatacacattatatacacatatcacacatacacacataacacacatacacgcattgtccacacaccatccacgtacataccacacatatacacacacccaacaaatatacacgcagcacacacatactatacacacattatacacaacgcatgtacacactatacacacatcacacatatatacacacacataaacatacaagtggtatacacacactatacacacaccatatatatatacacaccacatacaccatacatacaccacacactacacatcacacacacataatgccacatacacacaccacacacacatacaccacacaccacacacatgacacatattcacatacatgtaccacatacacacatgcaccatacacataccacacacacacaccacataaatacccacacaccacgcattctgcacacactacataccacacatatcacacatatattatatattcactgcccacatacacaccacacaaatacaccacacacacacacactacacacacactatacatacatcacatagacacagacacatacacatagcacacctaggcacactatgcacatgtcacacacacatcacacacacacagagagcgtacatactaaacacacatcacatatacacatacacacaccacacacacatactacacacacactatacaaacatcacagacacagacacatacacatagcacacctaggcacactatgcacgtcacacacacatcacacacacacagagagcatacatactaaacacacatcacacatacacatacacacaccacacacacatactgtttatttccttgctttaataaaaaaataaaaagagagagaactttaaaaggaagcagaggaaaataggcatttggaaaattagccccatcctaccatgatagctcctataaaacatcttctagagtctgattttcccacatctaaaaattatttctttttattctgttgttgtttggcactacaatataaatatctgtgcgtgcagaagcagcttttagtctttcatctgtgacatctgtggagagcgctggagcttgtgtttattcataggcatcagtccgttccacccttcaaacaacaaaggaggcaggtggaacccagagatcagaggagtgaagacattagctcaagggctcaggatgggctccaggtgcacttactctatgctgtctgacattcatggtgggctcgtactaggattgggcagggtgagtttggcaaaccaaaacccaaatgtgcacttcccagcggggccacccaccagggtgctgtaccctaaccctccacggctgtggcctgccctgggtcacctcatggcctggtgctgcccttcacacgaggaaaacccttctgtcagttcctagtctccatctttctcctccctgattccaaagtgcaggtgcctgctgactgagttctttttagatgaagtctgttttcaccataggccctcaaccaaaggccagttgacttcaactggccaactttcatctcaacccagaattacagctatccccaggaggcaggcattggaggagttgctggaccgcagaactgaacactcacatcctctgagaaacggagcagtgaaggctcttgcaattatctcctgaggggggctgatgaactgggggccccagcctggagcagtggaggccaagaagagctttagccctgtcttcaagggcctgaagagagtggcccagtggtcagatgtattctgtccatccccagggggagaccagaaccaccagacagaagatttagagagaaatctctctcttgcttttcagtagagcctgactttcacaagataggaggggcctccgtggatggaaacaggctccctggcacaggaggcatttaagaagaggtggatggtctctcagtgggacactggagcagggggacagacatcgggggaagggtgggccagtgcgacctttccaattgcctcccaccttgagaatccctgactcgacagagtgaatacacagccatctgagacctcctggtcacctgcctgcagggctctcttctgggcctaaaaataagattcccagagtcctgatccaaattagatccttaataacgtgtcaccatggctataaataagtctctttgagggccagttaatataattattttaatcagctacactccctagaaggactgccagctagctccccgctcagcctcgctgcgttctgaacaggtgcgctcctcctccgcctcacccagggccggtccttagagcagtcacaatgatgaagggtgggtgggcagtctctctgcttccctctctctaatgtccctgagacactccttccattctggggcctacattctcccttgatcattcaccaagacttccaacaggaagacaggggtgaaaacgcaaagtctacaagagccagacacacagcaaagacatgtaaatcacacacggcatgatgtgagagagagtgttacggactgaattggttccctgcaaatccacatgttcatatcctaatccccaggacctcagaatgtggctgtacttggtgacagggtctttgaacaggtgattatggttaaatgaggtcattagggtgggccttcatccaacaggactgatgtctttataagaacaggagattaggacatggacagaaaaaagaccatgtgaagatacagggaaaacaaggcggccatctacaagagccaaggagagaggcctcggaggaaaccaatcctgctggcaccttgacctcagacttacagcctctagcagggtgagaaggtaactgtcggttgtgtgagccacccaggcgatggtcctttgttacagcacctcaggaaactcacatggggcgcggtagggtgtgccctgtctggaggttccacattcttttttttttctctctctcccaaagactggacagccaaacaacacagagccctggacttctctgtcattgtatatgactccctgagagaatgtaaggaaagaaaagcaatagggtgtcagagaaaggacattggcctggccgggagagctggtgggtttagccaggctacctgagcaagctgctcagtcttgggaactattcaattatgttggcccccatcctatcatcagttaactgaaacacctggcccacaatgacctttaaagagccttccaggactaacaattttgcccctgggtagcaaggggcagcctcagatcatgagcctagaagggagaagccctggaggacagagtgggacaactgcagaaggagcacacagaggtgtgggtgatgtcaggaggctgcttgactctttcctggagctaggagctttcgttcctgtcccagctgctctatttgctaagtgcctcaacttgtccccctcccgggcatctgtaaatgagataataggagtgcacgtgttgtgtaccagtgaaagtctacactatgccaagcatgctcaccattacgaaagaggacaaggacaggtgggtgcccagtggcttctcaagactgacatctacatttatcagattccccaaggggcaactccctgggcaaggcaaggtgggtcttcagagttggggccggagtgcctgtcttctccccaccacaaacctaggtgccacattactatacagtcctaaagatgctttaggattgtggtttcgtgctgaaggaggcaggggagaaatcgtaacttgcatctcccaaaggctagaagtgaaattaagatccttacacacgcttagtggtctgcattttacatagagctttcaccaatacaatctcccaggtattattattcccattttacagatgaagaaaccaaggcaaggggagattaatgatgaaaataaggcagtgtaaaaaaaagcacaaggcttgggttcttactttgacctttaacaaagtcacttaatatcttgttatcacatggcctgcaaacaaagtcctgtagccagtacaagcagggtcaaaacatgacctgaggacttccacccagaacacgccatatgcacatttcacagattcaaataatctcagaactggaagggcccttggcaatcacagatctgattcctttggatttatgccaaggaaactgaggtctaaagatctccttgctcagggtctcacagtgaggctctggctggactaaaaccagagtccagggttctttttcatagaccatcctgccctgtcaatttgacttcaaaatcttcctcttcaacacaaaccacaaccacaaagagaagggtcttctgggttatctgtattgggttgcagaaagaagttccacccgtacccccaaacctggatacttcctccaggccgcacggtgctggcctcctccagcgactttgagcaggagagcaaatgagtcaagctcctctcacaggatgaggctgctgggagcagctcagaggactggaattagaaattctaattattagaactctcggaatgcaccaaaggacaatttataattagcacatgtcaaaaggccatccgcaaaggggacacattataaatcagaaaacaaagatggccccagaaagggactggggagctgagctgtttggcctcccacccctcctgatggccctaaatccaatccacctcccactcctgtgagccctcctccctcctatgccagcctctctcctgctgctctgccctttgcaagcccagcattggtgcttcccgctccctaagccctcttccctctgctgctcggtcagggccactgtccgaaggccttagcacagggatccctctcttcagggtccatgcagctctaaccccaggtcctgagcgggtcagaggcttttggctcctgctgtcacaggctgcaaataaggatttaatgactagcctttttatgaggaagaaaatgtctccagtggactgataatgtcatcgtctgctgctcaggtgcatgtgcccaggtaagcctcacagccagaaccctgctcttatgatgaaagctcagggcacaatcccagtgcagacttggaaaggccagcatgcaaaagaggtcggggcacctccttgtttcttccatgaatgaatgaatgaatggattttctactgacttatatgccataaatattttcttgagtacttcctatgtgttagtcacagcacttgagattggagaggaaaagcagtcaaaaacacagaaataaataagacacgaccctaccctcccagaattcatagtagcacatacttgacaggtgaaaacatttttagaaaaacaaaaacgaaaaccagcaagagaactggcatctgaaggcaggacacctggattccaggaaaagctcttagctgcatgacttgcctcctgccggtcatttgtcttccttgggcctccatcatctgtgccatggagataataccaacttcgtggatcccacaggggttgccatggaaaacatgataaaacacaggaacagaccctctgagaaatgtctgcagtgtaactccttatcataacacgaaacactgaagattctgttggctgataggaataagaattctattttcccacacttgccagtctgactcaagatggcacctagttccttggacaaagatcccaagggtagagaaaggcaatttatcaggccaccatatgtctgtgcttaccaaggaaccttctagatggtgacattttctcatatgctgtggctcacaggggaaagactgcctctatgtctagggatgacaaggttttattccaggagcaaatgaaccccatctgtgtggtagtggctgcctggagcactgtgttaaaaaagatcctgaagttgcatcttggcttggctagaaagaacatcctgatagattatggatgtctgttatgaatatggagttggggagtggcactttgttacttgtgacctaggaagataacatgcccactcaaccacactccttgttgcacacctttctttagagctgtgtcctctggccattcaaaggtgagctgagtattggtcaatgccctgaacacgattccttctgtgtgaattgttaatattaagttcttagagccagcaaagcctaagacatatgcccagcaagaaactgctatttttaggaaattagctggtccttcagacccggttaaatgtgctaggtggtctcagtcatgttctttataaactgagaagaatgcctcacaaatttgggtgtcattagggtctgtggatcccgggcactgccacacaaaatcacccggttcaaataccctgcaggtacatgataccctctgccgttaattctatgccattttgttgaagtctattccacttccttcctttaccacttctcaggacaatgcattctctgagtttattatgagctttatgctctatgaattcttgccatttttctaatatttaccctgcttgcgttttaaaggggacctctctcttagcatgtcaggatgtggcaaagagtctgtactggcttagttgctctgctcacacttttataaaagtctattatgtctgtgttaattcccaacagagctgagctgcagtcaacccctgaactacttattaaaaagaagcactgagcagatgaacgctctgctcatgactgagaggggaagagaacagactgtgtccaagtccatcaacacatcatctgtgcaccaggaatgctccaaacacaaacagccctagtgagtcacaaggatagatgaatgctacggtgattcttacatttgcagtcaggaccacagagtgctggagacaagaggcagcttagaaaccatctagtgactaaagatgcagaaattcaggcccagaacaattaaccggcccacagtgttactccaagccaggtatacttactataaaaaagagtatcacaaaactctacatgtgaggtatttcatttatgtctctttttgctatttcagatggtttcctctcagaactaaaagcacattgtattgcacattgtagatactcaaagtctgttaaataaataaaccaatgaggtaatgtacataaccctgcagaaggatttcagtacaatgctatttataatagcaaaaaagaggaaaaagtaaagagcaaatataaggaaaaggagtgagcatccatataagatatagtcatttaaaatatgtttatagagtcccagtgtcacttggaaatgctgataacgtaatgttaagaagaaaagcagaacactaaatcgcacatattctaggatctcggcattataaagaaaaatgcacagtaatatatttgggggaaaataaaacgaatcatgaacagtagtagatgtttctgttgtgattatgggaggttttatttctgcttctttgcactctgctgttttttgcagataatttacaatgtgcccataggattttcataagcaatgcgagggtattaagaaatagaaaagaatatccacagatattattcagccttgctgggatttggaaagagacagagatcatttctctcttttcacataaagaagctgatgaaacaaagagacagagacactagtgatgaaggcaggcattagctctctggtgtggagggccatccaatgccaggcaaacaacagatgcgggataaaatccactcaaaccacagtgggagggggcaggaggtgtccagtcttcctcttcacaaaggttccatccttaccttatccaaaagatgagcaatacaaggctaggctcagcctttaccagcagagcctccccaaagactctctggcccctgcagccaatgacaataaattaactatcacagtgaggtttttccccttcgtcaggcaatgtgctatacacattgtctcattaaatcctccccatgtctctgaggcaggtcttactgtgcccatctgagggatatagagaccaggactcacacaggtaaacccaggtggccaaggtgtcacagtttgtaaccggaccccagaagcctaagccctcgcccctgtgccccggctggtcattcgttcctccagatctttgcagcactaagaagatgctgcctggtgacatttcctgaattgtttcccacgggtcttgtctttcaggctaggacaagttgtttaacctttcacgtgcgtctgtctctcttgcttccctcaattggactgttagctcctgagggggatgagggggtcctgctttataattccttgtgtgtcccacggagccaagcctggtgatgtcttcagtacttgacacttcagatctcagaaaatacctgctcatcgattattggattgaataggttaaggaggagaaccgtctcatgggcagacctggcctgcagccaagacagaagctggatgcgcctccctccggactcttgaccccaccaaatacgacgcccatatatgtcaactgtggcattggtgtttgtcccccacacccctaaaccacaagccaataaattgcagggcactcagacatcaggatgtgtccttcacttgccaccagacctgagctggctacaggccaatgacagcatagggctggccctgcccgcctcccatctggcagcaaggatccagttccagattgtgacctgtggttgagtctggcacagtgacccagggctccagcaggcaaatcccagtcataaaaccctggtctgaaccagccacgtgatggaccccagttatctcttcctaaattgcagcagagctgatcttcttccagctgagccaagggccatcagacagggacacgtttacttttactatcctattaaagcatcccagaaaaaaagaaacagtccccatatcctagagcaagaaataagcaaatcattatctacaatgatatcctttaagtctaagcttgcccagaaggtgctgcacatttggagaccaggctatggctcccctctctgaattcttttgaaaccgcagggactgttacaggcgcctccaagactctggagccacagcttgcctagcgcagcttccccctcccggcaaagccctccctgacaaccctacccacagtaatctcaactttcatgaaccttttctctccccatagggtgaacacataaagacacacacgtgcagccgggcacggtggctcacacctgtaatcccagcactttgggaggcggaggtgggcagatcacctgaggtcaggagttcgagaccagcctggccaacatggtgaaatcctgtctctactaaaaatacaaaaaaaaaaaaaaaatagccggaggtagtggcgggcgcctgtaatcccagctacttgggaggctaaggcaggagaatctcgaacctggaagggggaggttccagtgagctgagatcatgccactgcactccagcctgggcaacagagtgagactccatctcaaaaaaaaaaaaaagatacacatgtgtatgcacatacacacgcgtgcacacacacacatacacacagcgtgtacatgttatttctccaatgaaagcatatttcccttaagggataggaccaatcacttatctttccagagtctaactgaaaaatggacccaacatccttgaattaataaataaatgaacaaataaatttgttgatggactggtcagttgataatgtcaaggaactccctgcaacagcctacacaggttcaccctcctccaaaatcatacctttccaagtccaaggaaatgctcaattcaatcatgctgttttagaaataaagtaatgaatgatattaacaattgtttagaaactaacaggtgcctggccaggcacgatggctcacgcctataatcccagcactttgggaggccgagacgggcggatcacaaggtcaggagatcgagaccatcctggtgaacacagtgaaagcccatctctactaaaaatatagaaaaattagctgggcatggtggcaggcccctgtagtcccagctacttgggaggctgagacaggagaatggcgtgaaccctggaggcagagcttgcagtgagccgagatcgcaccactgcactgtagcctgggcaacagagagagactctgtctcaaaaaaaaaaaaaaaaagaaagaaactaacaggtgccaggtactaggcttttgatataaatctcatacgttaatcttgtaagtgaggtagtattatcattattatccccattttacaggtaagaagaataaagaccagagggctatccacaactgaagtatagacagtgggtgaggaaacatgaaccaaatggttcttccagactcagggccagatccctggcacaaagtgcctaccctgcattgccttcagctaacgtgccaagcagacagttcccatccttcaattttatttaatcaaagcaaagaattcataagaatctgcccatgttcattattcaggcagattaaatatttgatagccctgtagtttaattttttatggctcagagattggagtgaagtgctccctgggaagccacactgtccctgggacagggcagcagctggccaaggaggccagaggccgaggctccacagggctctgctcagcacccacgtgcatctgtcctgactccagtaagctgctcatgctgggtcccagggccaaaggttacagacactttgtaagtttgcaagagaatctacaaaaaggaaagaagggctgtggggacaggaggcttagggcatcacaaaatcagaaaggaacccagatgaaccaaaacatccaggtcccaggaaggggaggcagcctcctccttctgtctctgaccacgcagcagaaacaaagcttttggacaaatgcatgagacggcataagggcaggatcaacttgtccatctctctgccaactaaagcaccacagggccatttgggaccttttgcctgccccttccagccacatgtaaccttcacagtcactacatattcctcccagttcactgtctccctgcagaagcttgaaagtccacagagaacaagaagagctgggagccaagagtccttcacagcctcaatctgttctcctctggcctaaagaagctctctttcctagtccttttcttatcttcaaaatgaaattccagcagtttttgtctcagctaccccaaaatgcccaaatgtcatgcagcatgatttcaatccctgaactgctccaacccaccccgatgcccccaagtctctctcttgctctccttccctcctttcctccttccctttctccctccttcccttcttctctcccccatccttcctctcttctctctctctctctcacatacacacacacacacacacacacacacacacacacacacacacacacacaccccttgttcttctgtgcctaccatagaacaagacctaatatctaagaatttcactggtacccagtcaacatccaaccaattaatttgttcaagggtttagaggggccaggagaggagactttttcactccagcagcccacggagatttctgttttaatttctttttaattggcagcgccactaacagcatatcagaaatctctctgctccgacccttctcctctcctctgttctcttcaacttttacaagggaaggacatccggcagttttctggaaaaatagagacatgtcacagcagagcccagctcctttttcctgccatccctattcatcaccagcctcctgaggagccggggtggtgacacaggctctcacttcatccatgtggggctcatcggggcaggtgacgaggagaaaggcatgcgccactccccccagagatggggcctgtcgcctcctgggaaaactggggtggagggctctcttccccgatcacctggctctatcttgctctacagacacctcactgggccctcagtactctcatgagaagagagcagacttccagccacccctgcttgccactccaggcctctctgctgatgggtgtatggccacgggacactggaaataacaggagtgtgtggtgagggagaactgtttgcccattttccacattcaagaacctggtgaaaagatgagcaaggattatctccacactggaaccattcatgctgcaaaaacagcactgagacattgaaggggaggaggcaatttatttgctgtcttgacactgtcgcccaagcaattctcatcgtgacaaaagaacactctggacaatcactgcccctcctctttcaggaaaccacactgagttttcatgacttgcaggtgacattttaataaggaatcaacatggaaccacaggggaagtaagctgaggccaggatctaggaggaccagggtgggaggggccaaaaatggcactcaggaaacaaagtcacctacggtgcaaaggctctttgtgcctgcaagtctggcaccgtgggatttctggcttttttctcctctctcatttactatttgggcagaggggaagtattttccagaaaggacaaagtagaagcagcctcagtaaagagctctctagaaacttctcctattcagttggtgttttacaaagtgcaaagcactgcaggcacctccattcacttatcccgttacgtgggtgtcgttatctacatcttataggcaaggaaaatgatgtgcccaaggtcacagagctactgaaagaaggaaggagaaatcagacatttctgtgccacctccttatagaagttgccgtcccccatcataatccaattaatggtaaaaatcacaactgaggctagatatgcagtaactccttgtgctctgcacagtgctaagcactttacatcagttgtctcctattttaatcctcatactaatgccaggagagaggtgttatcactctcatttgtcagatggggaaatcaaggctctgggccatcagtcacttgtcccaggccacagaagcagcaggagcagaaccaggattcaaactgtgtgcccctgcctgtgtatctccatggttctcaatcttgcctatcatcagcatcacctggacaaatggtccaaacaagacatgctgggccccacccaaagagtcgctaagtcagtggggctgaaagcaagcctaagaatctgcatcgccaacaacttcccaagtgaggctcttactgctgatatgaaaactccactttgagaacctctgctctgtctagcctgcctcttgtcacccacaagctaatgtgagcatcctgttagacaagtaatggaacaagatgtgcaaaatgtggctgcaggaagttcacttcctgatgcacaaaatcgctccaagaaatcacacaccatccagaaacacttaagcatcatctgcattaaacatcaactaagggatgttctaagccaatttactctaagactcactctctccttcttctgaacctcctctgctgaaagtgaccatcttccagccagcccacctcatgatcattaaaatacagctgtggagacatagggagcacttctgaatgagcaacccccatcagtgtccactcccacgtgtgtatttgtatgcccatcatgcaccatatggtgctcatattacatacgcaataaagtgcacacagatgtaatcattttaaagagtgataaacgtaaatagaaatagatgtcttaacattttcttcccctattccaaaggatagttttgtgcatcccactttggaggctgctggtctagaattcactgttcccgtttctaatttctgatcattagaatttggcaaccaccccctgcccctgcaggctgaccgagcgtgtctgaagagttgctgtgctctgtggttcgaggaaaagccgtttcctttctgttagcaagcccctagagaacacaggctgaccctccaagacttgcccagcacaagctctgtaagtaaggatggctcagccaaagcttcttgactgtgggggtcttttctccaaaagagaataagaagcatctcagagcccatagagaagacagtggctgtctctaaaagcttttgacctaacaagcaagagcaggagactgagccctcacttctaaagcagcaggaggagagggaactggatcagggtcagagagcaggccttgggatcagcctccaccaataaccatgggtgagactgggaccacactgtgtcccccaaggaccaatgtccttgcttgtcaaatgagatatagggtgaccaaccagtattgtggggcctcccagaatgccagagtttagtgccaaaactgaaacacactagaatgtttggtcaccctagctgtggaccaggtaccgggctctgggcaactataagtgtttatcagccctaccctgacctctgctgtaaggtatcctaggagagcctgagggagctggaggccattccctgctcactagggtgttgcaatcctaacaagatagagataatgataagccatgccaagtcaaatgtcaataccaggtcaaaacagaagctggaaagaggacataatgtaggctgccgtggccaggacagaccttcaggaggagggcagggtgcaggaggaggcagattaagcacacactgaagtattctttcctcaacctcacctcatctcctccctccccttccccaccaccaagtagagcaggaccgcagagaatgaacttaggctctggagtcttcctgtttgattccaaatctggtgctacacttttccttttggagtgatctcgggaccattactcaaactgcatagctgaggtattgttttctttaaaatggagccaattataccccactttccagggttgttctaaagattcaatgaagtaatgcacacagaacactttgaaattgtggctgagagcacaagctctataaatattggctgttcttaacctctcttgacccttttcaatctgttcgtgaatctaaggtattttcaaagaacagtgagctctccatgagaatgagctatcctgaatatttctgttattaatgatgggtacagccggcttagttctgcttctatctgtcactcctgaagccagggaggatgagagggtgtgtggagagaaagtcacagggaagccagccctggccccgggcaaagcccaagggtttctcctggccctgtgcataataagaagcagcttcctctgtctccatttccagctcctagccccaagcaggcaagtcatggaggggtttcccttcctccctagtcccccaggttctgaagaaagaaaggttcagaggccttctccctctgcagaaagggtatgtcacctcaggccatgacaagtccccagctaagcatccgctcaggaccacttaaagctcttgaaaatgagctgtcttagctcatggcaggtttcaagaatccctgcaggatgaaataccagcagtgttccccataaactcagtcagcgatgttgatggtaggaaccaggaaaggtaccgtcctgcctaactttctctccatccagctcagccctagaactcaacacatatagtagaatctagatgagtaaacccccacacagacttggccctgaaattccaccattaggcattcacttctttgatatgaacttcttttctgtaggtaatacatttttttttggttgcctggtatgtcaactggaacacacttaaatgaagaagaccaagattcacctcagcctctccccttagaaatctcgcaagtcaactggggaaaacaagccacacagaagtgtaatacacaaaaagaagtgtatacttcttcaaaaagtatatacttttggtgcaatacacagaaagagagagaagtgcaatacaaaagagagagagagacactatcacacttgccctcaaagggatacccccaacaacactgcacattccccttaccacacccccattgcaccttcaacacaatatcccaataaaagtaattagattaaatggtcattgtttgtcatgggcaattctctcactgtactgtgagttccttgaggcaatttttctctttttatccccaaaatttcgtgcatgggacagagtaagtagtcaatgaagatttttaaaaattgttaattaaggaatattttaataaaagtaaaatggaaatgcaagacattttgagaagggcaccagcttaagccagtggtcctcagagatggccctggacctgcaacatcacctggggatgtgtaagaaatgcaaagttgtccctaccccagaactacaaagtcaggagtccccaggttgggctggtactgtgcgttttaacaaggccatccaggtgatgctaatgcccactcaagtttgagaaccaatgacttcattcagcctttatcatcagacaccttctgcaatatgggttaactgtcctcaactctgtgaatataggcatatattcattcaatatatgcctattaataagcacccatgcagcaaaggccaggtggagccagccctggtcattaggtggcccaacgatgtcgacaagatggcagacaacatggtgagtccctaagcagttactcccaaagaccctcaaaggctgttctgagccaacaggaagaaaggccaccaagttgtggctgtggccagctgactgccctttaggaggagctgtgaggatgagatttcctagcaggaagctgctctggggaagggggatggcatcctgacacctgggagcaacagcctggaccatggattgggaggcggagggaatggggcagggcagtgggccacccaccttgtgccattggctgccggaccctgagcactgactggtttggagcctggtgtctgggctggtaaggaagcaaaggtgaaaggggtgtgggataaggcaaggtgagggagcagctgagccagcatccccttctgatctgttgataggctccacatctaggcctcttctaaacaaaaaggctgagctgccggctcagcagcagctctgtgggtgcacagccctgcccatcatttccccctgtattaggaacaaccgcccaactctggcccctggggcaggcccagagcccaggggtgacgaggagacagcacctcagccctggaaggtaccatgtccaagtgctcctcagccagggcagccatgttctctggaaaccagtagaagtgcagaggacactctgttccccaatcaggggcaaagttgccacaacttctccagacttggttttccagggccataggtcacctgctgacacttcatttaaaccattctcctgttataaaaagggacagtttggccaacctctcaacttacaggccctttagcccagtgtggctagccggctcttcccaggcacccacaggccaggagctaggaatgcctgctccactcaaggcccacctgccccttcccatcttccccctctaggcagagggggtcataagggttgcaggagcctcagacaggggtagatgaccccagggcctacctgtgatctcagggcgatgggtagagctcacagggctgacagacaaaagatagggtgccagttacatttgaaattcagaataaacaagaaataattttttagcataagtatgtctcaaatattgcatagggcatacttaaactaaaaactaaaaaccaaaaacctatcttgcttatctgaaattcaaatgtaactggacaaccttattttctttttatttatttattttttattatttatttattttttttgagatggagtctcactcttgtcgcccaggctggagtggagtggcacgatcttggctgactgcaacctctgcctcccaggttcaagcaattctcctgccttagtctccctggtagctggaattacaggcacccgctaccatacccggctaattttgtttgtatttttagtagagacagggtttcaccacattgaccaggttgacctcgaactcctgacctcaggtgatccgcctgcctcagcctcccaaagtgctgggattacaggcgtgagccaccgcgcctggcctggacaaccttattttcatttgctgaatctaccatccttactctatcagcaagcccagaataggaaaacctggtttttccaaagcagagcttaatatcacaagagaaagagccttgaaaatactatagagtaaggcctcattcacatgggtgaggttgataatttacttcacaggtgagatgacagtatcaaggttctgtctggcctctggcctctggtcaattgattcaaactttggatcccagctctggtgcagctgtgctgcctaacctcagcaagtcactcccccttcctggtggtcagttgtctcatcttcaggttaggacagagtttctcaaccccggcactgttgacattttggtccagattactctttattgaggagggttatcctgtgtattataagatgagcagtgtccctggccgctacgcaccggatgccagcagcacccaccccaatttgccaatgtctcatgggaggcaaaatcatgcctggttgagaaccacggggttaaatgaccctatatcctaatatctagggctcccaccacttttaacagtcgagaattattgggtttacacatgaatttgtggcaaagattcctcttaaatatccaactcccataatgaatctaacaggagatgtgaatgaccagggtttgattacatgtaaactttttaaaaatgtatcctctacctcactcccctcaacctcattccagcattcagaaattgacctagcctgattccagcaagtggctccagctctttgatggccttacagacagcaatgacttaataatactaaaaaataaaattatcatcaccctgattgaagggaatgatttactggaacttcttgggcaaacagtttttgctagtttaatattaatatgactactactaacgatagagtgtgtagagtgcctacaacacgctaagaccacactaggttatgtcatttaatcttcacaatagacctaggaggttggtgctgtgcttattcacatttagcagttgaaaagaaattaggcagtttgcctaaagtcacagactctgcctgtgctctttccaacacagaaacagtctatttacatacagctctcacaggagtagggaaattcattcctccctgggcctccattccaggtaaatactcacagtctttcatctccaggaccgaaatctctaggaccacacagaaccccagtccttatagggctgccacgtacagacaacacactggcttgtaaatgtatcttgaccttgcttttaccttgaaccactctttgtaactccagggcctactgtaggagccctaatcagccctactgtaggagccaggcccacatcaggcactccctcaataaatggttgctaaataactcagtgttcccccatttcaaagatggagacactgaggtccacctctttccgtgcaagtcattatctaaaagaaaaccaacgctggctctcaggttttgtttgtcctgaatccaaaatcccccacagtgctgattcactttgttttcttaacttgctcttaagatcccacatttccttttgtattattagtggatggagagttgattggatttgagtgacctggttgcctggtggcccaaaggactggcccaggagaccactgaagagttctagagcctggatctggaactggggcctggaaaatcgtgtgtccgtgccctcagttactaggtcaccttgagtggggctgccacattgttccatggcccagtttcccctcggacagcatgctgagtgagattccccccacggcgtgctattattacctggcacaccaaggaattaggccactgctacaatgaggccaccccgccctccaagattcttcaaaattctgctccttagagcaggacaacagggcaatgtagggcagtggctccaatttgctgaggactgcaggatgaaagagggcatcttggggtgactgggtgaacactgttctgggacacccagctatgacagaagggaccacagaacaaaagggtgcaaactgtgggcctcaccctggggggaaatgggtttagaagtcatacacacacacacacacacacacacacacacacacacacaccctacatataccaccagggagtctaattttagtagccatttgccccagcaaagcactttgcaagtagttattttgagaaatggtattagccattcggttatttttaatgccccttctgtgacaggcatttgtgacataaacagcagctgaaagaccataaacccatagcccttagatgtgttcagggcccaggcagcagccccttgggatgtcccaagcccaattcaaatggagggaatgggcgagcatcttgtacgccctgccggtcccgcctcactgcctactgctccgttcactggggatgggcagcaagatttgactgaatgggaagcccctctggtctgtgacagccagtgtgctaatgacaaccttcagtgcttgccgacagagtgcaggtgaaaatccacactgctaatgaaggtccctcgtgggctgtccccaacctgatgttctcagaccctgctcccaacacatggcttccacactctctgccttcccacatcctcccctctgctcaagctgacctctcatttggatcagcccactcctcatctctcataacccagcccctgctgatctgcatgctctgattccccataatgaaagagctggatcacctccttggccttctgcatctaatagcttgaattgttggccacctgtgtacttgtatttcttattgaagccactgcatttactctgtactgaggatgcaccaggcatcattctaagcccttaatgaagttcagggaactttcctgaggatcctagctggtatcatcatcatctagattttcgagatgatgaaatggaggtatagggaagttacccaaggcttctttgcaagtagtgctctaagcaagactacagatgcaagagcctcacggtctaggtctaaccctggttctgcaccttggaaccatggacaagttcgtcagtctgtgcctcagtctttccctgagttcctgtaaagattaaatgagttaatgcttatatgatccctttacagatgtctggcacatgacaggcactgtctaagagtcctcgcttgtatgggagtggagaggagaggccagagtattgtaaggtaagatgtattagtgcctacaatgtgttatgcaatgtactaaagcattctgcatgtattatcatatttaatgctcataataccttgtgaaattttacaaagaaattaagcttagagaagtgaaatcattctcctgtggtcaaagccagtgaatggggatttgaaccaggtagctgaacacaagtctaagtttattaacctgaatcctctgctggttgtcttgactctctggaaactgatcatgtcttcagatttcccacagttcctggcactaggttgagcactctaaacagattcaatgccaattgcaggcttctgacaaggcttcctaaatgcagagccctggctgcagatcaggagaccctggcccctccaagggcaccccggctaatcagcctcttcttctgacttctgactccaccccaggacaggcatggtgcttcgaaagcagaagtaaggcagcagaacacttggagaagcctcgctgagggccagggcctggtggttcggatggcagcaagctgcccccagggacccaaaacccaaaggtcaggaatgtagtactggccagccagggcaggcactgctgtgtggtagaagagaagtccagaactgtgaggcgtcaagcgtgagttggaggcaggatggcagtgagaatgcacgcccaactgagcgagtgcgtgtgagtgaattatgtgtgtggttcagttttaggcactgggcagatttgcaaagctcatcaccctcctagagttgcctgcaaaaggccacatgtttaacaccacgtcaatcaatcaacggaggtgcactgggtggggagtgtgtggccaacccagcacggggagccgtgcagctgcagggaagagagcatctctttccccagtggctcatggtcatagccgaggacacaagactggcccttgtgggaaaattgaggggacctgttaaatgctgacctctaatgtggttccagttgagtcaccatatttcttgtgaacctccaaagcactggaagacttctgggcctcgcgtggctgcaggtgaaacatacagccaatcactccaccctggagtcttggtttcctcccctgcagaatgagagtgacgctgataagacatctcaggcagaggcgaaggaggtgagccctgtgggaatttcggctgcccctgtgccaggctgaacaagacagggcctttgctttctgggggctgatgagtcatataaaggggatagaatcaaacactcaaaagacaataaccgcaacacagggctgggtgaataaatacacaactggctactcagaatgggataaccatgggagaggacttttaatgccaaagaaactcaccacgttgcctttgactttgaaaagtgatctgtgcttaatctggcatttcgccaattggaccatgagcaatggggtcccagtcctcattacccagtgcctcctttgcttcaggccagggctgaataggtacttaggacattcctaagaaggactgtgcaggaggaggctagcccagctgcctggctagcctcagcacacacattccctggaacagcagcctcgcttactgccagaccccacaggggtttctgcaggggctggacaaacgggcacatggggatgaaaagggtagagtccccagagtcagtcaatgtcagtgaattggcagccgctgctcacagagctgtctggattctttgcagcccagagagcacctttcaccacccagatggggaggccttgccaaccctgagcccctcagggaggtcatacgtgtgattctcagacaccagagggagcagttttccagagagtgaagaaatgggatccgggaagcttggtgaattcgtctgctggggctgccatcataaagtatcaaaaactgagttggattaaataatagaaatgcattgtctcacaggtctggaggccagaagtctgacatggagatgtcgttggggtcagttccttctgagggctgtgagggcacatgtgttccaggcctctctcctagttttcttgtccttccttggcttacagattcatcaccgcaatctctgccttcatctttataggcattctccctgtgtgcatgtctgtctctgtgtccaaagttcccctttttataaatatgacaccagttattttgggttagagcccacgctaatgatctcatcttaacttgatcatctgcaaagaccttatttccaaataaggtcacattcacaggtacggagggctaggacttcattatctgttggggagacacaattcaaccaataatatttgagttcctcaaaggaaaaacagctttttaaaaagccaaactgaaattcctaacattactaatatactggaacagagtcccaagaagtaggctcaatgtgtgaaggagcttcccggttccagcccccacgttaccccagcccaggcctttgtggcctcccgcctgcactgctctgtgatgggccccttgccggctgccctgacttggcctgtctcccttctgctacctccgcatcaggctgccacaccttgcatctcaccaccaggtccacctcggtcacgacaccttcctggtctaaaggccccagtggcagtcaaccacccagagggctgactgtggctcactccttttgacttcagcacccttggtaatctgcaccaacagaaacatcggccaatgagtgccgtgatttctctgcccgttttctcattcatgaaagggagaaaaaacgaactctccatgcatctactcccaacacattcccctgagaagcctgcggggaagctccctgggagcccattgccaaagcttccacctcatggagctggcgtgtacacagacaggcacagcctgccgtgctgggccaccatactggtgactggctgtgctctggtcccagcccaaggggtgggcaaaagaggaaagccagcctcatgatgagcagaggacagggaagagacccccacaccagggactgacccctccattccctcagaggaagcagaggctactgagccaccagtacccccgcggttcctccctgtagttgctcatggaaagccaccagcctcaggaagtcttcctgtgtggaagctcactggcaccaaggcaggctgagcccctctgccaaaggttctgggcagccatcggtctgataaagacacagagccctccttggaggcctggaagccccacccctagaaggtggtccttgaaagctctgtcactcatttcttctccagagcccctgaagcatcctccatgcagctgtgcccacctgaccatacagcctggccctcccttagcagcaccctggactccattcctaccacctccttgacaacagaatcctgtctgtcaccctcctcaccaggtgcgggtcttcaagataagagaccacctcatgcatgttacaaggaatgctctagaaggagcaccattcaagaaagagaggacagggccgggcacggtggctcacgcctgtaatcccagcactttgggaggccgagatgggcatatcacaaggtcaggagatcgagaccatactggctaacatggtgaaaccccgtctctactaaaaatacaaaaaaattagccaggtgtggtggcgggcgcctgtagtcccatctacttgggagactgaggcaggagaatggcgtgaacccgggaggcaaagcttgcagtgagccaagattgcgccactgcactgcagcctgggtgacagagcgagacactgtctcaaaaaaaaaaaaaaaaaaaaaaaaaaagaggacaggttgagcgccctgtcagaccagtgggcccccaaagctatataccatgtttgtttacctacttgatttctcaacatcactgtgagggagctatgaacatcctcattttacatacaggtaaggtaactgaagttcagctagattaagtgtgttgaccaggacacagcactagcaagagcctgaggacacctggctcctgctgtcacctggctgtcttcacctggtgtcccacaagtacttcaaactctgctctccaaagctctgctcattgtcttcccactcgccatccttaccagcccctacccacactaccttgctcttcctgaatcctttgtcctcactaggacaccaccctctactctgctgaccaggcaaacaaaaggacccaggcgaacaaaaggaccagtgttgcccaaggcctctgcagaggtctgtgcatgcatctcagagagcgaactaaccatgggagttcagcactgatcctattgtgtccttccactggctttttgtctgagctcccactggaaaaaccctgcattcttacttgatgaattttcaaaagcagccagggctttattatcaactgtcttttatgaataatcaaagtccaatggggactccctaattagcctgggcatgaaggccatttgcataacatattgaatgcctctggagtgtcaggtacctcagtagacatgatggttcatgcactaaacctcagcatgtgaccaagcctatggccagacacagatgaacttgaaagtgatgcactggaagtcgatgccccttgagggtgggtgagctcacagagtctattcctgacactgttgctctcacctcgtgacaaagaaccaatgctgctttcttgcatccacccctgagttccagaacccccgcagacaggcttccaaaaactgtgtccccaaactaagactgtgtgatatgtaagaagaactggcaggggacccaacctatattataaaacctcttgatctcctaaaagagagctgagtttaacccgacttagatcaccaggacagatgctatcacagaatcttagaatctgaggttgtaatggtcttctccaattcaatatcaaatccagtgctcccagtcctcttctcctaggactttgtatttgaggtggggaataagggagaaagtggaagatgtggctaacttgcaggtgagtaaaggagaagtcaggaagaagtagtgacttgtcccccaattcccacactcaggagcatgggcagtggagggagaaggatgctgccactggcttcatttacatttgtccatttacaaataccatggcaacaagagctcaggcatgcaatgccctcctgcccagattcctgcttcaaaatcaaaacaaatccagtatgcctggaaaacctgccacagctcagcaaactaggaacaggtgccatcaatgtgccaaaaacctaaaggaatctgaaaaaaaaaaatcagttatgcagaaaaagagaaggcagggaggccccttgggcagctttgctccctgagaagcggcaggatggttgtgaaacaaggagtgaggcccttgaagaacctcacatcagagctgcctacatcagtagggctgaacagggaggtgagccaagtatcaggcaccgggactccctggtcactatggatcacagcagtgttcagcagcagcagcagctctgagaagccctgggaatcacatggcagatacatccagaagaaaactggccagggcaggggcttgtccctgacacagcaggtggcagctccaggaaggaggacaagtccaagcacagtttgtacctggcatgttggccaggttaaacagcaagccagatgcaaacagttggcacaaggtgcagtggctttaccaaacacagagaagaaatatcacaggattaagttccccttctggaactattcatggttccagctcactcacccagactcacaggtctctgcaaggcttcacttcatcatccagtgctctagtgcaagatccgagagtagcattctatgggcaatgaggtgcacagcagaggagcccaagagaattgaccctccctatttacaggcaaacactgactgcattcatggatgcaaaacacgaaaacctcccaccagaccttgaaaacattcttaactataaaaggtagagaatgcagcactcaaaataaataaatttgaaaaaaaaaaggactgggtgggaaagtgccattatcatcatggccaagagcacaggctctgctgtgaaactggctggacctgagtcctggcccccagtcagtacccagatgaggctgagtagggctcaaccctctggacatgcgtttccccaatctatataatgaggacaaacaaagcacatgccccttggagttgttctgaggtaatgcacacaaagtgcttagcacagtgcacagaggacagtctgtgctcagtaaacaactcgtgtgatattgtgataattgaacttggagaaaccatctattctatgtctgcagtaaaagtcaagagaacttatttctgaaacaagatgtgttatgaagggcacatttagaaagcactctcaaaatgaagaggaaaaaaatacagaagcagaaatactgtgaggtctaagacagattatacaaaaagatgacagatatagaggacaggcagccaattcagaataaacctaactgaaaagacgaaaacaaaaaaaagtttcttaacacagaagacagacccaagtctgaaagtcaaaatgctcagtaggcatgtatatatatatatatatatacacacacacacatacacacacacacacacacacatatatatatacacatacatacatatattttaatttcatggtgaagaattatcagcatccaaacagaagatatcagattatctatgaaaaaaaaagagaaaaatcaagctgatatctgatgtctcctctgcaaaacccaacagcagggccaagttgtcattcatattaaaagaaacaaagtgcaaagtgcgataaagcagaatacgttgttcaagaagattaaacaggtgttaaatttttcatatttgtaattaagacattaatcaaaacaaggaattcaacaacaggagatgtccatggtaataaagatctggcaatgaaccctaagatctattaggtttaaataattgttacaactgtgattacaaatcaaaatgaaaatgaaaactaaaatttattggaagagaagataaaatgtgaaaaatataataataataagtagaagttttaaatatcagattataccataaaagcatgagtgtaatattatggaatgggggaatgaaaagaagaaaaattatttatcttacgtggcaaggagtaagaggctatttcactctatacattaaccattggcaaaatatggttgaacaatagttttaaatacttgagaggcagcatgggtagacattccaatttaataaagaaaagtataaaataaaaaatttaaatatctattacagatagacaaaaaagactgcaaaaagcattttttaaaaaacagaaaggccaaaacatattagttattacaatcaaaatgtgtggtacacattatatatagtattaactatatgcaataatatataataaataaatatataaaattatacactgtttataagaaatataccctaaaccaagtgacaaaataaggttaaaagtaaaagaataaaccagaatatgccaggcaaaaatcaagtgaggctcacacctgtaatcccactgctttgggaggccgaggtggcaggatcacttgaggccaggagtttgaaaccagccagggcaatatagtgagacaccatctctaccaaactgtaaaaagcaagctaaggagtgatgccaagttaaaggcaatggtatccaagcaagtgaaattcaaggcaaaagacattaaataaggcaacacaggaggtttcacattgatggagataatccaaagtgagtatctaaaagtcaatgacttttaggcacaaaggaagcctcacaacacaaaacatcaaattgtcaaaaataagaggagacaagtgacagaaacccagtagcagtagaggagtttactgaagtactattgctctctcatatattaagttgtccaaaactaaacataattatgggtgattagaaggctggaatttctgcgttaactggtcaactggagagaactggtagaaagctcaaccctctggttttggaggttggaaactgagacgggatgatgagtcagtacagcacagactagtgtggtccctgggctttacctcaaatggaaacttattaaaaacacacattctcagacctatcgcagacctgaccgaaatcagaaactctggagtggggccaagccctccaggttgttctaatgcaggctcaaggctaagacccaccaaggcaacaattaagcccataggctctggagggccagggccaaatcctgccccatttcagcattgttgggtgacatcaaacaagttgcttaacctctctatgcctccattatcatcatccataaactgagaagaagaagaatagtgcctcctcttggcatggccctgaggacaagatgagatcatgtggacacaggctcacagtgcctgcacggtgtgagcactcattgatggcttgctttggttcaggaatgcttggcagagctgtgcctccagccccactgctctcctgcctcccaacacccagaggtgttgagggtgaactcctctgcacccaatcctctgtgcatgtgcctgaggaggatggactgtcccctgacaatggatggatgccacctcatggctgatcactgctgcatgaggcagtgtcataaacccctccttgatgctctctggctggagcggccagttgagtgactcatggagcttgtcatctcagggcctccttccctgatgcacacggccctctatccctgccccccagcctgattcctcctccccctggcaagactgcagagctgagcagaggctgacccgatctgggcccctcgtctctgcagaagagagaaagccagcatgcagcggactcctgggcaagttccaggatgctgtcctcaagtaccacgtggccactgctacccatggtggggtgggagcaggggcaggcagaggccttgggccacagaacaaattctctctgtctgtgagcagaccagggtcaggtgtgtcctagttaaatcaaaatgtcctgtggggcaggaaacagtttttccactcataaagatgcagttcaaatttgagatgtgtcagggatttcactgtggctgactgtgtgtcatcatgattagatcatacactcgagcattttagagctgtaagtccctatggaaatcaccctgtgtatccccctcctctgccaggtgagacccatgaaggacagagaggccctaaggcagccccaaggtcacacaacataaaaatctaacagcaagaatggaaaagaaactgccttctaccacattgggttgccatgaaacctaacagctgggggcgcctgggaagagagaaaaagtcacgaagtttcttcctgacactcccactgacaatcgtgattctgacaccagaaatgccttttcttcatagcatttcccttacatggagaaatacacctcttgtcttgcttcattcacagttaaatatgcttaggaagacgaggagacggaggcccgtactcttgagccacccacctctgaatccacctgcctctggatccaccaaaatacctgcccttcctatttgcccgaatgctctcatgtttcagagccctctcctccaggaagccctccctgcaaacttcatcttaccatccccttttccatcctggatactctagagaaatcagagctcagattgaagctgagtcctcagactttcagttgcgtctgatttggaaggagaaagaagaacccccacatctctggcacccccatggacaccaagagaagaacttcagtccatctgacagcaaagcctgaactctttcttcactgagttcaaatttgcctctaccactcacccaccctttgtcatcaggcaagccacttacaactctccgagcctcaattttcccacctggaaaagggcaataataataataccttcctcctaggttggtgtgaggattaaataagattacatgtgcaaaagctccaagcacccacaatagataccgaactggaagtcactataataaaactgataatgacaacgatagtgatggtgataaatatcattagtgtataatccatacttggaccaatttgggttttttgttcaagaccgctcggtgagctgagtgtggcggcacatgcctgtaatcctagctgcttgagaggctgaagctggaggaccgcttgagcccaggagtttgagacaagcctaggcaacatagctagatcctctcttctaaaagaaaaacaaaacaaaaccaagaccacttggcaactctatcaaagaaaggtaaacaggtaagagctttttgggttaaaatgttgcagggatctgaactcccacccctctaggccagggaaggagaatgggagtggtaagagacttcctagtttaaaaatataacaataaaatccatcttccaaataaaaactgacctagtacacattttggattttttttctttcttccaaagctctgagagttagttgaatcctttaaaaagacagcatgctcacctctttctccctagcaccaatgatttggagagacagatcacttcacttctgacattctagatacatctatatgttgggattctccgtccacccagctagggcattctatgaagccaagaatttagttctaagctcccaaaggaagctctatttcaaaaagccgggtggctttatttcaaattgaagaggccattaaattcacaatattttgccaaatgaatttctcagtgatcctgagcaatcctctgaagtcagctgtccttgtgcagtcatgggcccagcacagagcaggcgtacatactaagcacctgttccagcaggtagagacagtgtagtgactgggacaagcctctgccctcatggatccagcactccttaaacaatttctgaagaaactcaggggagccagtgactggtacattctctgtttgagctgccacaagtgctgcgggatttttcagtgctggaaggggtccccaccatattagcaacaaggtatcaagtgccaaacactgtgcgacatcttacctaagttttcactgggcattttctgtttagtaagtcaggcactgagggagggaacatgtgacatgtccaatgttcagcttggcaaacagtgaagagggggtccaatggggggcagggcgcaggtggctgggatatggtgctggagggtctctccacatagggatacaattgggtagcatctccatcagctgacgtgttcccaattgtcctttcttggttatctgcctgcctggcaagaatgtgtttcttacactgccgccatgagcttacacttcactcactatacaatttattccactcacttttcacagtgatagcaggttgcccatatggctttatctcttctggaaagggagagtgagcatgtcccttgccccatcaccctccagatatggtgtctgtgcagctggcaggattggaacccagttctgtttcactgctcttcaagtgtaaccttcatcatagtctacaccctgcagaggagaagccatggagtgggaaggcagtgatggggaaccgagcaaccgagaggggtgccagactagcccagatccttgcaaactttcccatgacagccctgaaggcagaaaagaagaaacttttacctcctacctcagggagtctggattagaatttgaagcaagccttccacaagcagacagtttctttatatatattttaaattttatctttttatttttgttatatttttagagacagggtctcactctgttgcccatgctggactgcagtagtgcaatcatagctcattgcactatgatgcaatgaactcctgggctcaagcaattctcctgcctcagcctcccaaatcactaggtattacaggcatgagtcaccatgtccagccaggaagcttctttaaattgttgcattttatcttttaaaatatgtatgcatattttattcctcctcatgacaaatgtgattgaatacaaaataatattcattcccaaaccttcaagaagaactggttctccaggaaaatgtgccatgattatactgcagcttctagcattccctgtgaggctctgggctgtgcacctctaatgctggaaagtccaaatccaggagactcgggtctcctgagattccttggccatctgttcattcatgccatccactcactgattcagggcccagaggagcaccagggttaacggctggcggctgagtcagcagctctcaaggcaatcaccttttccacctactcatgaatcactaacctgctgcccccttgctacgtgcctggaaatgcataaatgtgcttaaaataagtggtacctgggtagcaagtttctcaccagcaggaaccagtccaagtgagtacagggcaaatagcagtgcggggtgaaaataaagactgactaccactggcaacccttggtcactcttcatttattcatccaacattgctgaatatttgccctgtgcaaggctccatgccctggcaatggggggcacttgaaggcaaataagagctttacaaggctctaggagatgtcactagtattccaaaaaccctaacagaagatacaaaagattagtgccattagagaggaaatggggtagaagctttggttggggggaagctcattagttagaggagagagatgttacttctaacttagaacatcaaaaacagaagcttcctggctttagccccaggccatgaagaatgagtggaatttcaggatacacagacaagaaagcagaaaagataaaatgaactcccacataaggcaggagataggggtgactagttatgtgggttgcagcccaggaacacagggaggaatgatggagatctttgagcaccaagaagagaagtttggactttttgttttcctttggttaatgaggagccatgaaagagtatttgtggaggaaagtgaagtaattagctaacatttagaaagtttaagtgggtagtaagatgtatgactaatcagaaatgacagagtcacgagaccagctggaagagtactgcaagagtccaagcaagcagcaatggaagcctgaactagaaaagagacagcagcagtggagaagagttgagccacgaggatttggcaactgactagagaaggcaccaggagaagcaagtccctgaaaaccatgctgcttgggaaagaccaactctttctctcatttcctcttagggaattgtaaaaggaattccctatcaccatttaaatttggttaaattcaccaaagagtgatggggtgaatcactctttggtgactaacccctctggctcttgtgtagagctaattagagtttcttctggaagatctgaaaccaccaacagtgagactcctcagatgaccctgatgggcaggtccatgattcaatctgtttcttccagcatctccccactggctgcagcacatctaggggttcaacctaagggagcccccctactctgggtatggttagagctcctttcaagatcattctaatatcaaaagagggaatcttcaaggagccttgttggcttcttatacttagagagaaaccaagaacacagtcagagttgatgtttttaaataccaaatctgtatgcatctatcagagagacagagagagaaagagagagagagagttagagagagacagagttttgaaacatggagagagggaaagagagatgttcctagagagagagagagagagagagagagtgtgtgtgtgtgtgtgtgtgtgttagagagggagagagacagagagggagagagagagagagagagagagctttgaaatatgaagagagagagggaaagagagatgttccgagagagagagagagagagtgtgtgtgtgtgtgtttgttagagagggagagagagagagagagagagctttgaaatatgaagaaagagagagaaagatgttccgagagagagagaaagagagagagagagagagtgtgtgtgtgtgtgtgtgtgtgtgtgtgtgttagagagggagagagagagagctttgaaatatgaagagagagagtaaaagacagatgttcctatgaagccctcagctcctaaccctctctctggctcagtgtttgaagcccctccagccgcccatggcaaaacttccttccagaggagcaggccatgcatcccagacccatgtgtatgctgtcccctaagaatgagagcagtgctctgtttcccaaatgggcaggggaagcaaacttttgtttccatagtctataaaacatttttaaatttaaaaacaaatgctttgcagcctctgaattattagttttttattaaaaatacaaacagctctatggaacaccatgggaaaatgaggactcttgcaacttcgtttggctccctgttaaacagaataatgttcatgaggaagaaggtactgtttgttccttaaaatgttgtattgcgtacaatggagaagagcaacgtggagatgactttccaatgtgttcccttgaaatgacctgaggaccgaatcaggaagctcagtctgaccagctcagcagactacccccactgccccatcccagagctgaacttgcagtcagccctgataaaaatctctggactagaaccagagcaccaatatcaagggattatccatgaactgactgttctttcctgcaggcaggctccacgctcctgggtggccagagtgccaatcagccctgtcccagtgctctaacgaggtgcccattcactgcccaagagacaacatgcccaagctatgacccagctccaagatctgaagggaccagactgccttcctgtttttctctgcatcccctgagctccctcttgaaaagggaaggaaagctaacagaaaagccactttctcacacacttttggtgagatttcatgaaagctgcatgacctttctggaaagcaacttggcaatgtatagagaatcttaaaaaacatgtgcatcctttggcccagcaattctgcttctaggaatctgtcctaaagaaacaagtctgtgatgtaaataaaaatggacatattcagttcttgactgcagtgcaacctgaaacactgaaaaactgaaaataactcagaggaccaacaatagggagatggttaagtaaactgcagtgtatctacttgggaaactaatatgcatcatttaaaagcatagcttcaaagaattattgataaaacaggaagatatttatgtatgcatctaaatgcatagagaaaagagtgacataaaacattcaaatatgaacagcaatcatctctaggatttaactgctgctttcatttttatttgattttattttgagacagggtatcactgtatcacccagccggcaatgcagtggcacgatctcagctcactgaaccgcaaccccctgggctcaagcaatcctcccacctcaacctcctaagtagctgggactacagatacgcatcaccatgcctggctattttttttttttttttgtaatttttgtagagatggggtttcatcatgttacccagggtggtttcaaactcctaggctcaagcagtctgcctgcctcggcctcccaaagttccaggattagaggcgcgagtccccccactcagcctgctttgacttttatgctctttttattgtggcaaaataaatatcacataaaatttaccattggaaccacttttcctttttcttttttttttcttttctttttttttttttttttgtagaggtgctctctccctctctctctctttttttctttttgtaaaggcatgatctcactacgttgcctaggctggtattgaactaagtgtctagttctatagcacgaagtacattcacattgtggtgcaactatcatcaccatccacgtccagaattttttcatcaacccatggtgaaaccctgtaaccaaaaacatctccctattccctccacctccagcctctggccaccaccattcgctttttgtctctgtgaatttgcctactccaggtatctcatataagtggaatcacacagtattgtgttttgtctttttgcgactggcttattccacttagcataatgtcctcaaggtgtgttcacccatgttgtagcatgtggcaggattaccttccttttcaaggtagaataatcactgtatgtctatgccacattgaacggacatttcagttgattctacctcttggttactgttttttgttgttgtcattttgttgggttttgttgttgttgttgttgttgttgttgttgttgttgtttgacagagtatcactctgtcacccaggctggagtgcagtgatgcaatctcggctcactgcaacctccgcctcccagcttccagtgattctcctgcctcagcctccagtagctgggattacaggtgcacaccaccatgcctggctaatttttgtctttttagtagagacggggtttgaccatgttgaccaggctagtctcgaactcgtgacctcagtgatctgcctgactcagcctctcaaagttctcggattataggcgtgagccaccatgcccggccctacctcttggttattgtgaataatgctgttatgaagatgggtttgcaaatatcgttttgatttcctgcattcatatcttttggttatataccccaaagtggaactgctggatcatggtaattctatgtgtcatattttgaggaactgccatactgttttccacagtgaatgcatcattttacattcccgccagcaatggacaagggttccaatttctccacatcctgtcaacacttgttgttttccaacttttttgataatagccatcctaatggatatgcatttttatgcttttatgtattttcagaatctccttcgggaagcatgtggtatgtttataataagaaaaacaaaaattaacgttatgttttaaaactgtgctagggaatggctcactggatgttatccactttactcctcaatgctgctgggctaacagtcctcctcccaccctcagcaaggcacagctaaattctggggatcattagttgtcaaacaccaactctatggcaagtggagtgcaagaccctacaaccttatggggctgatatcataacccaattagcacaatcccactgctgctgcttggaggcctggttctccttccatgagtgttgctcctttctccccactcctaccccccacttcaagctccaagcgatgacaggagtatagaaaggaaagaaaagagatttggggattcacacagtcctggggtacaatcgcagctccacagttgctcagtgataagataagcaatgtcaccttcctggacctcagattgctcatctgctaattgggtgatggtatcaggttcataagtttgtagggtcttgcactccacttgccatagagtcagtgtttgacaaataaggatccctattcatttctggaattgtgcatagcttctgccacaggaagaaatacagcatacctactagtaaataccacttaattgactgattgaaagaaacccgtcactgtgaggatcccaattcaattatttatgtcctctcctggaagcctctatggagtgcaggtttctcaaacatagtcctgttctcttctcctcaaacaaaggatctcaggatcaaataagcctgggaagcacaaagattgttatcttcaaaaacagcaaaagaataataattaacatatgaaaggtctgtaaccaagaaacctatgtttctctggcaagaccctgtctctacaaaaaaaaaaaagaaaaaattagctgggcatgggggcacacgcctgtagtcccagctacttgggagcctgaggcaggaggatcacttgagcccaggaattcaaggctgcagcgagctatgacagcgccactgcactccagcctgagcaacaagaaaggccctgcttctttagaaaaataaaaaaggagaaacctatgtttctgaaacatattgaccactgaacacctttttggcataacgccaattaacaacacatggagatgactttccatgtggaaacacatggaaataacatatctccaacacatggagataacgccgattaacaacacatggagtgagcagtgctgctccactcctcatccgacctgaaacctggaagtctggttcctcaaggacatcgagccttgaatttccacatgcaaacacctgtgagtatgttggggctgctgcagatcagcagtctcaaaattcatagagcatgagaatcaccaggaaggcttgttaaaccagcgtcctgggccccagcctcagtttctgattcagcagctctgggctgggacccaagaatgtgcatttctaacaaattcccaggtgatgctgatgctgttgacccagggaccccattttgagaaccactgatgcagacagtcaaaaacccctcacatacaagtttaatacaggaccatacaggaaatctgtctactttctgcaatgccaaagaaatcaagtataattcagaacttgaaacatccattctcttctgggacaagttcttaaaggaagcatttcatagtagttaagaaaatggactctggagtcagaaaagagcacgtttgcaagtcccagatctcccagtgcctggctgtgtgaacacagcaagttattaaaacttcccaagccacagcctctttatctctaagggagagaaaatcatggcaatgcctagttcatagaatttctgtgatgcagaaataaagcaagcaggatgcttggggaatgcctggcatctagtaagtgctcaataaagattggttattctttttaatgactgttatttaatcatcttatctggtaaatagctcatctgcgtactgtcagctgacctcaggatgtgactatacagtcgtccctgtcatgggcgaatgcaggctgatggcacaggggtaaaagaatttaccaagaaaatcataggtcaagaaaggcagatttattagagaaagtggggaaatatgttgcctgagagacaatgggcaagttagcctgagagaagctaacttccagaagacaaaagcttgctgcagattttagagaatggaacttgggctgattgataatgccaaggcagcagggagcttaacttgcattcctctgtcagcctggatgtttgataaattgaggtgtttgatggtgagcaggaagcccgggagttatgtatgttatccgggcatgaaggccaaatgtcttgggtcatatatcctgggccatatgccctgggccacaaagaaaggcagacctgtaacttatctggtttctcttttgtttaaattctctggacgtgaagaaaggcagatttatagcttatctgctttatctcttgctttcccctggtcccaccagcctgactccttttccctaattaggactccacagtccccccttatccatagtttcacttttcattttttcagttacccacagtacagtacaatgaggaatttttgtgctctgtaatgagacagagcacagtcacatgacttttattacagtatattgttataattgcacaattttattattcattactgttgctcatctgtcactgtacctaatttataaattaaactttattgcagatatgcctgtgtaggagaaaacacagtatatacaggtatcggtactatccatctgcagttccaggcatccactggggtcttggaatgtaacccctaaagataagggcatctactgtatttggagacagggtctttaaagaagtaattaagttaaaatgaggtcattagggtgggccctcatccaatataactggagcccttataagaaaaggagattagggcacagacttacactgagaagacagtgtgaagacatggggagaagacagccacctacaagctaggcagagaggcctgtgatgaaaccaaccctgtcaacaccatgatcttggacttccagatagtaaggactgagacggtatatccgacttgagccttaagtccaagccaccgttccactattaactcccaccaggacaagtgcagtggcctgaggggcccttctgcttccactcctgcccttactccctggccttactgttacaagagtgaacttcaccagtgttaaccagatcacacgcgtggctgcctaaattcctccaatatgtcacctaatactgagaaggaaatccaagctcctcaccatggccaacaaagccctgaaaaacggcccctgccagcctccccctacccagcatttcccccacccccaccatcaccacctcatgccctaaactccactcagagtggcgtttttgctgtttcagaaacaagcaagctaatccttgccaccaggcctttgcactagctggtgctactacgtggaacgctcttcccccaaatttcctcctggctggcttcctctgagttcaaatgtcttctcctcggagaggcttttcccatccatcacaaagaaaccctcagcatcatctcacgctattgtcttcctacaagttagcagtagcttatcactgtctccctgagagcagccaccgtagctatcgaatgcactgctgcctcccgggagcctagcacttattccaaggccttggagcttagtaaatatgtgttgcctggataatgtatgtgaaagagctttgcaaactgtaaagtgctgcataaatgtaagataatgtcacaaatatcaaaaagagccagccaaataattcaaagaaaataggaaacaaggggagaagagggatgaggaattcagaatgaagctgagagatttcaagtgatgattcaagaaataaaccaagcaaccaattttgttaaatatgtgaggccacagggcgagggaagcacaaaccactccaatgatccattcaggccatgtctgctccactcagccatagaaactgcataaattacaggcagcagcagttttcctggagccaggcagtagaacactctccttggtgccggcctgggaggaggatcctggcctggcaagcagggctgactcaagctcattgcattagccctcccctcctgcatctgggcccctctcaccgcagtgctgcctgcccaggacctgcactcctccagcgggcgggactgtgactcacagatggcctgtcactcccagtgccagcacagagcaccacccgtgcctatctttagaagtttcgcaggctgaaaaatcaatttgcccgcctggcacctgggtctggggcctccccgctaacatcagtggcaggcgaaatgtggcctcccctctgcctgccctgatgcgtcagaccttactcagggtcccgagggcctggcagtgccgcccaacagactcctgtgagctgctgcacccacaggtgtgctggtctgcccctcagagatagccaggcctcaccagaagatgcgggcaaacaccacgccctagaaaatactggcaagggggaagcgaatcactttgcatcctggctgcctgactggcacattccccaggtggtcatctggcacctaatccatgtgtggtcacagcaaactggcttgcccaggtggtacaagttcagcctcttcctccaagcagggaccagaggtaagagaacagcacacaactccacgccttaataaaaaggcccaggaggcagattcccaacgcagtgacaactcccagctggcccccaggcttcccaactactgaaaatggccacatgtgactcccacaagccaaagggaccctgtattactgggtatgcggagagagaaccatctcagacatttcaccatattaataatctctctttcaataaagactcgctgagcacctggcagtggcagggtgggtggaatagggtaagaataagctgaggaacaagagaaaggaaatctctggccctggccctgtactttctccttgcacctgtgggcgctctgtgctcagcctttgagatttccaaatcccctctgaccttctgcctcttcactcacgtctagacaccatttttacagaaaccaggagctactgcctgttttgtttttttttgttttttttccagtaatacagcctagggccctgcccaccccacctccttttctttatgagatacagtgaagtccagctgtcctgcagcagatgaaaacagagagagggctctcacccgctagctctagttgagaaatgagaatgccccagaagagcttaagggctcaaaagccatctctgagaatttgcagaagcacaatcctacatgtttgcttccttaatccaaaaaaggatccaaggtcatgtgtctacaggagccagcctgttacggtgagtgaggggtgctgcattcagcaccgggggatgggggggaaaggagagcgtgcaatggctctgcccaaaccaatcatcaccatgaggggacacaggcacacaaaggtacattttcaatcttttattttttcaaaaacagctagcaatccagatttttatccaaaatctcctttgtaaatataggcaattgatgaaaaaaaaaattaaaaaacaatgaagccacatgggctaaaccaaacacacctgtagactgccagtttgtcccctctcataggtaggatggggtgactgaattctggggagcacgttcagaggtcgctatctttctctgcttctccccagagaggtcttcctaggctgcctctcagacacacagcaccagccagagggcaaggaccaactgataagccaggaagtgtggctcccatcactttgaggagggaatcaggaactctttggaaacccctgctgtacaccttgctggtgccatttcccaaatatttgtggttcacccctcggctttcagtgtctctttccttctctgcctccccacccagggctaactcctctccttcctgaagactctgttcaagcatcagctcctccaaagagctgcccactaagcagtgcccctccctccagcccctgggctgggaggcttcccggcacctggcatatcatgcactctgcatgcccacacacaacttccaggcacttgattgaccctcactagcagggagctcctcaagagaagggctggttctcttccatccctgttatccctgcagccagcgcagatcttggaacacagagcagctccacacagaactgaaccagcaacttctccaggagcaaatgttttctgagcactggcctataccaggtgcatgcgaagggtgcataaggccactgagatgaatttgacatatccaggggcttcagaggatcacagtctcttgggtctgacagatgtttaagaaatccccatcatgtagagtacccacagcccacccccctactccgccccgccacagccaccctcctcccatccttcctgggtcttggccacacttgctcttccttctgcctgcaacatggccctttcctgaaatctgctccaaactccccttaacaaagagctttctctccatgcaccctccatagcactattttttcccattccctgtttcatttgtgcttgtgcacttatggccacctggcttctcctgtttccctatttgtcctgtctgtggtctgtctccactactagacctaacccaatgagggcagggcctgcatctgcttcgttttctgcagtatgcccggtgcagaggacagcgcctgacccatggtaggtgcacagtaaacagtggttacccgaatgaatttaagaatgagaaagtaagatacgttccaaaagctctgcatgctgcaaaggcctctgagcctctatatgctgagaggcagctggacctctgcctcctcctttgcacggtgggcagagcacctgcagaactttccacttctcatgcctcatcatgtgtctgggctccggctccggtgctgcaaagcaggtgaagggccccctgtgcaagtgtaagaggctaaaacgggggtgcctgtgtgagcggctggtgtggggtgggcacctgccggtgtacgggagactgaagggtggagagggcctctcatgcaggcatgtgtgagcagctgcaggtgtgtgagcaaatgtgcatcactggggaacaggtgtctgtggatgagggaggaagtgagggtgagggtgtttgtggacatagggatgtgtgttttttacaaaaaaaaaaaaaacaaaaggtgaggggaagccggcctgcatacatgtgcatgcatgtgaacatgcgtgtgtgaatgtggggaagggcgcattggtgaaaaaggtgctggtgctttttctccctgatgcaaactcaggctggagagactgggactaggcagaccctacccttggcactccaggaagagttcctccctctatgaagagctgcctgacctcattcaaggtgtacagaaagaaagcagtgtcaccggaacccaggcctccaccataaatgggccagaggcaattccacagcagtaaccgggcaggcaaaaccacccctggaaaacacaagctgacacgaaggatgagcctctcaggccccctgggcgtggggtccctggaatccctctgtccctggctcctagtgattttacaccaaggctgaacacatagatttgaggcaccagtgcagtgcaggacatgggcgtgttattaccagctccatggttaatgagcattgcatccactgggagcagccaggctggggatgctaagacctgctgggtggttctgctgagttggggctcatggggcaagaaggccagtttctgccagcccctcccagcagcagtgagacaaggacacagacactgaagggcccgtgttctcagcctctccccctccgactcctgcccatcttcctggtcacatctcctcccaccgtctgccttgcttgctgagtccatgcatttgttcatttccccattcaacaaggaggtatcaagcaccactatttcccaggcacattcctagggtgtagaactgaaaaacacaggtaaagtactgcctccatgcaacagacattgtagttgaggaaacaggcgataagccaaactgataagagaaatataaggtgtgttaagacaaatataagatggtgacaaatgccccagagaaaataataaaatagggaagggaggcaggaagaggggccgttaatcagggtagccaaggaaactctccagcagccagcctcgttccctccccagaggcttcacagctgctgttccacacacctgaagtactgttccctcaaagatcccccatagtttccttttccaggcaagttgatcttgttccactcattggccacttccttagaaagaccctccctggccaactacataaaacaggttccccattgcactcacatcactatccccttagcctgtttcatattctaaaaccagttctcattatctgaagttagtttattatttatttactatgtttctgcctcccccagtgaaatatgaggtctcaaaggagagaggatgtgtgtcttgctgaccactatatcttcagcacccagaacaggccaacacatggcaggccctgggactgaaatttcatagtccacttcttgttcctttgggttaagcaatgccctcccccagcatccatttaaaaatactctcaggcaagtgatacatgaagtcatgaacactctagtatgaatccgtcacttctctctaggggctgctcagaaatctaggagcacgtgttagtactgagggaaggggacagggccgaaggaagaagcccacaggctgcctgcccaagcacaggactggaagggaggaggcctgggtgtggtgccagctctgtccccagcttctgggtaacctctctaagcatccgtttcttcatgacttagagctgagagggagctcttggtcacctatgctttggggactccagcggggaggaaatgagtcaattaggaggacatgaagttggctgcctcctcactttgccatcaaagacaataggtctatgttctgatccctgcctcagacaaaatggagaaaacccaaagatagtgggaagccgcctgcactgtatgaatgcacgcttggagaagactgtctccctgctgcccagcacccactgtccacgcatggttactattagaaagttaatcatggaaaatgctgaggtctctttccccagccctgcacctctcagctccacactacaatttcatcttccatatagtgttaccagacagtgccattggctccgtccactcacttgtcccaggcctttatgacctttccattcaagccacacaccacgtctgctccacagagctgtaagacacactggcttcagcccgcctggcctgggccagcacgctgacattttccatgagtccacatcagccagtgaaatgctcagaggggattaaggcaaccttctccatcacccccgagttgctttaggaaagagaataacagcactgacccctccattggcagctggtgatatccacacaccatctctatccagagatgaaaggctccttctccatccttgacttgcaaaacagggattatttcccacctcacgctttctgaaatatcaccaaagatgcagctgtgtttgaaggccagcctcataaaaggcgtaggacccacgtgtcagtcaacactccactgagaagataattgattttttttttgttttatgattatttgcgggcactggttctctttccattagcctggataatcgagggaagactgtaaagagtattaatatcacggccaaggtcactcagctggctcctgctgccattccaacccaaaggctgaattactatggcttttactaataataacaagaacaataaataacatgagtgattataaagccagggaactctgcaattacctcaacaattaacacatcccttcgtgaaacacagaacagaaaaaattttcaaaggttcaagttagaaaacttctgcattctgtttggtgcaagtgacagtcagaaaagggccttgtttgagggtatgcagtgtgagagtatgcagtgtgagggtatacatgaggtctgcagtatgcagtgcagtgtgagggtatgcagtgtgaggtgtgcagtatgcagcgtgagggtatgcagtgtgaggtctggggtatgcagtgtgagggtgtgcagtgtgaggtctggcatatgcagtgtgagggctggggtatgcagtgtgagggtgtgcagtgtgagggtgtgcagtgtgagggtgtgcagtgtgaggtctggagtatgcagtgtgagggtgtgcagtgtgaggtccggggtatgcagtgtgagggtgtgcagtgtgaggtctggcatatgcagtgtgagggctggggtatgcagtgtgagggtgtgcagtgtgaggtctggggtatgcagtgtgagggtatgcagtgtgaggtctggggtgtgcagtgtgaggtctgggatatgtggtgtgagggtatgcagtgtgagggtgtgcagtgtgagggtatccagtgtgaggtctggggtatgcaatgtgaggtctggggctggctccagttggtttccaactttaccaggtgtgtggcccgggcaagtcacttcatctcagcaggttcctgcacataggggctggtgaggactcaaggataaggcacactaaagggcttggcacagtgaccagcaggtagcagcactctctaagtattagctgccattgttgtctttatcattaatgtaactacatcttaattaggaatgatgggatctcatttggcccccacaccaatccaggaattgagatgagaatagtgtttcctctaccatccatcagccaatatccagcagccaccccaggggaggccactggtcatcccacgccatataaagttcactgcccctggatggtaggctcaccccaagcctgctccctcatcctcattcccatcctcaacagagaggaaagtccaccactgtctccattttaaagaggcagcctgtgacatccaagagaccttccagcctcagggaaaggcgtgaacaagagctccagctgggtctttacagatgaagccccactttggtacctcttctcctaacaaccccagcttttggaagacatcaaaattccaaaggctcagctgcagaaagatcttccaaatttctcattatagttattccctgaaaggccaagagctttattcttcatccatttactcaacactttcatggagcaactgctacgacgtgtcagcctctgcaggaggcagctttaaactaagtgtgacagatgagaaagaaccataacacacaaagcagggagaacagtgattccagccaaagaaaacagcatgtgcaaaggccctgaggtgcataaaatttggcatgttctctgtggatagggttctaaatcatgtccaggacagggggacacctttgtgtcaccctcatctgaaagcaacctttaagaagccacaggacagactgtcttcaactcagaaaacctccctgatacccatcttccatcctccacccctacattctcactcttgtctggtttcctcagttaccatcctggtgcctaatttctggtggcagcaaagtgcaagattagaggcccacacactagtgcccggaagcttgggcttcaatcccagatccgccaattatggcttcagtggtttggggcaagtgatttaactgcctctctgtgcctcagtttcctcatctgtaaaccatggataacagagaacctctttggagatctgctgtaaggatcggacaagtaaaaagaagtgaggctcttggataaataaatatctaaggcacatagaagttccctgaaaatgtgggcattatcaatatttattttaagcatcatcatttttcttattatattccctttctccatctggtcccttgagagtgatgactcggttgaatgaatgacacccaccccagtttctcaccccatctcccaacaccaggatccttttgcctagtgggtggttatcacttagatgtgcccatccccaaacctcacttgatatagtgatttctggagaccctaagaggactcagggaccaggcacggtggctcatgcctgtaatcccagcactttgggaggtcgaggcaggtagatcacctgaggtcaggagtttcagaccagcctggccaacatggcaaaacctatctctactaaaaatacaaaaattagccaggcgtggtggcaggtccctgtaatcccagctgctcaggaggctgaggcaggagaatcacttgaacccaggaggcggaggttgcagtgagccaagatcatgtcactgcactactccagcctgggtgacagagcaagactccatctcaaaataaataaataaataaataaataaataagactcaggggacttcctgcacattcccatgagccatgagccatctccaacaccttggggcagagtaggggactctatgactccactggggaaggggtcctgcaatggggcctgagatgtgctttcccccagctgacactcttttccttatttaactttttcaaaaactcccccaaatgttttgccttttcatttgcctcgcctcctccttaacactctccacctgccccaaaatccccagtagtttcaaaattgaataactgtcgggaacagcatttaaagatgctaatttaaacacacgtgtcagaaaaggcaagctggatccctgctcctagcaacagcccctcacccacacctcacagctgctgctgcccagaaacagggcttgcttgagtgagctggcaggggggccggatacagggaagcagagttgtgggacctagctctgagcctgcttctggcctttccccttggatggaggtctttatccttgcagggcagccttcaaaggtgcaaactctgccaagctgccaattcctcaagaaaggggtcttggggcaaccaatggtttaagtaaacccattgtatcacattttgaacatacagaactgctaacacagagacctctaatttcctttaataaacccaaactcttccatttgagtaagcttcatacattaaatagcaacacctactgttaaagcataacaagtctcctttccatttttcacatcataaatgtaagtttgggtcccatcaaggggcagattcctctaagtgccaatgtaaagtgccccctcctctatgtagtcctcctgaatgaccctccatgccacaggtgggagtggtcttttcctcccctgaactctctcatgctcttcccagctatctttcattgtagcaagatcttggtcaagctcatgcatagcttatctccacttctagactgggacatccttaagaacagaagctatgtcttactcaaccttggacgtgccccccccccttgcaatcacaccacagaaccgcatagtaggtgcttaataaatagttataaattattaacatcagtcaccttggagctctccaatttaaagaaacagttttttaaaaatatgtatagtaagtagacactgccccaatagttggtcccattggtaaatatagcttttcatgtgttgggtttgcttcaaatggaggtataaaaacacacagaaagaccaagacagaagctaaaacatagggaatgcaagcctggtaacctctacctgggagagaaatttgcccaactgggcaatgtgcaggcaaggctgatgtcaagggaagatgctggagaagagaaatgctactgaaagagcacgcaagtgcctttgcatctccaggtaagtgcttatttcaagaaagtgtaaagcagctatgtttcttgatttggatgttagttccatgggtgtgttcagttttgaatatgcatatactttgtggtgtgttcaagttttagtatcatattatatagttcaacttgaaaagtaaaaatatttgtgggatctaaaaaatcaaattagagtagaaagagagttaccagaggctgggaaggggagtggcggattggaggggaggcaggatggttaatggatacaaaaaaatagaaagaatgaataacacctactatctgataacataatagggtgactatagtcaataataacttaattgtatattttaaaataacttaaagaatgtaactggattgtttgtaactcaaaggataaatgcttgaggagatgaatattcactctccatgatgtgcttatttcacattgcatgcctgtatcaaaacatctcatgggctccataaatctacacacctactatgtaacccacaaattgttttaaataatttaaaagcttttttaaaataaatgactaaacaatatttctcacatggaaacttatcctcgatgtccaagtgaagttattgtgagaataggggttgtggtgcaaaaattcactctctagagaacacagctgttaccacctataaagaaagcgaggtctccactcacaaaggaaagcagcaggagtatgtgagatgtcgaaggagaacgtggaatgcctaagtaataaaacagacacagaaaactttccatccccacggtaagagaagctttggcagagtttgctcttcagcctcagaccaacagagctccagcatccaaatgctgaagaagccaagaatgtgcaaactatgctctctcagaataataagaagaagaatattcccttctcctctgggactcttcaaatgttttgaagtttctgacactctcaaaaacatgcagaaaccgcagcctgaatttagaaacctcagcatggtggtatgtgtggtatgagttccaaattctcgacagccctagaaacctgtttctagaggagaaatgaaaataccaggcacactgatgcagcttgtgggttgctttattgctttatttagggtggcagctcgggactgagggacctgggtctcattatctatcagctacctccccactcacattttctgcaattgacatcatgcacaatgagagccacctagctggtaagagaaggctctaaagactactcagagggttatgcgggagggaagaggaggaaataatatgagcccatccacttcctctaaacactggggtcgagggctgtcatggatcacctgcacggatatgatccccggcctccctcagcaccagcaggctaagccgctgtcactgcctgaccccctaacccagtcaatacccaaccatcaagatcacagtcctcaaatgagctcactttcagtaaggtaccgtgttcgatttttctttggacaattttatctggacgatatctaccatgacttaattttgtagccaatgtatacacattaaaataagatgaaaacaatactttctggacctcatgcagttctaattaatataattccatatggatttatggataccagttgtgttctagacactgttgtaagtccttggaatcaggcagtaagaatatgaaaaaagagaccaaaatgagaattatctccagaagagaaagcacatccagcctggaatatgtccttacaggttggaacccgttctcttccagatgccttgaggcttctttaactttactctttctcataaccacccagaaagtgcagggttggagactcaatggttgatcaatacatttattgaatgaaaatgacaggccctacaagtagtttctggaagccctgccaacattttcccaccctgggttctggtactgctcccaggctgtgtggcattgactagagtgcttcaacggcccactggccccacacagctggtgcctggggcccagggtggatccatgagtttgggcaactcctcctcattcctggagctcagtttcttcatgtgtaaaatgaaaggattgaagaagattgtctctaatttcccttccaagttctagcattctgtgatgccatgtgcaccccagttaagtgagaactgccctttgctattcatggaggcaaaagatgtcaccctcctcctcgttactaacatggccccatcttgtccaggttcccactccttctccacagtgtcttgcacctcagataaactgaccccattccctcaccagctggtgggtcctgtctagtttacatcagggcattcccattctattgacactgactgatttggagccaggcaagtggcctggttttggtcaatgagaaaaatgggagaagtatcgggggctttggagaaagattttctctatatataaagtcctcaccagaagagatggtccctgccttgactctggacattgccatgtccagatgtgatgtccagaaccactgcagctatcttgcggccatgagagaaatcagacttggtataaagctgtcactaaggacagtagggtgaagaaaagaaagggcccagggcctcatccacatcactgaaccactgatccatccatagtggagcctttcctcccccaactctgttctcttatgggagatacatttccttactgtctaagccaatttgagtcagtgttcttgatcattagtaatcaaaagcatctaactaatgtagtggacccccaatttggaaagaatgaaaatattctgaaacactcaacactaaaactactgtacacagttgaatctttctaatgtctgagaaaatgctctacaacactatctggatggaggttaccctttcaaataaatgcctgacatcctttctttctcaaaagccaatagcatccagatatttgcacttttcggttgcttggtttctagacaaatgttagtggcccgatcattcctacaagaaatggcactgacttgcccttctccatggagacgatgagcacagccatgaactcaattcaaagagcagcagaagagtcaaaagtggcaccttgaaactgaattctctgttgtgttgattttctgagctttcaaagtgttattcatttttttctacctgtgaatgaatccttgatttctcaatctgcctactcgctgagatagatttcagcaaaataacagtagacatgggtttccttctcctctctctctctctctcttccccctctccaacttcccatcctccctctccatatctccccctctctaattcaccaaggtaacaaaagaaacaataattaagtcaatgagcatgctcgcatgtgcaacaaaaaatacctctcttattacattgccatttccttttcaaatcctttgggggcattgtgtacaaatatagtaaacagcattagagggaaataatgccgacacatacttctgggagctcgtcatgtccctttaagacaaggcccactgttcagttccattctaggccacagctcgggtttcaagcccaaggtccccttactgcctcatgcagtattaatatggccctggcatactcccaaatttacattatgaaccataatctgggccagctcccacaggacgaactggcttggggctcccctcttcatttccccagagggccttctccccatccatagccaggccacccccttccccagggatcccccactttcagcctcagccaggggaacacacaagtgcttttcaacaagtagttaattccctagcatggagtatcatctgtgggggctgcttacacaatggcagaggaattgcgctgtcctgcaggcagtcacagggggagaggggaagaaggcactctcagacattagagccagagccaactcagggtcacttctgtggcaggcctgaaagcaccaccaggatgtccaggccaggaggtcccatgggcatacccagatctgctgaaggaggcctctctgtctcttctctgtgtctcttcctctctctctccccagttataaccagaaggcaggtgcaatttctagaagagcccataaaccatttccatttattaaaagagaaagaaagagagagagcgagagagaggtgaggctggtggggagtgaggaggaggcacaaggaaggagtgcagaggggaggcaaggcaaggaaagaacacagggtggagggtggctgagtgggccctggtgcagccctcatccccaggggctggctcgggctccatgctgtgcgcacagcctccaaccaccatcaggaggctacaggctccatccaggatgttgtctatgggactcctgtctctgaggcaccatggggtgtgttggggagagactgcactctggacagcctgtctgggttcaattcccagaccctctactcacaagctgtgtgaccttgggtatgatgcttaaccactctgtgcctgcatctcctcatctgaaaaccaggaccaagaagagtgcccaccacctggggttgcttgtgaggatggaaaacaggacctggcacaaggtgtctagcccatgcctcagagcttgcacccaacagagcaagtaacaaggtcaaggcaacaacagagggtggacctgaaacacatcctcaagaatccagcaatttcctcaataagttaaacacagcattaccataggatctagcaatcccattcctaggcatataccccaaatcaaacacaggcctggcacagtggttcatgcctgtaatcccagtactttgggaggccgaggcaggcagatcacctgaggtcaggagtttgagaccagcctggccaacatggtgaaaccctgtctctactaaaaatacaaaaaattagccgggtgtgatggcggatacctgtaatcccagcaactcgggaggctgaggcaggagaatcgcttgaaccaggaggcagaggttgcagtgagctgagattgtgtcactgcactccagcctgggtgacagagtgagagcccatctcaaaaaaaaaaaaaaagaaaagaaaagataccaacaaaagctcgtacacaagtgttcatagcagcactattcacaatagccaaaggcggaaacaacacagatgtccatcaactgatgtatgaataagaaaaatgtggtgtggccatgcacagaactaaaggaacggagtactgctgcatgccacaacacaggtgaacctcaagaacattatgctaagtggaagaagccggacacaaaaggccacatatcctatcattctactcataggaaatatccaaataggcctcaagaagcagcaagcagatcacaggttctcaggctggatggaggagagaacggcagtgactccccattggtccagggtttccatctgcagtgctggacggttctggaagtaagtagcacagatggttgaacagaattctggttgtatacttaaaatctcacaatggtcaattttatagtgtgtatattttaccataataataaaaaaaaagaattcagaaagggcacagcactcagactcttctcccctgagtcctctcacgtggtgaagagccaggcaaaagggttgagggcattgttgttatgcactaagttcccccactgtgttcctgccctcccctctttttccccctgcaccactctgcctgtggtttcccagctcacctctgggcctttcctgtgctattccctctgccaggagtgcagcccctgccaccccagcaccctcccacctcagccagcctagctcctctcagcccttcaaacccagctcagcccctgcctgctgtagaaggctttcccttgttaagatctcctcctcagggctcccacctcactccccggcacctaccctttgtcaaagcaccatgttctgtgcatgctagacagagctccccacctcagctgtaagcttcttccatgcaagggccagatctaatttactcttatacccttagagccgagcacagagaaattatataaataacaaatgagttaaaactacagactattatctagaagtcatgagataggaaagaaaaattagttatgaagaagggactctcaattcctagataacttaaccccattctcacccctgatcccagaacctctccagggaaaagaatgaggacaccccaagcagagagtgaccaggccaaccaagagcccccacgtgggcctttgtcaggaaagtcaggggctgaagaaccatgacatcctaatcccagtttggagtggacagcctggccttggattcagtctccgctactttcttcaagggagccaagtactaggctctccccacctcttacctcattcaaacctgcagaggtaaaagccaccttatagaggaggaaattgagactccgggaggtcaggcgcatgccccgacaacaaagctaataatgttcaacaccacaggcatctgaggccaaaacttgtgacttttaaattcgtttcctcttcctccagcagtgtctacatggttgcctcctcaatcttctaactaacacgagaaggccagagacacaggcaatgctaaaggacagatccttgtggtgctggactaacccaccgaatgcagctgggtcctgttccaaaaactcacttcaaacaatgatgctattgaccaggatagacagagggacaaggaaagagagatccttggggaaagacacaaaatgattcatctcagccactgtgctcaactacttgtgtggctttgagtaagtccaggtctctctggggctttttaatttttcccttttgtaaaaaaattgtctaagtctaacataaaatgcagtaaatcatctccaaagtctcttctagctcttaggttctaacactattacaactaacagcttccccagaaggatctagaaaaagtggccatcttgtccacattcacttagtgcaagtcacgcctagagcagacagcgttgcctgtgagggtgatgcagtgcacaaagctaagtcaccatcaccttttctctgggagcttcttataccaatgccccaaacattccttgtaccaggacagacacaaagagaaagatgcatttattctgctcccaccacatgttctataggagacctgtagtgtaggtctcagtagtactccaaattctgtcattctctcccatcttcctgatttctgccccgcctgcctgcctgcactaatattcagtgcatattatccttgaaatcaacttgaaattgtctcgattttttcaaattagcattgtcctgggcaataatatctgtgaaatcacgagctctgatgtactagttctatttttccacaagtgtattcaaatacacaactataataagaaattcgtctgtgtccctcctcaaagcatcttgcatcccaccagcattgaggtgtggcaaaacacagcagtagctcacttagtctccaccagcaaacctcttaggccaaacaaagctgtttcctaccattttagaaaaaccgagacttggggaagcaagcgttcaaggtgacgcagccagaaagcaccacgcggggcttcaaacttgggtgtgcctgattctaagtcccaagtctttgccgctcttgtaagcatccagcttgtctacagcagatgggggtgaatgaaagtcaagagattgtaaataatgccaatgacctttatcacctattctacttaatcctgtcctaagaacttgacagcaagattttccacgataatctgaaatgagagtaattcatctatgcataaacaaagctgacagccagcatactgaaatggacagaaggagagcactgtatgagtccagaccagttagctccctgggcaggtgcccctcacccacgccagcaaggtcaaggtttattcccactccaggcaacgctgggttcaagctgtcccagttcagaggctgtaccaccgaccctgccagcgctcctgcaaatgcacagcttagtcacaagggactccggctgtgcatgtgcgtgactcagcacacatccctcagccctccaaggaaaacaatgacaagagcacatgggatcagcagtgtcatccgtgaacacagaaacacccggcccttcatgcataaacccaccaaagaaaagggcttccaacctagcctggaaaattcaagaactggaagggctggtgctcaaagtcatctggtctgacccctcacaagacagcaaggaaaaaccagagccaagaaagaggcaacaagggacttgcccacgggcactcagctgtgtcagtccagggctaaaaggaagtgcccctacagcttcctgcagagtcagcagccccaggcacagtacttctctctgcccacgtggcactgaggaaattgccaattacagagctatgccctaaattcaggaatcaataaagtgtaagtggagagcccagttacccatatgaattcaacaacaacaaagaaaaatgaagaggaaaactacccagctcattatctctctgaagtgttttccagtaacaactcaatacgaatcagaaataatctcctacgagaagcagcaactggggggaaaatgcactgaactgtgcttggagaaagaaggggctggccatgcattccagcacgatgagaatccccccgtgtgtcacgcaatatgccaactgcaggaggatcccccaagcaggcgtgtgctaacacgtcatttgactccaacacgagatgactttgagttcccaatgatgtgcgcaaaagggacagattctccccgccagtacagtgggctctctggaccttctgaccaagccaggaagggaagaggttggcagcagatgagggactgaccagcgaatgaaaacacagcgatgccagatgcaaaggacactccttgggtgggaaggaggtagggttggtttattttttcccagactttttcactcatttaagcctggagaatacctccctccaaattttatccaagaaccagccaatggccaaaccccactcaaaagagaaaacatgaacactaaaatattccatgtactgaatatttttaaagcaaagttaggattttctaggtttgtttccatgggggaagagggtggtaattaaatgatttacagaagaattttacaacctcttcattttacagataaagcaagcaagacataaagaagcaaatggttttttcaaagtaaccctgatagtcaatagcagaaccaaaaccagaatgcaagtgaaaaaatccagatttgccaaaaccttcctattggctctatgagagactaacttctgagtccgggctatcctgatgatactgacagggtccccaaaagctatcatgcctctctgagtatgttctcttggcaacctgaaatcactctcttccttagctcctctaccatctgtaattaattattctataacttttattgaagactttctcccctgcaatagtagaagctctactattatgctgggaacataataaatgtttgaaaatatttgtagagtgaatgcatatgtatttctgacatatgaacactcgtgcattcaacaaaccagggctgaccatccagggcatgacagtgctttcatccctcagtgttgctaacatgcccagtgttgagacaccccaacaaggtcatactacacatgcaggggattcaacaaggtcagacacaaccagagccccaaggagcagagtctactgggcagactagccaacacacagaagcggctgcatgacacaggagaaagggcacccgtgaagctggagctccgggtctagtttcccttccctagtcaatgattacatgacttaggacaaatcatttaacttctctagaacttgtctgcttcatttgcaaacacaagccaaacaagaggaaggcaggcatcccgggaggaggaacagtaaatgttggaagtaaaagccctaaggatcctaatctccttgagtacagggaccagtctttcttcccgcatcccaccactcttccccagatttgtgtgccaggctctgcccctcccccacctccatcactgcccggcaagagtcaccaaactctgacagcattattcttccagccactgacctccaaatatccctctgataaaatcaaatcctaacaaaggaggatgaactccccctgcttaggctttgtgggagagaactgcctgttgctcattggtaactcagggcagaaatatcagaaggatgaactgtggggaggctataaatgtgtgactgttccttaccacctcatggccacctgtactgtctctatagagccaaagctctaaaaggtactcatttgtcttagctccatgcctgaatgttctactcctgattacagagggagaacccttccctctcttgctccatctatgccaaagctggcccactatgctgcttggtgctggcctctaggccagcagcccctgccaagggcacacttgagccaggcagccaggtaactccaggccaggcttccccctcagggcgttaccaggctcctccccagcttctccctagcctggcaaacatccagccctatgctcatcccagaaacctaaagataaaatcattaggaaaacttctagctcagagatgattattgctatgttatttataatagccaaacagcagaaacagcctaaatatcctacactagagaaattatggtgcagccataccaagtagaatgtagtcataaaaagggtttacataggagatgtttgttatagtaactgggaggcagaaggcagcatacaaaattggcagagggtacagtcagagctaaagaagttgaaataatttaaaaaattggtacaagcaggcttaaagaaaatgcatcaaacgataaccaactggtgtcctaggaagaaactagatacgaggtcctttctctatccacgtttatgtgtatttattatagcgaagcataaacattaccactgaaaagcatctcatttttcctgaaggaacctaatatactcaggaagatcagggatttgggcatcaaaagttctgggttcaaggtccaggtctatctatacaataggcacaaaaatacaggtagatggaaggaataagatctagtgttcagtagcacaacagaacgactacagttaataataatttactctacatttcaaaatagctaaaagaaaatatttgagatgttcccaaaacaaagaagtgacaaacgtttgatcaatgttctttctgtttccagcctacaatctatacctacaacccacagcctacaacccatacctaccatttacagctataacctacagcatataactacaaactaaaacctacaccctgtacctccaacttataccctgcaacctacaactgcaatctataccatatatacctacaacctataacccataatctacaacctatatctacaaccacacctacaaactacagggatgctataagggtcgtggagattcaccaagtgccaatctttacatgaatatgttatatgaaggtggcgcatgaattataatttcttaaattctacacacatgcacacactccagtagcaaccacacatcagttactaagcacatcttaattccagaaggacgctctaacatcccaaaatactccaaccagggctcaaaagtcaaaaggtcccaccattgactcctgttcatctaccccacatatctcaggactcatcagatttggtccaagaagtttattcccctccttccgaaaaatacggatggaagtagttataattcagttttttaaaagacagctattatcaaaaagtctgaaaataacaaatgctggcaaggaagtggagaacagggaacattcatacactgttggtgggaatgtaaattggtacagccactatggaaaacagtatgaaggttcctcaaaaaactaaaaatagaattaccatatgatccagcaattccactgctgggtatatacccaaaagaaaagcaatcacacagaagagatctcttcactcctgtatttattgcagcactcttcacaatagccaagatacggaatcaacctgagtgtccatcaatgaacaaatggataaagaaaatgtggtacatatacacaatgaaatgttattcagccatacaaaagaatggaattctgtcctttgcagtaacatggatggaacaggaggacattatgttaagtgaaataagccaggcacagaaagacaaatatgacatgtccttactcatgtggaagctaaaaaactatctcatggagcaagagagtagaatggtagttaccagaagctgggaagggtagtggggaggggatattaagagggattggttgataggtgcaaacatacaggtagatagaaggaatacgatctagtgttcagtagcacaacagggcaactgtagttaacaagaatttattctacatttcaaaatagctagaagagaatatgtgggatgctcccaatacaaagaaatgataaatgtttgaggtgatggtatcccaggtgcccagagttgatcattacacattgtgtgctcacagcaaactatcacaggggcctcataaatacataaaactattatgtatccataaaaattaagacaaagaaaggaaaatgcactggcatgtgtattttgcggaattatttggtttggcaactactctttgtctagagatggagtttagaattgtccctcaggtttgaggccacagttcctggcatctcggagcaggaggacgccagcatccttcttgttagaatcagacagcatgggctttcccagagcttacttcctgctgtggtctttcttcccagtgttgggagaattccctcacttcactgatcttcaatatcctcattagtgacagtaatgccaatatttttatcatttagaatgtgctagatacaaagctaagggcttcatacctacgaactcatctattctgtgcaacagccttactatgaaaataacattaggtacgttgactgcctcccccaggtagagatgaggaagtagaggcacaaagaggtgagtaacttactcaggttcccacagcttgtgggcaggatgttggggttggaattgggtactctgtctcccgcactctgatatgtctgtcagctggaagcaaaaaggcccacttcagaagtcattgactaaattttaaaagccaatgatctaaacaccatagtgcaccctcaattggtgtcatcactggtctcctccccagagctgccaacatccacacctttctctcaacagccatttgaacacagggagaacacatgattcaccacagccaatgactgggaaaaaccaaacacaaagctcaccgcatggagtgtgatgtcttgtgtcccattcatttcccagtgatttgcaggaccttgtatggtgtctgggaaaaatgtgtattgactttagttcatttccttcgtaggttcagcctcttattattttatgttcatatttattttccagagatagccctaaacacgggacatcaccagttccagtgaaatctccagggggagtacatagagccccaggacagacaggaactgtgtcacctaacccaacactcccaagacttctgaatgctcctagaaccaaactcctcttctgctccattgcttcccctccacccccctgctcctttaatttcagtgacaggaaatgccttccgtttggtccatcctatgtcatgcatcactgtgccaactcaggggacacattcttcagccacaagaacaccaccccagcagaaccacattgagcctacagtgcccacaccttgctccaaaagtcacatccttgcccccacccagggcccaccttccccaaaccatggacaaatgccagaaccaggcctgagaagggctctttcagagtccaagacacatgagcttccttggaaagcatcttccctatggaaattccccccatgactgcagaaaaattaaaatcactcagaattctctatttcttcttagagtttcagaattgacttgaagacacctaaaatcctaatctcaccaactctccatctcctcctctgcctctaaaggaagaaaaaaaaattttaaagaatggacctagcattgagaaacagagaacaatctattattgtgactataacaactcctaaggagccatcagagtctcggtggcaccgctggccccatcgtcacccaaatcatcacagtgggccgttcggactgcaacacgctgcctgctcctcccggcgcacattcttcctggctctccctcactgattttttggcagggctcagcaggaatggaatgggcttccacgcccgttatgatgatggatgggcaggctgctggtggagtggggcctttggggaggcactgtatacacacgcacatacacacacactcacatactctcacattcgtatactctacacgtactctcacacacactctcatattcacatactctacacacacactcacacacatccacatactctcacattcacatactctacacacactcacacacacccacatactctacattcacatacacactctacacatactctaaacacacacacatacactagacacactcatactcacacatactctcatattcacatactctacacactcacaaacacacatatactgtcacactcacatactctacactcacactgcatacatgtgctataccctacaccctacacatacccatacacactcacactcaaactcttggccagcagcacccaggtgaatccactgtggtctcgtgggccaggattctccccaagatccttggtcgctgaagcagccccaaacccgctttgtctgggtctcttccaactctagagctttcattgccatcattacccccagctggacttctgagtcaaccagatctgagttagaatcccagctccacagcttactagctgtgtggccttggcaaggtcacctctctgaacctcaatttcttcacgtgtgtcttggagaatgccagtactaaactcccaggctaatatggagtcctcaacagcccagctagatggtgagtcccatctatgatccatcaatggcaccccctcccccaccttggtccctctgccacagactccatggatctccttaaaacctaaggatatggagttaaaatctgacccaacagagggcctctatgaacctgttctcgtgccacaaaaggcatctaatcccattgctccctgcctgtgaagggctggttgtcaagactgattcaggggacagtgtgtgtggagtggttagcacagggctcagcatgaaggctctgcatagtaacagctgcctctgaggctaggaggctccgtacataggtcccccctcctgctgagcagtaacctgtctccttcatgtcaccacccacggtcctacatctacccaagaggctgaacacactccaatacaggctggttggtccgggaggaccctagggaagaagctggagactctgagacttacaccattcataaaccagctcccccaccctaggtaagagcatatgtctctgaggaacccacttttctcttttctgttccctcaagagcctgcaaggccattctcttatttgccattcccaacttcccaatgagctagcatgataggtactaacgttctgcattttaaagacaagcaagcacctaagtcaggttgcttgtccaagataatgcagagatggagatgggatcaaaacctatgagtcatctcccaacaacgtatccactaaaatacctgcaattctagttttacaggtaagagaatagacatgggtgggataagtgagtggcctggggatacccagataatggagcatggaggtgaggcagaattgagcttggggaccgaaactctatcctcttaaatggcagatttgggagacattccctcaagaatgaacccagctctggcagggcccctcatccccaggtgtccccaccaaattcctggcccctgctattttggaagtctatcagagatgggcaacacagacactgaggagccacgggtgaattcccagccctaattttctgttctgtgctcagtctgtgggccctgggcttgggtatcgccctctctctgcagagtgtgtgcaccacccaccaatgcaaatgctgttggccgctgggagaaagcaaagcaaaacttgctgccagcccagctctgcttcgtaatctgccctttgcattgctggggaagcagtgggaatacagttgcagctacctgatggtacatctaaaaaaataaccagctaaaggggcccacagactcccacctgtcctctcctacccaccactctgggagagcagcgaagagctgctgtttcttttttctcccaccccaaggaaatcaatatgttgtgcaaaaacaactccttccagcaaaactccactttacacctacctccatctggaccatcccttggagcatccccctaattcaccaataattcctcccagaatcatcatgattgatttcacagacctgggttgctgcctgtcctgctatgtcccagccaggtggagcagagcagtcacatccacactcagtccccaaaagctttggatccagggtcacagccaaagagacacatgcctagaactggcttgcagagcaataaggcaaagctggggtgttttaaaagggaagtccaggttggtatccatataaaggctaacagtgattgagcacctactgtgggctaagcactctgcagaacttacctcattgaataatcagtataacattttacaaatgagcaaactcctttgggaaaaactggcactgttcagactataatttgttcatataactttcacaatgttcatcttcttgataccatacttatggataaaaataatacttagtggctctttgggtaaaaatggtaatattaattgtagtgctggcagtagtaagactagcactagcaattggaatttattatgcattttaatgactgtcaggcattgtgctgaatattttgaatacattatttgagtaaaaatactgttatcactttcaatgttcccagaattatgaaaatgtatctcaaaaatttaagagtaatcactaggagaaggctgggcatggtggctcatgcctgtaatcccagcacttcgggaggccgaggtgggctgatcccctgaggtcaggagttggagaccagcctggtcaacagggcgaaaccccaactctactaaaaatacacaaaaaaaatagctgagtgtggtggtgcacgcctgtaatcccaactactcaggaggctgaggcaggagaatcgcttgaacccaggaggcagagatcgcagtgagccaagatcgcaccactgcactccagcttgggcaatagagcaagacttcctctcaaaaaaaaaaagagtaatcactaggagaacagaatatgatctacagcttatgaaccaacaaaatttaaaaaaagaagaaatatggaacaattcctttaatataagacaggaaagggggaaagaggagcaaagaaacccaaaataaaacagcagaaaaaactcacatattgtatcagtgagtatattaagtataaacgaattaaacgtacctattaaaagacagagattatcaaaccagatgaaaacattaaacaaaattcaattatttgatgattgtaagaaacatatagaaaagccttattaaaagattgacaataaaaagacaaaaaataatatgtcagaaaaactctacccacaagaaaactagtgtaacatgtaattaatatgatatgaaactaattttgttcctcaaaacaatgcaaggtagaattaaaatccctattttgcatgagactgtgaaatagagaagttaggttacttgttcaagctcacacaagcagcaggggcagaaaaaggacccacacttggatttctattactccaaagcccattcttgaaactacgtgactctattgttctaagtaacattaccttagaaactattcagtgtgtagaaagtacatgttccaaaatcaaggcttgagataggagtaaggaaaatggagaatggatcatgagtcactaaaaaaataagaaagaacaatctactggttctcagtcttggaagcacgctagatagaacacctagggaactcaaagaaaaggccagtgatttggccctaccctagaccaattaactccacatgcctaggggtgaggcccaggcatcaatattttaaaagcttccaaagtgattttaatgtgcagccagagttgagaacaacttatccattcactaactcaagggcaagtttgctaaaacatggagggtatctttaggtcattgtgacaaagagaaatgagaagatcctccaaccttatccctttgcaatggtttgaatatttgtgtccctccccaaaaatttatatgtagcaattttaacccttataagtgggattactgctctataaaagaggtcccagagagctgcctggtcccttccatcatgtgaggacacagaaggctccatgtatgaagcaggaagtgggctcttaccaaaaaccacaagcaccttgatcttggacttcccatcctccagaattgtgagaaataaatttctactgtttgcaaatcacccagtgcaaggcatttttattatatcaacccaaatggaccaagacaaaaggaagaattggcataaagagagacataagcccttcttctgcatagtgagaggatgccatgcctgagaatatgacagaatccctgtgctaacaccccctccctgtttcttaaagagaacacaatgaaccacagaatctcagcactggaaagaatcttaggggaaacttaaaatggatcccagacttggctgattgttagaacgccttggaagttttataaaaatataaatttctgtggccctcccctaagggaatctaattctatagctctgtgttgagcctaggaaattgtatttttttaaaagatacgcagggaggcttttggagaaagatggcagagtgtcccaatacataatcagacaaagcaaaacaaaaaaacaaaaaccaataagtgaaggagaaaagcaagcagcaatcaaacaaggaactggcacacactcatactatcaacatctaaaagacctggggtgagggtgggggcaggaacaggatttggcagaagttgtcaggttcctaaccccaccccatgcttcagaagtattattgctgaggccaaaatctttagacttctcactaattactatatatttgcagagaagcagactgtgagtgtgacatcatttcttcctcttttctgacttaatacggagagagttggggaaacagattgagaactattagaaaaagagctataaaacagcagcatgaacaatcaagactctctctctttctctctctctcattctctctctctttctctctctctcattctctctctctttctctcacagaaacacaggttccagggctcaacgcttaattgaggggatcatctaaatggcaaggacatcccctcctatatcccctcattagtggaatgagccctggaacagcacatttaacaaagtcatgcaagagttaaatgtggtcctacccaaaggagcacacagctctgagtctgaccaccctcatctcccatgttcccctataatgctcccaggcatcagaaagcatctcaaactggagctgacaccatggcagaggtttcaggtaagtcacaaaaggagtcctaaagaatttgccctcaatatcagagtgattagaagaagtggacagagctacccaagttaaacatatgcaagataaaaaaaatatggcacttgtgaacacacactacaggaggaaaataaggaacataatagcatattgtgctattatgatgatgaagaacctctctagaagaaaacataaccaaagaaacaaagaaaattcctgcaaatgtttaatgctatagaagaaattaacaaaaacatatattcaatgaattcagaaaagttagcaggtcaaagaaaacaaatcaaagaccaaaataatcccattttagattgtcgagtaaactagaacagaaagaatacaactggaaattgaattcctacgtaggggacatgcttgagactaaacaactcagggacttgttagatattatcagccttaacaatgtaaaaataagctataattaaaataagaaagggggtaggaggtaggaagaagcaggtgattgctaattttttcatcatttataacatgggctcaaaagtctaaaattgaaactaggtattaacagaaagcaatgactccatcttcttaaaatttttcataaccttgatgagctcttctaaaagatatccatttcaatgaagacatatttttccagaactcagaacttcctttagatgtacttgtttcctcttagaaatttaagccatgtacgttaatactctttgttaaaattgggatgtagagtgtgatcccattattctaaaattattcctgtcaatctgtgatctacatatctttccagctgtgtgtgtgtgtgtgtgtgtgtgtgtgtgtgtgtgtgtgatgatagagagattacgtgagttttcttaatgttcatgatggttatgtctaggaagtgagatttttgagtaatttttaaatttcttctctgaactttgatattttcaaaaacaattgttataattgtttaaaggaaaaaattcccaagtggttgagagggtcacagctaaacttgaagagcacggcatctagcccaggaatctgattcctgaatctccaaaaatcactcctgagaagaagccacacaccaagctgctgtcaaaatctccagtgatgatgaagcactcactatcctcatatgccccatcccactgcagggcaacttcaattttacaggaccacaaattttctttctactgctaccctatcttctagtaataatatccacctttcactgaatttccctaactgtgagctaagcgtattctttaaatcttcagagcaactctatgaaggtatgaggtttcactatagttttgcccgtcttcctgttgaagagactgaagcccagagaagtaaattttcctgaggtcccccagctagtagtttgcagagctgggcttcagcttttcattgtggttgaatacaaagcctgtgtttttaaccaaaattctttgctagaaagtattgcatcatattgaccccaaatccacttttctataacttctaaccaatggcactgactctgctccctggggacacagcaaaaagtctaatccccttccataagcattgtcttccaacataggaagacaaaaatcatgtgaccctcatctaccccatcttcttcctccccaagtgatccttctgcaggtgcaaaatgtaccgagaagagagcatattttttctgacccacgatgaagtcactgaatgattagtttaaatggaatcatgaagtttctaatatgtacttaactatatgctatcatttaagttctgctttgaaggagttcctaatagttgggttcctccggaaaatctcctaagagggtttcatcccacagacaactcccaactccctgggttaactggaggggtgcagtggtgtggataaagtaatttatgtctgacacggaaatgtattatatgcatttttcaatttatcttcctaattaaattttttcatagactcatatttaaatgagtttccactcccctaacacatgaggactgacagtgagtggagggaaaataggataaaaatgttaagtagattttccaccaagtgtgaatcctccacacacgaatcactgagggaatcgctggcactctgtgggctgggtggaggggttttctttggtttataaactccccagaacctgattttcacatgcagacatgagagcctgtccagccagcagagtatatactgtccagcatctcctgtgccaggagccacaaggcagtggggcatggaggtgccccccgggccctgcctggaacatattctcccaggactttgagcttcctggcagggtcatgttccaggagccccgatttcagggaaatattctgctcccttggtttcacacagagggtagcaagcctccaccaaaatgcacacctgtgttggcagcgaggctgtggactgtggcctggaaaacatggcctcacgcctgggaaagcatgcctcagcgtaggaacagagacccaatatagctcagctcggactgagtcaggcactgaccccactaccctgtccctaaatcccccctgcagtgtccttgatgtcacctccctgatgtcctgaaatccaagccccccagccccctggggcacaggcacggctcttcactccctccctatggccattccccagttaccatctgaactcacttattccaggcccaggcctggctgtcccttggagggaaggagagacacccaacaccacagcccagaaggaacctccacagggagtcagtcaaaagccagacactaaaattacattttctcactcccttctcatttggaggaaagtctgtgtggggctggctgtgatcacacactttcatcacacactttctgcataagtgagagaactgtctcaactgcctcctcctcttcctcctcatcctcctcctattccctctccctcctccactgaattcccagctcactgcctcccactagttcacagtgtgctagggccctccagccccaccgagaagccacaggaagctctgatccacccccacagggaaaaagggatcagaaccaccacccagcacagatataggggccttgtgtaggggaccagccagggagcccctccatcttgaagaatctaagtcacgaggacaagcacaggagcaaagcaggcagcctgagctatccatgtcccaggccactgccggcctgttctgaaaaatttcacacaaggttatccccaatattcccagacatgtgtcccttccccggtgctgcatggcccccacactggctgagtatctccagtgggagaggaaaggacagaccgactcttaggaatgcctgctcactccgtggtagcatgtccccttcaggcctcctttcccatctttgaaagtgaatcctgggtggctccctgtcaggggagcacacagataacccagccccaaagatggcggggcagacctgggcattagcaactggagttctgttttcccttctaggctacctactatgtgtcgggctctgtgcttggtgctttgtaaacccactctcattccatcacccagcaacagtgagacccaaagctcagagaagtcaaagactttgcctgaggatcttacctacaattaatggcacatggtcaagacacaaatctcattccagaaaccaagatctttctaccacaccaaatgtttccctaaagagagcccataactccacacaggaacccagcccagcctggataacccatcagaacagaggaagaaaactcctctgtcaaaatgaaagatgctaatagcaagggtgtttactaggagtgttcaaatttccattaaaaccttcctgtgcaaagatgagctacgaaaatttccttcttggaagcttgtacctcctggaatccagacatctactttcaagctgctgaaggctcccactgcctccccacagggctgcaatcccgaccatggattattaaggagtccacaggcttggctcaatgaacagaacggctccgttatatttcaacctacccactaagacttaaatatcacaccctagttcagacagccctcgcctttcatttttcttggctttaggaagacagggagggagggcatacagagccaagaacccaagtgtctgagcttttacagtaacccaaactcacccaagacaggctgcccaaccgggcccacctctgtgtggcttctccagatcaacagaaatttggggtgaaagcctgcttttctccatgcagtaaggcatctgcatgaaaggcacatgtttccaggaccttccaagctctttcttgagtaaatattctcttaaaaaggttttgaagcagaggctaaggagaggagtcaacatggaattttatttctcttggattatctgactcaagcagcacccaagactagcaagaccaaagatgggctgacccaaagataaccatttacaacaggagtcagcaaaccaacagcctaagggcccaatccagcccgatgcctatttttataaataaagttttattggcacacagccatgctcatctgttctggggtgtctgtggctgatttcatgctacaaaggcatagttgagtggctgcaacagcatggcccagaaaagcctaaaatctctattatctggccttttacaaattaaaaaaaaaaaattgccaacccttgatttagaaaaactttcagatgtagttaggcctatttcttgagcctttttaagagcaaataatatctctggaatatatttggtatagtcttatatggagggaaaaggatgaaaaaaaatggcccctgagtttccttccaaatccacaggaagccaaaaaaggaatgaggtgcctggtacaaatgcctcaggtgacagacatcctatttacagaaaggcaatctgtgcaccacctcagggaggccaaaccaacatgcctggtgcaatcatgcagccttaccctgcaaccacgcccaacacttggaagcctaacgtggacaacgcctggtgcaagagggcatgtggtcagatgttccacccccacttagctcaggggcagacagaaggcttctccaaagctgtcccttggcaggatttcatgtagcagatgccactagtctacagtctctacagcctctgactcccagcatgtacacatgtaggtgtgcacagaggcccagagaagcagggtcaatggaatccatgaagctgacctggtggcagctcagggtttattccctgcttccaacctaccagcaggcacaactcttgatagatctaacagcacactggggatggagcactgcatcaggactgaggagactcagggtcttgccccagctctgtggctaactcctgatgcaaccttagaagagtcatatcatgtctctgggactcactttcttcttctgtcaaatggattaatactacccactccatctaactcacagagctcagtcatgcaacaagtaattattgggcatctactatgagtcagacattatgctaagcacttgggatatagtggcaatcaagatggacaaattccctgccttgtggagcttacactctggggttggtatggaaactaataagggatgcatagatgaatactttgaaaaatcatgatgtgcttcacttgagtcgtggatggtgatgctatcttcccactctgggccattcatggactagactcacacactgagcagacctgctgggaacacatcactgataaaagtcattcattgggaactattctaaatgccttgtatgtattaacctcaccatcacagagagtcctcaacactgaagtaggaactctaaatatgcatactccacaaacaaggaagctgaggcctggagcactggagctaaaaaggaaatatgtgtcctgtcccttatgatatctcccatactggctggagatgttgaatttactatattaaattcttctccattatcttgaggagtaaggccaggacccttcagatggagaggaagtctctctccctagatggggaagggaagttctccttccctagttcaatcatcacagaaaaggaaagcatctaacaggaaagtagcacccagaagagaggccttaaactccttggaagaggtgatcctcctatctgcctctttgggctgaactctcctagcaggggatttttagaagggtggataaccagttgtgggctgcagtgagaagagcgaacccagcccatgaagaaggccaaaaaaatgaggactctggcagggtctgtgagctaagatgagctatgccctacagggcagttatctagctctgtcagcctccattcatttccttttttctgtctccacattttcagtaacgtcctgtctaaacatcccaccagactctcaacgcaacatagacaattagcgaaaggttagaaagtcatgcacccaagcttggcccaccacagttagaggaaaatggcaccaccttaaaactagtatgtaggtgttcgtactaaatacgtgagaaattctcccaaaggaaggtgaagctggagagagtcagggtcatccaactactttttgccctctcagagcattttcctccttgccaatgctggacaatgaaagcactagtttattcagggaaatcacagtttcctttttagaagagcaggatgctaagaagggagcaagaataagttgaaaacaaatggagtaagattcagcattgtgcacgcacccccagcccagccacccaagagattctcccaagccaggcagtgatgctcacatctggtccttcaccaccaggaccaagtcagagcaaaggagaaaagaagagaaggaagagacaggagcgcactggatgggagagtgaagggttggagaagagagggatcccagcctactcccaagcccagtgggatcatcttcccctaggaactcccatctgatattggctctggttggggctgcctctctcccagcacctgctgggtagacttccccatgtttggtcctgggaggtgctgtagcagctggagctgtcctctttctgccgctggaagcaactggaagtcccaggggccctggcgctccctctgggatttcaccctattctttcctgtctcgctttctcttttatctcctggattaacttactgttgtgccatctacccagttgtcagtgtgcctgtctcagctttgtgatctcacgtagatccacagaacctaagagctggaacgggccctgaaaacattctggagcaggcgtctcggcagactcaggcatgcctctccccagggaaccaggccgcgtctgggcagaagcaaggcttgggggagtggcaaggattgtgtgtactccctcgaagcacatcttcagaagtggagcattttcaaggtaggatgttgacataattgttaggtccatgaaggcagatgctagaagcagtgtgaaaataagactctgaggttgtccaggtggggggctatttttatacatttccccccacaacccaagcagtacatgggccctagccctcaagcttcacctcccagatgtaagactccaaccaagattttggagtcaggggcatacaaagcccactcaggggacacactcatagagtattcaactgattcagagatgtgggaagaacgctattcctatttatttttttgtagaaacagggtcttgctatgttgcccaggttgctctcaaactcctaggctcaagtgatcctcccacctcatcctcccgagtagctggaactacaggaacacgccaccacacccagctaccactatttttatattaaataaaacatgtatcatggagtgacaggaaaaacctatgcaagtttaagtaaatattgtacttaaagtgggtgactttaaattatgctcttatatgtacaggggaaggacagaggaagggctcatttaccttcattcttctctctccctagagaattctgtgtatccaattttaaaaattcatcatatgtcacagacagaggcacagaccccctgagccatggtgggaagatacttctggacaaatgtatacccagcaaaaatctcaaaagctccaactttctaatggcttcattttactgatgagaaaactcagacctatagaaagaagagcagaaacagactggatcccaaatccctgtgccccacagttgatgctctttccacctccaatctgaggcactgctctccatgtggccaggaaccgtttccaactaaactggtcctgcctagggcctggaaaaacacactgttaatatgcagccttaattaaatatttctgatgagcacaatgatgcttcaaaattctagctaggattcgactgatgctgcagcctggagccatcaaggaagagcctctttcccctaagcatggtgtgtgtggagcttgctgggaagactgagaccttccaatccaacctggccagcacatctattcaagccatcaaccagaggacagatgtagaagtcaccttctccttccagggaccactcttggaagcagatttccacaaaggggaccgtacagttctaagcttacagatggttagaacagaccagccccactggaaggccagaagtgacgaggatgaggtcaaatgtcagtgacagagaggctcagacctctctgagccatggtgggaaaaatctctctgacccatggtgggaaaaatctccctgaactaatctgcaatttccaggcatttctgaccagtaaggaaaggatttggttgcagaaggctgggaagctagattgtagaccaagagatggagaaaactcttcaaggggagagcccagccactacaaaggggcccagcatgaggtgtgctggaggtaccctgagggccgtggctgcctgactgacttatcctctactttgggaaaaggcaactcagtgcctggattaaaccattagctctggaggatgcctgtctggtttgaatcttaatttctccatttcccagctgtgtgacctcgataagattacttcatcctctgggtctgcttcctcatatgaaaacaggaacaagaagtgcataaacacatttcagggatgtagggaagactaaaagggttaatatagggcaagcacttagcacagtgcccagcatagagcagtactgtctaggctgtagctaccacacatacccagtgaaggcactcaactaccaggtggacaagcaactgatacatgtgtgtgctgctctctgctcccctttggacatttggaatttcaagtactgggacttaataccacagagggcagagttttgtttttcctgcctttgacatgatgtttatgatcttcttttcttgtgaacaccccagacctagggaccagcggtggcctggcttcctgatgcagcccatgaacacatttaagaatccaaaaaggttagccaggcgcagtggctcacgcctgtaatctcagcactttgggaggctgaggcaggccgatcacttgaggccaggagttgaagaccagcctggccaacatggtgaaaccctgtctccactaaaaatacaaaaattagccaggcatggtggtgcacacctgtagtcccagctactggggaggctggggcatgagaatcgcttgaacccaggaggtggaggttgcagtgagctgagattgcaccactgtaccccagagcaagaccctgtctcaaaaaaacaaaaaacaaaacaaaacaaaaaaacgccgggtggcggggtggggaggcggggagaaagctgcctctgcattgcaacttcccaaacagcacagacattaacattttagtgatgaaataacaaagctgatattctcagtatcattcctttattgagtgaaatcagaaatataactttttcttcttttttttcccccgtgggactccataaaactatttttgttgtaaatgttttaaaaggcagcctgtcaatatttcaaatgttcctgaattggagctcatggataaatgactcttcccccattggccaagtctcctctcctgctgcagcaaggaaaggggcacttgggagctgagaaggcaggaaccaggcgccgttgacactcctctagtgagatgaatgttccctccactgggtcagcagtgagcaccagcccaagaagtgccctcgcctccctcctgctgggcagtcaccaggcaaccctgcaggcagtgcaccaagctgttcctccataatgcacacccagtcagggcctgggcacctctagttactcagcagtgagcccacctgctatgtctcaggggcatcccacacccagaaagctgcttctacttcaagcctactcccaggggatgccccatcagggactagagggtcctgctgaacccaccccaggttcaaggtcagcagcaggctgtttcaccaggaaggccaggagctatgctcaaggtaaccaaaaggacagaaggccccacccaagtgtcatcttgcccctcctcccagcttccccattggctagtaaatgagtaaacagacatggttctaaaacctagaagagcatcagaactccctgtggatctgggttcaataacacagatttgatattccactcctggatattccagttttgtaggtcttgagcagggatcgactttttttttttttaaggttccaacagatgatactgtggctacgatgggcagctcagatgtaggccactggcaacacagagtggaaggagaagcccacagggttcctcactgggcgacacaagctcttcaaagcaagctgagtaaatctcttggtaacaagccaagccggactgcccacagctatgggcaggtctgctgtgtctttcgcctgctgaaagcccaggttgcagcacagggaacagcagagacaggatcaaaggctctctgaggacagtctgtggcaacaaagtagcagctcctctctgatgaggtaaggaagagtccaaagaaattacttttgggctgggtgtggtggctcacacctataatcccagcactttgggagaacaaggcaggcagctcacttgaggtcaggagttttaagaccagcctggccaacatggtaaaacctcctctctactaaaatacaaaaattagctgagcgtgctagtgtgcacctataatcccagctactcaggaggctaaggcaggagaatcacttgaacctgggacgcagaggttgcagtgagccgagattgcaccactgcactccagtctgggtgacaagagtaatactccatctcaaaaaaaaaaaaaaaaaaaaagaaagaaagaaaagaaaagaaagaaagagaaagagaaaacacttttgaaatttggaaatgaggaagactaaggaagagtccaaaagaaactttgcctctgcccaaggagcccacaaactttccaaggccttcctgttcctggaaacggtgccatctccaaagactcctccgcacatggaagagcctgatctctcgggcacagtcaaccattacggcccattttctcaaactaggccctcctgggggtcttagggaaagggggcaacattacacaaggcaggtgaaggggatagccaatcacagaggggtgcaggttggcattgacctcttcctaacttttctcataatatgaaagtgacttctcttctcagaagaaccgttcataatgaaattcgagctgcctcaatcttccttgatcatctcttcactcttaccacatacacacacgcacgcacaccacaggaaaacgcatcagatgaagaacttccccagtccagtgcagatttaagaaagaggacactgacatagggaggtgggctggggagctggggagggggcagacaaacaagggcatgtgactgatacacttcagggcgggagtcagacggccccctcacaggccagggtgacatgtgacaaagtcacaaggccctgtggtatttcttgaaacttgatttcagcccaagtcaaactccatggatcaagggtcatttctggctattataggatgagagtatccaggactgaagacctcatggggcagaaagaaaaaaaacagaaaggtagctcttggagaaataacctaaagattagaatcaaggaagagccaacctctcttctaacagggaaaaaaaatttactaaaatgacacttcagcatcacctattttttcaagcttgtctttctgaacagaacttgaaaacacagttgtaaaactgttttactagttcagccgacttagaaaaacaaaaagagcttctcacagctttaaacagagtcctgtgctgaagtgttccaacactccagccccactctggggttaagaatgacagatgatgcaatgtaaaaacatcattttccactggacacagagaacatggtacaatactttggaggttaaacagatgagaagggaacagtacagagacccaaacttagctcctccatgcctctagcacacacatatgcctcatggaaggcatctggagaggttagtgctagagaggccagaaatcttgtttctggttctgtgctggaattaactaggtaaaccctggatgaactgttacatctttgatcgtcactacctgagaattaacttagacaaacattgacactctataaagcagcaattgcaaaatgtgggttttcaaaagcactctgagttcttttcaaagaggatggcataagaatcgacacagctgacatatggtgtggacagagagaaatagcttgggcttggatttccggtcagttcccctttctgccagttaccatcagaggaaccatgggcaaattacccaatctctctgagcctgtgtcttcacctttaaaaatggtattatagttctcaaagtaattgcgaggaattaaaagtcaattcagggtcaggcgcggtggctcatgctgtaatcccagcactttgggaggccgaggcaggtggatcatttgagtttaggagttcgagaccagcctggccaacatggtgaaaccccatctctgctgaaaatacaaaaactagccaggcatagtagcatgtgcctgtaatcctagttactcgggaggctgaggcaggagaattgcttgagcctggtaggcagaggttgtggtaagccgagatcacaccactgcactccagcctggacaacagagtgggactatctcaaaaaaaaaaaaaaaaaaaaaaaagggaattctatgccctgtaaagtgcagtctatggaagtgatgatgatgaagaccaggatacagtacaataaggactctttatgctttcaaaaccgtgattatgctgcatctggtggaagccaggactctggaaatatggcccagacacacccagaactgaggatcaagatgagcgtggatccctgggtcatgagcatcccaaccaagtgcctgatgcccaactccagggaaccatcttccctccgcacacaatagtcattccatggtggtgcacacctgtgagtcaaaaacaccctaagaaaatgtaatccttggggcatttcctcagctccagcctccggcccatcaatcacaagcacaatcaaactgcaatgcctcaaaccaatctcctaggacccctgccagggcagagactgaaagtcactgaggcaatagagcatgtattatattgatgatcctctagctgcaagacctgattggtttgagactcccttggataatgctggcaattaattttggcaaaagagcaaaagatagatgtgacatccattgaacacagagctgcacaggagtcaggtttctggaaggtaggaagaatgcaaggaaattaactccagagtggtttgcagggaatgggggctccaggctcattatttcaatcttgaaagctgtcaatcactgtcaaaaggcagtttaatctcaccctgaagctttcaagaacactatgaatccaggcctacaattagcagtccaatgttgggctgatgagttatgggcattttccatctgggagggcacaagcttctcctatccagggcgtgccctgggcataaaggatgtgtggacaaatacaaacactccaccagccagaggtgacagaaataggcctataatatttgcccaactgggtttatgagacaagcatgtagttcaacactgtttatacagttcatgagagaatcttgggcagtgacagagaatgtaactctcatcctccttagggcttccagaaatgaacagaggatatatatatttttttaaaaagtggatcctccacattttctaaagtttttaagctctctggggcaggttaagaaattcagactgcccaggaagtgattttttttttttttttttttgcatggaatttcgttcttgtcacccaggctagagtggaatgcaatggcatgatctcagctcaatgcaacctccgcctcctgggttcaagcaattctgcctcagcctccctagtagccaggattacaggtgcccgccaccatacctggctaatttttgtatttttagtagagacagggtttcaccatgttagccaggctagtcttgaactcctgacctcaggtgatctgccggcctcgggctcccctctttacaccattctctaagcaaataagctaacatcccagaatggaattatagaaagattgcaccagtcaaaaaaggcatttggtatacatattctaagaaatgctacataataacaatatgaattaataataaattaccttctttcaccttgaactgaaggatttgcaaattttctcaagttctctttcatttgaccttcacaacaaacctgtgacatttcttaccccctatgaatggttaaggaaaagactcagaaagtgggttcttgcttcttcagatcccagatgactcctgaaatattcataattctgatcttaaaaaaaatataacacagatggtaggacatgcctcgtgaatcaggtaataccctggcagcatctcccttagagcgtagaattccacaggcagggatgtgccaaacacctctgcacgccaagctgggtgtagcaactccatcaaatccattggatcacgatgatcctggtacagggagaggggacaatggaacaaccaaggccctggaagacagcaactgaaaattttgacctgtggttcaccagcttgaatccagcactgggatgtcgggggtggggtgttccagggaaaaagaccacagcttctggatggttccaagaagataggttccctcattaaaactggtatcaaccaaccctcttgtacacagacccctgtggtgggtgtcaaggggaaagaaacagatgggcccaggatagataacacagatgcccagtccctgcccccaagaaagctgcccctgccagttgagaacactgctgcatctcatctgaagagaagcctacacagcagtcctggaattccaaatcaggtggaagaaggcagatggcgcaaaataaactcaagaaacagacaatgggaagtaagcatcaagccaggtaccttgacacagtacctctggcatggtccccaacagctggcctgttggcctccccaaacaatgcctctttctaatgagtctttctttaaagtggtcaccgactatacaccttagtgtagagctgctggtacaacttcctgtaacatagcagttgcagtgaagctccagggctacgctgggagtatgagtgactggctcagccccagaaggcaagtcactctccgtgtcctggtcagcccagcccctgtcactgggcaacatgtggttgtgttcagacatctcccacctgtccataaaaggtgaggtctaatggtggcctctttgggacaaccttagggcaatggggcatacgtccaggactgaggctgagaagcacacactggtgcatccctaccagggtgaaaatattgaaatcctttttacatggtggtaagtagcagcttccctgaattcctgcatgcctactaccaccacccagcctctacaatgggactccatgcctccccatgatccagcgactgaagggttggacctggcacagtcgacacttctctaggactctgtcggtgcccaggcagctgtgtaattgtgaaatgctttgaatatcctccccacacgggcccagtcaatggtgctgcaccttaacccaaacacctcactagtagaaaggctaaggaactcaccttcctaagaacctgttgaggccacaccaccagctgtcctccactgggcaagaaggtgtcacccccagctctcctctctagctagggatcctccattcctgctgagagggacaatcctggaaaaagaactatagcccttcaggtattgtatccatacctctgagtctatgtgtgtttttgagaggaaaaaaaaatgcttctggtttcacctttagaactaaaaatctggttgatctaatatgctagacatttcagcaatctctggcccaacacagagtagggtgccactgttctctatattcctggcccagctgaatcacagcatcatagcatttaagcaccctcaactatattcagcccgatatgtttaaaactgcaggttatggccaggcatggtggctcacacctataatcccagcactttgggaggctgaagcaggtggatcacgaggtcaggagtttaagatcagcctgaccaacatggtgaaaccctgtctctactaaaaatacaaaaaaaaaaaatcagccaggcgtggtggcgggtgcctgtaatctcagctactcaggaggctgaggcaggagaattacttgaaccctggaggtggaggctgcagtgagccaagatcgcgctactgcactccagcctgggtgacagtgcgagactctgtcaacaaaaacaaaacaaaataaaacaaaaaccctgcaggttatgacccatcagcaggtcacagaatcaactgaatcattcacaatcagcatttttcaactgaaacaacagcacagaaaacagagtactgcatattaaaagggttgctgcatggaacttttgtttaattacatacatgaacataagtattgggttgagaaagaaaaggtatttcttattctgggtttcaggggaaaaagcttttgaaagcccctgatctagctaactccactctatcattgatgaggaaactgaggctcagagaacagcatggtcaaggccactcagagaatgtgcagccaggtgaggtggttctcagtccatgcagcctgcggactttgcttttcttctaagcagctctggctctggccatgggcattgggattctgggatgctaagtagctggctcctcagttcctaagagctgtgctcaagtggtctctagtgccattgagattttccccagcagagtaacccttagcactagatctcctgaggctgaccaggaggccctgagaagagatgccagccaagcaccccatcccccattcccacagcctggtagtgggtttgggcccagcctctacatctcattctctctttataaagtctcaagcaaactgtgtggctgggactttataataaacttggagccttcttcaagctgaggctccagcaaacaactagatctttctgagcagatgcttctgctctttaggcaggcttcctgtctctacaggtggtctagccctgggactactggaaaaatgagggagtgagggtgtgctttgtgagaggctgggacaggggaacggctcctcctgacaatgtatggaaacacttttttttttcaattaaaaatagcatagatcacagatgagaaactaactagaactatataaaaatacaactttttttttttccaatgggacctgcttagatagaagctaacattccctgaaaactatttgtcaagcattgtgctatgggcttcacacacattatctccctggatggtatagtagttatctcacttgatataaaataaagttcagtgataccagtgaatgtattaatgacatacacagagctatcacttctacagtgcttattctattctaagaattttgtgtgttatttgatctcatcatcagcttgatacagttggtgctattctcatccccactttgcggattatgaattgaggtaagaaaggctacctgacatgcccacactcacatagatactaagtggtggggccagggtttgaacccagatggtccaagctttggaccctcctaattacctccactacactggttatgattccttccactttctggcgcagaagcagagactcgggaaagttaaatcatttgtgtccactccacccagaagctctccacgtacaccagagggatggaaaacatttaacaatgggtaaggcaggtccatgaccttcacaaggggcaccattggctaggctggagacctcctgctatgctggaaactgagccattttaggggctgcttcaaggggaaacccagagggtttcagagaagggataaggtaacagggacactcacagcacttagggcaatgtctattttaatcagcagggaagttttccaatatgttatcaattttggccactgcaaacagccaagataagacagtgctaaagctcttagtcgaaactgaatttttgcatgtttcggggctggaaagaactcttgagccatatagaattcaacagcctcattttaccaatgaggaaaccaaggctgctatgcaaagcatggtgcccaaggtcagagaactagtaaatgacagagtcaaaatgaaaatccagggtgcccagatgcccagattggtacttagggtgtttggtggtggtggtttgtttcttccctatctgtgctgattatattcaatacacagatgctgatgtgcatgcacggggcccagcccccagctgctgtgccacaccctgacaacctcaggatcttcagagaggctcagctgctcaaagttccaccagggaccatacaagcttcatggatattcagattttttttagtaagcacctgaattttgtgtaactgatttccacacccattgaaggcggcttctaaatttagaattaacatccaaagcggtctgttgcacaaatgtatacttcctcgcaagctgttgtcagaaacagtaaaactgacatccataaaacagtttcttcataccttaataatattgaactataaaaatagaggatctcaagcaaacaaagctgtaaccataataacctttacaaagtctactaccacagtcaagtactgtccagatctttttttaatgaaaatgtaaaggtggccccagccttattctcacatgacaatgcaattccctaggcccagcattccctctagacacttgtcactgcccaatccagaactttagtaattgatcatttggggtaataacctgcaccttatacaataaagccacctttgcagaaactgcagcttcactttcatcacttcctcctttgcctattccaattagttgcttagattcagttagacacgtctccccataccaagcacattcagttgtgccaggaggatggaagaagtctttctttcaagacatcttaacaaagtagacattgcaacgcaataaagtagtgagactcatggttgatgcttacacacaatcttccaacagaatgctttatcatcccttgcccagaacagatggggaaaaaattacgctatgccctgaaattttccattcttgatctcagcccaaaggtgacttttttatttttaaacttgagacttgagcaaaaaaaaaaaagttcaactatttttgattcatgcccaggctaaagaaacacatggtaagattctttttttttccaaacccgtaggtagctcaaacagctaagcttcaaaagctcaagctttccaactagcactaatagtgttcacagaggcagcacctctgcagtaattgcaaggccaaaaatcaatagccggggtgagaaggagctgggattccactttctggacacattgtccccagtacctctaaatacttaaaagaaccgcatagaattctcaaatgtttaagcaggatggttgggcctgaagcttttcctcccttctgggtgataaggcaacccgtcctcatcaccattttttcattacccatcctttgatgcatttcagtcctctcgagagtccaggctacccagagagaactgacaggtctcctgactgccctctgtccccagaacttgctctcttctaccccgtccctcccagccctagccccaacactgactcctctactccttctaccctccctccatcctgctattcccagtctccatagaggaaaaagggagtgtcatgcctagatgaaaagatttggggttcaagtcaccccatgtacctccctggttccaacgaacctccggaattctagccacagatccccctcttgccctctcatcctcccctaacacatccctacacattgcaggcccaggggggagtccacaaaatgggactccatgcatccatccttctgtggggccgcgtagcacacccacggcaagactccagtccctggtcccggctctgccacttatgaactgtgtgcccataagcaagtcgtctcttgctctgcagactggggcttatcacatttgtcccacctgtcccagagagctgttatgcaaagtaaggggaatcacagatgtgaacaggcttcagaatcagagctcaatataaatgtacctccttattattaggcacatggcacagtgccaggcagtgtggtatgttccttggggctaaagtccaagagatattggcaataaaagaaagtgaattataccgggcagaaaacaaggaacaaaaagagaagaacagagatgaggattcaccagcctccagagaagagtgaattcacagtgacagtgcaatcaataaaggcttcctgcaagaggaaggctttgtatgcagcctgaagtggctctcaccacgctgatcaaaggtgatttcatggccaggcatggtggctcatgcctgtaacacgagcactttgggaggccgaggcggacagatcacttgaggtcaggagttcaagaccagcctgggcaatatggtgaaaccccatctctactaaaaatacaaaaattagccaggtattttttttacaggtggcacatgcctgtaatcccaactactctggaggctgagacagaagaatcacttgaacctgggaggcaaagattgaagtgaaccaagatcacaccactgtactccagcctgggcaacagagcaagactctgtctcaaaaataaatttaaatttaaatgtaaaaaaggtgatttcatgcatgccccttcccaagaccaagcgctctttgagggcaggtgacatgtctttatgtctcagccttcgcagcttcctcctggcatctaggtgaaagaaagaatgaatggagccttgaactaaccaggaactcaactaagtggaaaagaggagagactcccagatagcagagggaagacaagctggggtcagagggcggactctttggcttaggagtagaggagttcagaagttcaggcttctgatcacaaagggaggtaaaaggagttcagaggagtcagtgacatcatgaaatcagtatttggggagcttaattgggcagctgcatgcaggatatgcagcagggggtgaaggaaagctggcagagtggccaggaggcaagggcaatgagtcaggcagacggtgagaagggaagccactgcctctcggccaaatcgccctctgggagcacccatctctgtcccagtggaagccccatcaagggccactctcagtgactgtcctctttaggctggaccttaagtgtcccctagtcctcctgccttgcacccagcactggcctcctgcaagtggttaccttccccttgtgaatccctccaggctcagggattccagggattccagggattccctcccattcccgttttagaggacaacgcggatggtaagcactcccttaaaggaagcacagtgatgcagcagcgggcggggaaacagggagagagcttttacttctgagcacattttcccaaattgctatcttttcaacacttttataaggtagtatgttaatatgacagttaagatgatgataaaaagaaggtagaggaaaaaaatgtggaagacaggaccagtgcattcaacacacagctcagacatgattgagaaacagatcctggtgctgaagagctggggacaggagcctggtgatgggcagcctcggttccagggcaggccctgccaccaacgcactgtgtgaccttaagcagctgtgctcttcccagtcactctcttccacctgtaaaatgatgtcagagatagttcccacccaagagggtagttgtaagaaggaaatgagttgatctggtgcagtgcttagtacttggcacaagataagtggttagtaactggtatctgtgatgggcaccaggctagcagttactgcctctaacatctggagacgcaaaccctagcactgcagctatcccacaggaggtgtcaaatgtgagcctcccaccccatccccctgagatccccacatgaatgcacctccccacagccctaacgctctcaccagggacacacagaacaagccagtgcctcctcgctttacagaccatcagaaatgcaaaggcagttgctgtgcctccacggaatattctctcccctaaaatcttcatgtttttctctcctcttatttctcttctattcacctactgcacaaacaagatcaggcagcagtgataggcaaggaaagatggaaatattctttaagtggaatagcaaaaataggctttggaaattaatgcctagaaatttaccctgtgggctctctggagaccaacccaaatgaaatcccattgacagaaagctgcagccctctggggaatgtccccccatcccatcccccaggatccttggtccaggaaacatggaagttggcttctgatctccctggtctcccagggatcctgctcggggcaccacctgaaaagtccctcggcagaagcacttctcgccatgcgtgaatgctgtggaaagcatctgaacatgaagtttccaattactgctggcatttctggagtgtcctgatgctggctgcagctgtcccacggaaggccagtgatgtcatcagcaagcctgacagcactgagttccaaggctggctgggaagaaaggttccctgcaggctgagcccccatcactggagagggaggaacctgccatttcccccgcaaaggtgggcactactcaggtttgctgcttcccttcctgggtagaattccattgccataacttggactcacaccaggaaaggttcagaagctgcaccaatgtccaggatgattccatctgactgcttctgaaaacttactatgtgtccagagttgttccgggtggaggcaagcccaggtgagacctactttccaaatgttcatgtactcacttcgtggcatgaaaacaaaatggtcttgcattcttcggctacagagagacaataagggaagtaaaaaagggaaagagagaaacggagaaaaagcaaaagaaggaaaaggtgggaaggaaatgaaaagaggaaaagagagagaggggaagggaaggaaggagggagaaaaggagggaagaagtttttgtcctgtggctagttttaccttgaacctccctactcaagaccttcccagttcctctctcctcctctcccttgctcagggagctcaggccctgggggagccctggcagataccgtcctctagaagagctgaccaaggagacagagcacgggatgcctgcagagcgatgtaacagattgggccctgagccctacagtagagttcaagctcaacgcaatgttcagatttcccaaggcgggggattagattaattggaatttgcaggctgtgcccaaccaagatccatatctgtcaccatgttaaccacattcaggcccctcttaaaatcagaaccccgccatccatcaccaccccggtggagaggcacggccagagcctcgcagtccaagactgaccttctggctggcagcctaccttttagccgccagcctcctccatgggcttccagataagcgtgtgtaactcttgagcaaatcctagcccctggaggaactaccggcagttatgaacacagtccctttgttcatctcaggagctgatttaattaaacgagaaactatggacccttcctaagggagaaactatttagtatccagaaccaaggaaagtaaaggctaaagggaaatccagatcctttcaaaaactatctaattgaaccttgggagcaaaaccatgcagtcaaattacacaagaggatccaaggggctgcagtgtaacccaaggtgacacagccattaagtgaaacactcaggtctgagctagggcaccctttccaatgcattatgacacatttaatctgtaaaactgtaaattattttttttaaaaaaactgtcttgggccaggtgctatggctcacacctataatcccagcactttgggaggccaaggcaagtggactgcttgagctcaggagtccaacactagcctggccaacatggtgaaaccctgtctctacaaaaagtacaaaaattagccaggtgtgctctacgcaaataaactagaaaatctagaagaaatggataaattcctcgacacatacactctcccaagactaaaccaggaagaagttgaatctctgaatagaccaataacaggagctgaaattgtggcaataatcaatagcttaccaatgaaaaagagtccaagaccagatgcattcacagccgaattctaccagaggtacaaggaggaactggtaccattccttctgaaactattccaatcaatagaaaaagagggaatcctccctaactcattttatgaggccagcatcatcctgataccaaagcctggcagagacacaacaaaaagagagaattttagaccaatatccttgatgaacattgatgcaaaaatcctcaataaaatactggcaaaccgaatccagcagcacatcaaaaagcttatccaccatgatcaagtcggcttcatccctgggatgcaaggctggttccacatatgcaaatcaataaatgtaatccagcatataaacagaaccaaagacaaaaaccacatgattatctcaatagatgcagaaaaggcctttgacaaaattcaacaacccttcatgctaaaaactctcaataaattaggtactgatgggacgtatctcaaaataataagagctatctatgacaaacccacagccaatatcatactgaatgggcaaaaactggaagcattccctttgaaaactggcacaagacagggatgccctctctcaccactcctattcaacatagtgttggaagttctggccagggcaattaggcaggagaaggaaataaagggtattcaattagaaaaagaggaagtcaaattgtccctgtttgcagatgacatgattgtatatctagaaaaccccattgtctcagcccaaaatctccttaagctgataagcaagttcagcaaagtctcaggatacaaaatcaatgtacaaaaatcacaagcattctcatacaccaacaacagacaaacagagagccaaatcatgagtgaactcccattcacaattgcttcaaagagaataaaatacctaggaatccaacttacaagggatgtgaaggacctcttcaaggagaactacaaaccactgctcaaggaaataaaagaggatacaaacaaatggaagaacattccatgctcatgggtaggaagaatcaatatcgtgaaaatggccatactgcccaaggtaatttacagattcaatgccatccccatcaagctaccaatgactttcttcacagaattggaaaaaactactttaaagttcatatggaaccaaaaaagagcccgcattgccaagtcaatcctaagccaaaagaacaaagctggaggcatcacactacctgacttcaaactatactacaaggctacagtaaccaaaacagcatggtactgttaccaaaacagagatatagatcaatggaacagaacagagccctcagaaataacgctgcatatctacaactatctgatctttgacaaacctgacaaaaacaagcaatggggaaacgattccctatttaataaatggtgctgggaaaactggctagccatatgtagaaagctgaaactggatcccttccttacaccttatacaaaaatcaattcaagatggattaaagacttaaatgttagacctaaaaccataaaaactgtagaagaaaacctaggcattaccattcaggacataggcatgggcaaggacttcatgtctaaaacaccaaaagcaatagcaacaaaagtcaaaattgacagatgggatctaattaaactcaagagcttctgcacagcaaaagaaattaccatcagagtgaacaggcaacctacaaaatgggagaaaattttcacaacctactcatctgacaaagggctaatatccagagtctacaatgaactcaaacaaatttacaagaaaaaaacaaacaaccccatcaaaaagtgggcaaaggacatgaacagacacttctcaaaagaagacatttatgcagccaaaaaacacacgaaaaaatgctcaccatcactggccatcagagaaatgcaaatcaaaaccacaatgagataccatctcacaccagttcgaatggcaatcattaaaaagtcaggaaacaacaggtgctggagaggatgtggagaaataggaacacttttacactgttggtgggactgtaaactagttcaaccattgcggaagtcagtgtggcgattcctcagggatctagaactagaaataccatttgacccagccatcccattactgggtatatacccaaaggactataaatcatgctgctataaagacacatgcacacgtatgtttattgcggcattattcacaatagcaaagacttggaaccaacccaaatgtccaacaatgatagactggattaagaaaatgtggcacatatacaccatggaatactacgcagccataaaaaatcatgagttcatgtcctttgtagggacatggatgaaattggaaatcatcattctcagtaaactatctcaagaacaaaaaaccaaacaccgcatattctcactcacaggtgggaattgaacaatgagaacacatggacacaggaaggggaacatcacactctggggactgttgtggggtagggggaggggggagggatagcattgggagatatacctaatgctagatgacgagttagtgggtgcagcgcaccagcatggcacatgtatacatatgtaactaacctgaacattgtgcacatgtaccctaaaacttaaagtataataataataaaaaaaagaaattacttttgaatgggaaaaaaaaaaattagccaggtgtggtggcacatgcctatggtaccagctactctggaagctgaggcaggaggatcactcgagcctgggaggtggaggctgcagtgagacaggattgcgccactgcactagaacctgggcaacagagccagactctgtctcaaaaaaaaaaaaatactttctttgatatatctttatgagaattgctatcttaatgttgctcataaaaataacttacacaaatgtgtgccaattgctgaagatcttcagtttcagttattctattttttatttctggaagtcctatttgtattcttcaaatctccacggattttaaaaattagtctattgtttcttcctcatttgtttcaaacatttaaaatacattacctattccattggaactatatctgaaaccctcgggaatctgattcttctgtctgttgtttctgctgactttcactcgtggtgactggtttcctcatctgttttggattttgagagtgaaagctcatgcttgaatggctgggttttacctacaggaatccatcaaggcttgagctacaagtatgtccctccagagagaatgtgcatttgattctgacaggaactctggtgtgaccaaccccaaactacctccagttaattttgcagcgtggagtctcctgggtcacccaggcagtacaaattcaaaccccaaacttgcatgaaggcagacttatgattacaaattctcacagcaaacattgttccatcctttggcaagccaaagccaaaacagataagggcccctgtcttctccctttgcccccctgcagatgtctgctggaccacctgtctgtcccctagggatatatttctcctgtaggggaaagcttcagacagaaatctcatttccaactccccacctggcaagggtcccaggtctggctccctgggtattctaaaggccatgctttcaatcctggcttaaagcctgacacgccctcaatctgatttattgtaaacacagcgaagtctttcttagagcctagatctgtgctttttcccgtacctaatttaaagctagatacacctttctttggtctttggagcccagagttcccagggccttctaaggaataagctttcaaaactttgaaatgtagatgtatttataggaaaaggaaagcagcagcaacaaggttttaatgacctataaggctaatggaagggaggaaaaaacgcacacgcctgtgtagtcagcagttccaattgaggagcatctgaaatgctgtaagaaggtagaacaaagtgggaaatattagaacagagcagagtggatggggaaagaatctacaaagactgtagagacatttctctctgtctccgtatctttctgggtcattcttcgtcacaggatgtcaacataagaggtatattttaccctatacacacatgatgtgggccaaaagttgaaaatgagtgtaggattagaaactacaattcagaattttaaaaagaaaccagaccacacacaacaacttatccaggtagtttccagaaggcttcatagccatcactcagttcgtcctcacaaaagccctcaaaagtgcattttataaccagtaatggccaaccttctgataaccagtctactgtactttctcacatctgtcactacttcttatcaaaaaaaaattcattgattaatcaataatacgtttgggaggctgatatgtctggatcacttgagcccagaagttcgaggcagcctgggcaacatggcaaaactctgtcgctccaaaaaaaaaaaaaatccatatatatatatatatatatatatatatatatataaattagctgggcatggtggcatgtgcctatagtcccagctactcaggaggctgaggcaggataatcgcttgagctcgagaggtcaaggctgcagtgagccatgatcatgccactgtgctccagcctgggcaacagagtgagatcttgtctcaaaaaaaaaaaaaaatcaataacatgcacacactgcaaatatatctccagctctatgattcctcactcaaaatcttcaaaaccagatgtgttttagaattccaattgtttcgggttttaggaaattattaaggtgaatctctgaggtttgggctgcacatcacagtcacacacactaacatttcttcaatgacacacgacaattcagactaagctggatgaatgaagaccataaactgcctcgcagttcagggcagcttccactcaccaccagcccctccatgaattaggtaaaaacactcacttttcagagtttgggggacttcaggttgggaatgagctggtgtagaactggatacataagtcatctctcaaaatatcttatatttaaatccatcagcttaaaagtccttcccactaagtctcaaaatcttcactctgattctcagaaggggcagaaaagaacagtgatcagaagaggagaggagcatgaaacagttgatggccagagagagcccagtgggcctccccgggagccatgatgtgtagtgtgtgcatgggcggtggggatgtgtaggcataaaaccacaggataggtcagacatgacccaggaagactcttaacaaagcctcaggtgtaacagcaggggcaggctgggcaggggtggccctcagtacagttgcatttggcctcagatttgtgactaagagaagcataatatgaggcaaaacctcagcatcctcctctacagcaggagagctggactacaacagcaatttcagatggcaggcctcaaccccctggttgaccaggaaatctatgtaacaggttataagcaattattttttaagaaaatggaatggaatggaatggaatggaatggaatggaatagaatagaatagaatagaatagaatagaatagaatagaatagaatagaatagaatagaatagaatagaatagaatagaataggtctgtacctcgctcaacagggacagaagcttctgtactcaggacccttccagactcaccctgtatacctgtccacctgcctgttcatttatatcctttataatactctttttttttttttttttctgagacagggtctcactctgtcacccaggctggagtgcagtgacacaatctcagctcactgcaacttccgcctcccaggctcaagtgattctcccacgtcagcctcccgagtagttaggactacatgcgtgtgccaatgccaggctaatttttgtatttttagtagagacagggtttcaccatgttggccaggctggtctcgaactcctggcctgaagcgatccacccatcttggcctccaaaagtgctgggattacaggcatgagccactgtacccagacctatcctttgtaacattctttataatgaaaagattatgtcaagctgcatctcatgtggtaaggacagccattgtttcaggaacttttctttctataagatatatatattaatatctatgcgtgtgtatatatatatatatataaaatctagcagaatgtatccacatgtatatataacacatagatataatacacatgtatatacacaatgtatgctttgcacacacaatgtgtgctttaactgtgggatgtggtctaaaaaatttaggatttactgtgctagatgactgcctctgaatctttttaacacaaacatcctgtggattgttttttctggtgttactgaatccaggcattctgtattaaaatcatcccagactgaaaatcaaaaagaagtctcgttaaattctctctttttcaggatgtactttagccactgggacctgacttctaaggtctctgccactcactcattatgaccactagggcatttatctaatctctgagcctttagttccttatttctgaaatgcagaggctgaccatcacagacctctgaagagcaactgctcacataaaattggagaaatgacgactcctagctcatagaatggtcgtgaggatcacatgaggtcatactttgaatggtgcacccaacacactgtaagtgccatataattttgcctctaagacaagactatgaatgctttccatgtctggtgcttcatgatgcttttgaatccagtattcattttgcacatgcagcctgcttggagtgggagctgatggctttcaggaggccccagggcctgaccactgcaggggctgggaccacagatcgtaccaccaccctttgttcctgcctcctcctagcccttgggaggcaaagcttgtcccctcaataaatgatgaccagaaccctgtgtttgttgcccagcctcctgggagatgggcagtggcatagcaaagggattactttgggtaaatatttctctaaacctcattcttgcctccaccagtgcccagaacgagccggccagctccccaacagccccaccgttccaatgctaggacagtgctgacagcatcagctccctgaatacagggcaaatgacctcactaaaggtaagccccagaattaagcagtggtggcagaggctgggaagcacaagaggaggagaatgcatgaactgttctctcaaggcactagcgatttccttttccagagcaggttatcgtctttacagcacttagtacttggaccaaacagccaccacattgcaattccacctgaggccatggcgggcatccaatcctgcctcctccaaaacgggaatcttggctgcacctttctggacagatggaagcccactttctggtgtgccttccagaacccagggagctaagtcttaatgctccccaaggcaccttcccatcactggcaggcaaacagaggttagtctacccaactgatagctgagaacgctgagatttagttcacaggcctaaaatgctggttcgcaatattggctgcacattaggatcacccggggagcatctgaagttcccagagtccctgccatacccagaggctattcggatttgttccaagcatttgctttatctccccaggagtttccaacgtgcaggtgctctggctcttggttatcgatctcactggtgcctcagagccactggaaggccagttaaaatagagccctgggccccacccccagaggggagtccctgacttgggggttgggcctctgaatttccatttccaacaagctcccaggtgaggctgatgctactggtccagagaggaaactagagctttgagatccagtgctcaaggcccatgtttctagccttaggcttctcagccatggattggggagaatggctcctggcttgagaagctctgttctagaatagcactcctcagtcttctgtgtgcacatccggacgcatctagattcatgcccaggaggtttgggtggaacctgtgctgctgatcctctaaccaccgtctgaggaacaaggccctagactagcaggcctgactgccaaatctacattcttcccacttcaagcaggtctagggccaggcaactcgcccttccctaacagagatctgcctccttgaaacctccactctgagagacttgctctgagccacaggacaaagaaaaagacttcctctcccagaaaggcacccaggtatcctgtccccacctctacctcttagcctctctttctccctacgaaacaatcccccatcctttaactcctcttgctatgtcacaacaaacaaaacctcagggatcttggaagcaggcggactctcggcctctcccagcacttgatggggcagtactacgtgacatttaagtcccctccactggagacgtgcttcctaagtgtccaccacatgctgcatatggtcctcagggcttgggacccagctggggcacaatgacagaaacacaggaagcacacagccgtgcaagaaagctcaccatgggattctaaaaggagtgacgctaacagctggaacaagaagactgcaaaggaagaagatccagttcccatctgcaggccaggggtctcaggactgctagccttctgccctctaagccactggtcccattctctagcctagagagctacaggatatcaagcctcgagatgctggtaacctgtccaagtcatttaacgggaggaggaaggacgacaatggcttacactgtttcccatgcaccatgtgttaggcactgtgtgaaatgctctgcaagtattatttcattcaattctcactgaaatcccatgaaatgctcattgctatggcaccacagtttaacaggaaagaatggagaagaatggagaattacagatgtgaagtagcatgccaaacaggaggtaacagcagtaactgaccccatgttgacgagcctacacactctctttttttttctttcctcggctcactgcaacctctgcctcccgggttcaagcaattctctgcctcagcctcccgagtggctgggattacaggcgcccaccaccatgcccggctaatttttttgtatttttagtagagacgggggtttcaccatcttggccaggctggtcttgaactcctgaccttgtgatccactcgcctcggcctcccaaagtgctgggattgcaggcgtgagccaccacgcccggctcacactctcttaactgccatgtagttgaagcagttaacttgccttaactgcctaaagatgaggcacttaacttgcctcatcaaggaccgggagagaccgagactcagcctccttccaagatccaggtttctatgcaagatggtcccgtcctcaggccatttcatatggtaataaataacatcaagcaatataattgcacttaatacaccaggcaactctaaactacatgtgtatacacatatatacacacatacgtaacttatgtatagataaaaacatacactcattccatcctcacaacagccttctttgtaaatatctagatttccattgtgcagatgggaaaactaaaggacaaagagcttgggtaactagggtctcccagctagttggtggtgaagccagaatttgaactctgacagtctggtttccaggttgtgctggtgacatccccctgccccctccacagttcacattggctttggtgcctaaactgaataaagagcacagttcaaggtgctttctgtgcccacattgcacccagtccagtggccaaatcctctgcaggtaccttgataaacatccagtaaggaccaaacaggtgcctcctgccctatttatagctcccagcatggccagctagctataattagcaaagctcccctaggactggagctaaattaaactggtgggattagaggccagcagcttcggacagtgcctctggacacctccagcaacacaccactggtgatactaagagaagcctcttcaaagaagtagtttggcctcaccagtgggcctttctcctgagtggtgtgtggacccaaggggttcctttaatggcctcctcccaattctagtggctgatctgtcctgagatcccccaattaaatcagaagaagatgagtgatctcatgctctaagggtcagaaaaccagaactctggtcccggctgtgccgctgatcagcccggtggccaagggactcaactgctctgggtttcagctttgcttcttgagatgaagacaggcctatctctgaagtccttcttggccggaaaatcccagacatctcacagatctcaaaaaggggcttccagttaagtcctgtggtagggatcaaatgccctctagagaagggtctgagggaagcctgcagcccccaacgagggaggaggactctgacttgaaagtctggtgtaaactcttaggctgctggtgctgtgagcctggaagaagagaagtgacaacctctcaccacctcctggagcctgaagaggacaaagaaagagatctcatcttccctctcgctccagagtatccagccgccaagggctctgcctctctcgggactcagatgtcacctcctcagaggccttcctgggttccttatctagaaaatccacctgccaccacttcctagccactggccagggcactcccaagacatggactctcatcccctatatatttgttaaaatgtgcattaactgtctgtatctcccactgggatgtgagccccacagaggcagggcctgcatctgtgctcttcacatctagagcacctggcatataccaggcactgggtctgctgactcagtgagccattttggccccaggcctcctttctctgtgctgagcgcccagctgccaacctcccggagtcgttgggcttctgtttttcctgtccaaacagggagggagccactaaaccaaacaggatgaaagggaaagaggggaggtcaggaagccttcttggagaaggggatttcttcaaggatgagtcagtgatgtctagccaaggaagcagcaaggatggagagaagagaaggggcaaagcacagaggtggaaatggcccatgcagggcatctgccggcagctgggagttgctaagagcatggaaggttatcaaagcaggagggatcagggaggcaggggtgtcagtgacaaatggccacaggtgtgtgcgaagaagcctgaattttatcctacagctcaggtgtgggcaaacttctctgtaacaagctgtcaatctgtcacaattactcaactctgccacggtaagcttgaaagcagccataaaagatacatcagtgaatgcagatggctctttcccaataaaactttatttatagatatttgaatctgaatatcttatcatgttcatatgtcgaaaatataatgtgtctattgtttttttcaaccatttaaagagatagaacccatccttagctcatggactatacaaaaagaagtggccggtagactcctgctgtgggcaatggggaagttttgggaggttttaagaaaaagaaagacaagatctgggttacgtcttcaagaggcctctctggtggccagtaaagaacggaccagtgaaggtgttattccagaggctgggagaccctcaggaggcccttgtgatggtttaggtggaagacagaagggatcccagcaaaggaaatgagtcacagaagctcccctagaaagtgatttccatctgacccattggggcagtgaggcaggtgtccccggatgtttcttccatgaacagcaattgaattgaatgccaaatttgaatttggataacagcctctcgtcctagcaaaccagattaatactaatcactttccctccccacacatatccagctaactttccataaaatgctatccttaataaatccagaaaacaaacaaaaaccttcaatgtctacaataagattatagtatatatataagaaatgtctggccgagcaccgtggctcatgcctgtaatcccagcactttgggaggccgaggcgggcagatcacgaggtctggagatcgagaccatcttggctaacatagtgaaaccccgtctccactaaaaatacaaaaaattagccgggcgtggtggcgggcgcctgtagtcccagctacttgggaggctgaggcagaagaatggtgtgaacccaggaggtggagcttgcagtgagccgagatggcgccactgcactccagcctggacaacagagggagactccatctcaaaaaaaaaaaaaaaaagaaatgtctttattttcagaaatgcaaactaaaatctctagggatgaaatcctgtgatattggtaactgactttcaacatatttcagcaaataaaaaatgaacgcatcaaaaacagctccaatctctactgccttcctcctggcccatgacttgggaaatgcagggcagggtcagcctgccccaggatcccacacacacttctaggaggtaggtgtctctggatccatgtggcctgtgcatgtgatgaggggcctcttgctcctgcagaagagccatctgtgctttgcaaaagaggtcagagtcccaagccatagcagccaagggcagagaccaaagtccagacctgttcctgaagctaaaccactgttgcaggtacctttgctctccgtgatcttttgccaatgacccaaaaagaagctgtgaatttctgaccctgcactcataaatgctggtgtccatcaagcccttaccatgtggcccaatactttatatgcattattatctttcctaaacttcacaacaagcctatgggaaatatactattttctccactttgcagatgaggaaactgaggcttagagtacaacctgtgccatcatacaggtccccacacctgggaagaatccatgcttggcttaatgctctgctatcaccatcataaaattcttcatacattttataggaaccctacattcgcattctgcacaggaccctgcaagttacatagccaatctcactcaggtctcacggctcactggtggtgacatcaggggtaatgcaggcagtaggactccagcacctgcctgccatccatgacagtgttagaaatttcatgtaagtggctatttgattccaggctgctaaaagccaaagccaggacagacaccaggctctgtttgatacccaattctcaacacttttttttttttgagacagagtctcgctctgtcacccaggcagagtgcagtggcgtgatctcggctcactgtaacctctgcctcccgggttcacggcattctcctgcctcagcctcagtagctgggactacaggtgcccgccaccacgcctgtttaattttttgtatttttagtagagatggggtttcaccgtgttagccaggatggtctcgatctcctgacctagtgatccacccacctcagcctcccaaagtgctgggattacaggcgtgagccaccacacccagccccaattctggactcttaactcaggcaggacaaacagttggtggcctgggcccacccaactgccgtgctcagttgccttactccctccactctcagcctccttgagaagcacctttcctctctcggccacttctgtttcctccacagtgaccttggaacggtgactaggagtgctgcaggtggtggccttagaaggacaggggccagcccagtcccactctccggctgtcactgaagaagcacatgctcctcaatggaggaagacagcttcaaagagcatctgagttttaggaagggtaggagacagctggaacagaggccgattctgccagctgtcatcggtctctgatctcctggcaagaaagctggccatagagtaaaacctctttttaaaaattcagcaaaccaggagacataccctcagggtgtagctctgaggttccaatatacatattttcccagggctgagaagactggaaatttctccagcaagatcaaatgcaatgcatctcaacccagacccaccagggcaaaagcagaatctgtccccgaaggtcaacgacatcatcactgacattgagtctagctcaggctctggagctggtctgcctgggcttgaatcctagctctgatgctcgctagctgattggccttggcaagttatttaacctcttcatatctttgtttcttcctctgtaaaacagaaataatgatgcctgcatcagggttattatgaggcataaacaacttaatatatgtggaagaggagcttaataattgctagtgattaaagttgatatcatcattttcaagctctgcttagggacctgaagaaatgctcattccctacctaatgcaagcggggcttaaaacctagatgacgggttgatgggtgcagcaaaccaccatggcacgtgtatacctatgtaacaaacctgcatgttctgcacctgtatcccagaacttaaagtaaaatttttaaaaaatgttcattcccccggaagtagccccaaccttgccatgccctaaatccgctgctctaaaatccctaacacaagcaagaagtattgcctcttcttgaccaactgcaaggaagtgcctgcttctccaggacacctacaagggcagctcacagagccatgcccctcgggggacttcttgaccttggtggtggaggccttggcagacgctcaggtgtttggttccatatttgcttccagataagactgtttagtagacatgcaactgcttagctatgccccaaggcatggggcaagccaccagccagggagggcccacttcctctgactcatctgcacacatgacaggccaccagccccatccgccaatagcaaggcaaagctgactcaggcaacatgagattacgagagcatctccctcccctcctacttcagtccacagcaatctgtgcctccaaccttctttgtgctacaaagataactcactggtccaggattatcatggtacctctgtgacaggctcatcagcagggctgctcttgccaatctcttactgctcagagcctggcccttgtagctctgcctgctcttccctggtcctgaaccttgcttctgctccttggactcccaggttgggcttcttcctggtcagtcttatgcaggtctgaccacaactagtcccactatgaagcccatcagaaatgaggtcaatgcatcactggcccagtttcacagaaagatggacgggggcacaaatggctgctggaatccaggtcctgacaaatagagacttgatagagcatggttgaatatttctcacatagggacacaagtccagaaggcatatggcatctctgagtactggatgtcataccaggagagtctcatctcaaaaggaggtgatgatcatgtatttggccttcaaagcccatgctgctataattttctaagatctgaaatctgagtaatacaacagcagtcagcttcatgaccaagagcccatccttgagggaaactgactcttcctcctctgatgagtgacttgactttccaggcaagtaaagcaggattgagcttactcctgggtctcagggttgcctccctggcctggggcagagcagatgaagaggaagtgggtgttgattcttagtggtttggggcttcaaccttgtcacctacctttcaggcctagcctcagtcctgactcaacaggagaggccaacacacccaactccacttcctaaaggctttggtgcccaaccccaagtcctgatcactactcaggaaggaaatacaaggaaatgccttccaggtaggaaaggaggtataaccatatgtagataaaaaaggaactttccatttctgtaaattgaagtcttattcacacaagagacagattgcagggggctggatttatggggtaagatgattaaattctgtgtcctctttcatatgtcatgctttatcacgcattactaaggatctgatttggtggcaatttgttgatttcttcagttcttagctcagttacaaaaacgcagtgagcaggacttgggtaccctgccagtcagctccttagggtcagagaaacaccgtcagtccacagtgctttataaccacccaaccaccttagacggggccttggtattcactacccactcgtcctcccctagcaacaagcaccaacaatccaacatatacgtaagacttgtgggaagcccttatttgtctttatagccacagaatgtggtacatttaagttgttccataaatgtttttgtttttgttttgagactaagtctcgctctgttgccaggctggagtgcactggcgcaatctcggctcactgcaacccctgcctcccaggttcaagcaattctcctgcctcagcctccagagtagctgggactacaggtgcatgccaccacgcccagctaatttttgtatttttagtagagacagggagggtttcaccatgttagccagggtggtctcgatctcttgacttcatgatctgcctgcctcagcctcccaaagtgctgggattacaggcataagccaccacgcctggccttgttccataaatgtttttaaagaagaacatgctccctgaaatccagcccatacgccattcagtctctgactctgtctctgacagagacactcaagagtgagctgggagaaggcctggctgtctgacatcacctaggaggctgaggtctgacccagtcttccagaccctaagaagtctcacagagaacccagcactcggctgcacttaaggcttccacagcacgctgttccagcatcacctccagctccctatgggaagcccacacacctggccaagggacactggagcatgcactccctgcacagtcctctcagccactctagccctttgctcacgttcttctctgaccccagaacaacctccctacccttctccaagctgtccctcaaaacccattgatcacttaagaatctccatagcagatcttttgtacttggcatactgaactctgaccacatgctgggcagtttgctggatgacaggagtaccaagaggacgaaaacacatgcctgctctcaggccactcagactatcgggggaggtgaacagaggaacaaatggctgcaactcctgcacagtcagactggctggggtgagtctcagccccacaacgcactagccgggtgacctgaagcaagtcgcttaacttaaaatgtctgtttcctcttctctcatatgaggacaagcatggtactgatttcaccaggccgttgtcgcagttgtatgaattaatataattaaagacaacatttattttactcaaaaattactggagtaagaggagtgaaggtaatgcacaagctatattacttggttttgtaccaagctcttatcagattgctttcactagattggtgccctgtgcacatggcaggccctcaagaaatgtttgtaacccttccttgaacatgctctgcactttacccagcttttctgttctcatcacctcttcaacattgtttgtataaaaattatgtattctgcaaggatgagatcagatgccacctcccctaattaggtttacatgcttcatgattcccagacgaacaacttccctgtcttgtttttggatttctcaggcatctaaaaacaggtcctcaccaccttcagttatacccatccatataggtatactatatgctcctatcagaccacagctccttgaagacaaatactgagattcatgcattgttatttggggccaaggctctagcgacagaacaattaaaaagcagtgctatttctgtaggggagcactccaaaactcctttccaaaacctttttctcataagcccatgagccagaatggctttccagaacctcatttttatcaaaaatagaaaccaatctgaccacgcacactttatatcagagtgaaatggaacatcccaaacttttatcaacatgcattttctgttcccggtatataataaagggtcccaatgtttatctaacatttttctgaaatcagtatgtaacactctccacttctgaatctgatggggcaccagtcagtttcatagtcatcactggagagactctgtgccagattttgtcttcagttgtaacacaggatcacatggtcactctactgagctattcccacccacactcttggttctagggatgatgaagggaaaaacaaaatggttctagcacctggatgcagaccgttgcatgttcgacgtccttttcttgtgctccatatgaaacatgtcccagatccttcacgagcaaccctccactgttcagtttcataggagcgcagaaaacaagtccagtttcaagtaggtagtaatttctgtttcatttcatgaacaaaatagagatgcagcaataaattacatgatttgagccctcattagtagacagtaaatgtcactgtttattaaaaagctaataatccattcaattttttaaattaagcaataagactctaatataataaatttgaataattaagcctaatattaatggagtgaaaacatgagggaagaaagaagttctaaaatctttatttttccctccacataaaacatgttaataatgatcccacaggtgaaagaagtttctatgtgcataccagtggagtacttatttgtcaaagcaagaactcacacgtatgcttagatggctggaaatctctagggaagtacagagaactctcctaactcagccctcactattgactcctagctctatttttacctgatctgtttttattgctggactccactctctttccattacatacagcctaagaattttctactccagctagaaagagctctgactaggacacaagtttacaaccaggatggttggtctgtacgtgctgtcttctccctgctcaataaaaggagagcatccttgtgttagaaatagcttggtatctgcggccataccaccctggacacacctgatcttgtctgatcttggcagctaagcagggtctggcccagttaatacttggatggaagaaacaactttgcacaacagttctaaacaaagcacagtttgaacttattcttcctgccacacagccttcccaccacgtgaggccgtagcatcatctctgcttggaaactctacaccaagattgcaccatcacgccctgaagaaggcaagaagccttttctcaggccactgaatataggcttatgtaaacaggcagtataactcagtaggcggagatgaaacatttgcacttctctccaagcattataatgagaaagcaaaactctttatacaagctaaacccttttctacattcttaagtgtccaaacaaacttttccccagcagcctgcacttctatggctttgcattattgggataagccaagagggagggaacaggagcctttcctcctaagctcagagagatcaaagaaaacaaagctagagagtgtgagggattctgcttggtgagcatttctcagcagagtggactttctgtgtctgggctgcgggcccctgagtgtccggtgctctgaggacaccttcagtggaatctgtggaaggtacacatcagatctgctcccagtaataatgccctgctttgcagaggctgttttgctttcccaggtgctttcatgtcttttattgatcaacaagcaaacacttactgagcgcctatcagatgcagggccccaggtggagttatctcaccgacagatcatctcacggccccagtcttcagatatatgtgccactctgaaaagaaaataaggcccagatctgccttcaagatgtttatagtttatttggagacataagcagagtcccacagaaagagaaataatactgcaaagcactctattttaagttagtcttcctcaaactttgatcataatcacaaccacattaggagcttattaaaagtcaaaggggcctggatcacatctttggagattctaattccatgggaatgaagcctgggtccctgtatttttaacaagcagccacaaagattaaaaatttaaaacctaagacagtgcctaagtggcaaatgagacagtcactcctgttggccgaggtcaaaggactccagcaaggtcagacataaaagagacctgcaagggcagacaggaggctgagagcagaaaggcagaaaggggcaaggtaggaagttaggagggagagggggatagggtcccaagaacaagtgcaatattcatgtaggggacagaatgcagaaaattctggatgtaggagaaggctgccctagaggattgagagatcaagacagacaggtaggtctggagtccagggccgtgggactgcagtctgggccctgatattttatcatatcaaagtaaggaggatcatgaatgacaggtgtttactttagcctggaggcaaagggtgcctcaggaatggcagggccatgagagcagagaattttagacagaggtcccgtgctaggcctggattgaaaccatcaggaagaccggaagctgggcccaaggttctagtaagatattttaatatcctgttctaccctcaccacagatcaacgaactcagcaagatagataatattatcttctttctgtagagagaaaactggagcacaaagtggccaaacagcaagaggaaacctggggaagccagaacagccatgtggctggcgctcatctttgacaaatcaatccactgcatttcaagcctattcaacatacatttattgagtgcctactaccagcaagaaacaagaagcagcaagataaacggagtgccgttcctgccctcagggagctcacctcccaggggaggagctggcaaacattttctgtgaagaaccggatagtgaatacttcagactgtgcaggccagttagtctctgtagcaaatgctcacctctgacatagcacaaaagtggccatgcacaatacacgaacaaatgagcatatctgtgttccaataaaactttatttacaaaacatgcagtgggccggattcgacctgtaatgtaccaatccctaatctagtgggtaaaacaaaccccttcatggctacttataaaacaagagaggtgtgttataaataaaacgactttgcagcccaaaggaaagatagagtaatttagtctggccatggatgactggggaggcagcactggagtaggacaagtacttagttttctaggtctcagttaaaacgatggggctgaatcagaagcacatggacggcccttcttgttcccgtgttctctgacttggatgtggtgctcctttcctgcccagagtcttccaactgcacaaacaacgtggcctctcccaagctccctgggcctctcctcacctctaccatcaagttttgaatgtcaattaaggaataaaaattcctaaatgatcctggaaggctgaacacacacacacacacgcacaaagtgtgtgtacatcctactgtgtccggaattggtgggttcttggtctgacttcaagaatgaagccgcagaccctcgcggtgagtgttacagctcttaaggtggcgcgtctggagtttgttccttctgatgttcggatgtgttcggagtttcttccttctggtgggttcatggtctcgctggctcaggcaggagtgaagctgcagaccttcgcggtgttacagctcataaaggcagcgtgggcccaaagagtgagcagcagcaggatttatcgcaaagagggaaagaacaaagcttccacagtgtggaaggggacccgggttgccactgctggctgcggcagcctgctttcattctcttatctggccccacccacatcttgctgattggtccattttacagagagccaagtggtctcttttgacagggtgctgattggtgcgttcacaatccctgagctagacacaaaggttctctaagtccccaccagagtagctagatacagagtgtccactggtgcattcacaaaccctgagctagacacagggtgctgattggtgtgtttacaaaccttgagctagatacagagtgccgactggtgtatttacaatctcttagctagacataaaggttttccaagtccccaccagactcaggagcccagctggcttcacccagtggatcccgcaccggggccgcaggtggagctgcctgccagtcccgcgccgtgcgcccgcactcctcagcccttgggtggtcgatgggactgggcgccgtggagcagggggcggcgctcctcggggaggctcgggcagcacaggagcccacggaggggcagggaggctcaggcatggcgggctgcaggtcctgagccctgccctgcgggaaggcagctaaggcccggtgagaaattgagcacagcagctgctggcccaagtgctaagcccgctgagcccacacccacccggaactcgcgctggcccgcaagcaccgctggcagcccctgttcccgcccgcgcctctccctccacacctccccgcaagctgagggagccggctccggccttggccaccccagaaaggggctcccacagtgcagcagcggtctgaagggctcctcaagtgccgccaaagtgggagcccaggcagaagaggcgcccagagcgagcgagggctgtgaggactgccagcacgctgtcacctctcactaccaccgccagatgctaagtctaaatttatttaaatttctaaaggttttctccctccttcccagaacctctccctcctgaaaaaggtccagctgcttctgtaccagacactctagcgagactcaaatgttcttcctgaccaaatgcccacctcaagaagaacctggagccaggaagaaaccaagggtggccacacacctcatctgccctgctgtgctggtgccaggcgagaaaacagaaatagagccacggagctcaacagcaacacctcatatggtgccagcagacagcgagcaaggcccaggcagataaacacattaaggcaggctgtgcagcgcaggccacgtccaggcctcagagggacttcatctcagccagccaaggtcaactccattctaaggcttagtcagcctcctcctctgggggctcagactcccctggccaagatcactcatgtaccaagaggattggacaaggccacgagtgaggccaggtgccagcagggcaaaggcaggcaaaaggcaccacagatcgcatgtggtggcagcaagccagctgtgtatagattcaagcctcagacccacctctgaaaatcctaccctactcaagcctgaccacctcctccaggaagccctcctggctcttgctaattagcagtaaattgtgtgttctcttaacatctagagtaatacttctcaacatagggttgcgagaccagcatcatcaataagcaccacctgggaagttgctggaactgctgttggaagttctcaggccccacccaggccaagcaacttagaaactctgagggtgggacccagcaattggtgttttaataatgtcctcctagtgattctaaagcaggctgtggtttgggagccactaatccaaagtctagattctaaaccactaactggacacctgtgttttacatgcaatccctgtgctcctggcttccctgggaatgtggttgcatttcagagcctggatcgcacatgcccatcaatcccccaccttgcccagcccaggatgccacagcaagtacttcctcagcaaacacctgtggaatttaattagcttgagttcagataccaccatcaggttacaaaatcacagaacctgaatgctgaaagaggctttagtgcccatccagcccaactgcccatcaaggctctgccaggacccagcttctccacgtttctctcaggtcaggtcagatgctccactaatgcctgggagttcagtctcattcgttcgcccagcaaatattgactgagcatgggtgcgaggcacacacagatgttcctgcacacaagtgaacgagaccaatgagaatccttgctcggagggagcagatattccagtggcaggagagacccaatcaatagcaataaataaataaaacaaaaaaaaacccatatgctttaaccattagaaaacatcagacacaccaaaatatacagaccgcctatgaaaataactaaccagcactcttcaccaatgtcaaagtcatgaaaggtaaggaaagacgagtcacaaaagcacactaaggagacatggtgggtacatgcaatgtgggaccctggactggatcctggaaaagaaaaacagcatcagtgggaaaagtgatgatatttgaggaaggcttaaagtttgacatgcagttttagaccaacatgaaacttgttcttttctatagtgatgtaagatgtgaacaattacgggaaactggctaacaggtagacaggaattctctgtactaatttgcaaattttctgtataatattttgatggcaaatccagttgggaaagatggtccaaataagaggtgaggtgcagttggcatccttaaatagagaagtgacatgtgggcaagatgacatttgggcaagacccagaggcaggaaaggggccaaccagtggcactgtgaatgacatgaggccaaactcagtcttgccaggatgtttacccgtttgtgcttgttcttctatccagatgaattctgaccacgctttgaacacttacaataatgctggaggaccctcagtcttctctttagaggaggcctcacagtcctgcagctgtgcccactgagtgtgccccggcagcctgagcccctggagtggacagtaagagagagcgcacaaaggcagtggggtccaataaagaccaaggttgagaccaggagcacctccaccttctttgttctggaattgccctggtctctttttcttgccagcaaaccactttagttcctactttctcctctctttgaccctgtgcccaagcttctcagcatgtgagcttctcctctaagcactgtccacatgcgcccagaaccttgagcagtggagctcagagcagggttgacgtgagtaagcagacatgagtcaggctgagactccacctaatgactaaggatcaacgtcccacccaaagttcccatgtctagcccttcagaaaggacagggaaccataatccaaagtaaaacagcctactccctaggaatgacagcccacagtcctgagttctagggacctcaaataagtctctcccttccaggcgccaggtcaccatctataaagcgatacatttggattagttaatcctcaagatgctttccagttctaacactgcataatcagtaatgtatcaaatgaaattgtgcaaggtaattgcagctttgaagtacaatgtggggtagtaatggtagcagtgatgagatctatgggctcctaccccaagtgaatcaccagaattggaaatggtaattgttactattaatataataatgtcttaaattgcagagtgcttttccatttacaaagcatttttatacacattatcttgtgtgatcctcataagaacccagtgaaagtggtaggaaaaatgttatttctttggcatagatgaggaaacaaagttcagtggccattcaattaggagtgacggtgctcagccctgagcgtaggactcaatgcctcatcttctttctgctgcttggtgctgtctttgctactccaacaacctgtgcaaccatctgtgattttgtctctctagtttttgaccaggttagttcaaggcatctgcacaataaggaaacccaggcattcccctggaggggaaagcatccaaattgtgcccagagctgccttggctcggtccatccattgggctcctgggagcacagtcctcgccaggaggggaggtagcagtattctccatttgtctccctgcagctcaaaatagaacagatgatgtatcacagctgatctcactgcagcatcagatgttttaaaataattaaataaagagaaatgggagtgtgaagaaaaaggccccaatttttcaacgctagtgtcccatgaaagtgaaaagaaagggacaatggtcaaagtcaaggtgagggggcagctcccccagaggtgccaggtttacagccgttctgtccctgccatccaagctttcctaccagtagcaatactgtcacccctcaccattcggttgcaatttgcaaaaggcaagagacaacttcctttcttgccacactctaggatagaagaagcactccagccagccaccaatttcccctcgctaagcagcccttttctcccatgcccactacatgcagagggtgacccaggcacacccagagtgggtgctcttgtgtcctgtcggatggggccagtcagcatgagagctctttgttcaaaccccgtctccctaccatttgtgtccctacctaagtgcctacccttgcccacgacacttatctccctagacctcagtctccacggttctgaactgggagttagaagcactcatcttacttcctcatagggttgtcagtgctatgaggatggagtgagatcacacttgagaagacacttcaaaaacttacaagtcccacagggcactaagagaccatggttcaccaagcacctggtcaggactgataacaatggcgtatggctggcctttcccagcctccctccagttagatggactggaagatcaagttctggccagcagaatgtgggcagagtatctgctctataaagccttcacacacgatcctgctccctctttttctcctctgccagctgaagacccagaggaggattctgggtacctagaaagggcagagccacagacacaccctttgattgtgttacatggctggagttgagggttgcttgctacagcagctaggccacctggactagcaaaatgtcccagtggagtagctgcctagaaaatctcacaatgaggttgtaaattcaagtgagtggaaaaaaaggttttagtggtcgggcgcagtagctcacgcccgtaatcccagcactttgggaggccaaggcgggcagatcacgtgaggtgaggagttcgagactagcctggccaatatagtgaaaccccatctctactaaaaaatccaaaaattagccgggcatggtggtgggcgcctgtattcccagctactggggagactgcggccagagaatcacttgaacctgggaagtggaggttgcagtgagccaagatcacgccactgcactccagcctgggttacagagcaagactctgtctcaaaaaaaaaaaaaaaaaaaaaaaaaggttttagtagcaaacagtcaagtttcctcataattcttccacccagtaataggataaaaatgagaccatataaaagatgtaccccggcacatggacttcggggccccatagttctgtgacgtctgtgttcaacctgtttgtggaacagtcagtacagcacacaccaaaatgcagctcccatctagattgttgctgaggtgctcttccttttctcaaacacctattaatagatttacactcctgacaataaagaagcgcggatcaacctctaactagccagacaggctagtttttgttttgttttgttttttgagatggactctcactctgttgcccaggctggagtgcagtggcgcaatctttgcctcccaggttcaagcgattcttctcctcagcctcccaagtagctgggactacaggtgcgcgccatcatgcccggctaatttttatatttttagtagagactgggtttctgacccatattggccaggctggtctcgaactcctgacctcgtgatccatccgcctcgacctcccaaagtgctgggattacaggcgtgagccactgcccccagcccagataggttagtttatccaatcacagtatcaaatgccctcctaatgtggacaggccatgctgggccacataagagactaataagccactagaaaaaaagtgggggacaaaggacatgaaagacaattcacaaacataaaacaaatggcccccaaacatgtaatgttcacccttactcatacaaaataaatcacgtctcacccattagactggcaaaaatcaaaaagggtggcaagatctcgaattgccgaagaagcagggaaaaggcactcacttgtactatctgtggacagggacactggttcctctccagagatcaatttcataatatctatcaacttgtaaatggcaagtccctttcaattcagcaattccacttctagaaatctatccaaaagaaatcctcatacatgcataaaaagactcatacacaagattattcattgtttgaagtgcaacagatgggacatggcctaaatgtccaacagtacaaatcacacaaatacatttggctactaaacagatgaaaagtctaccccaaagtttacacgatcctgctccataacatccggagattgggggttgggggaactggcaatcaagcgcatacccacagaggttgtaccaggatttacatgcgcacaagaagggatgctatggggaagcattatccttaagatgctacgggagcacaatccaatgttcgacaaggtgtgaatctgtttccatgcagttccttggtgttgtgcttattttaaacatatggaaaattagccataatgcaaataacacagcaacagctgtgttttcatcttcttggctattttgacgtcacagccatcaaatacaagctccaaaaaagagcgaatgatattgttcccagcagcacatgccaaaaggccacacaccttcccacgggatgaaggattccagggacatctctttttataggtgtgacttcccctctttgcagagtagctatttagcaactagagggcaaagccaggcaactgagacttaggaacagaattatatcagagaaattggcgacaacctttctggagcgaaatctaacagtgtctattaatattctatatagacatacaccttttgacttaggaattccgctctctcaacaccagcatgaaaggcaacatatatgagatgtagtggagaaagaaaccataccctgacaacaacctgaaagtccatcaaaagagaatgattgaaaaaattatggtacctctataccgtgaaaattctgtaattatattttaaaatgagatctatatctacaggaagatatagatctcatctctcctgcctcaggagagatgttcaggatgaaaaacgtagttatcaacaatgtattgtatatttctaatgcatatttcaaagtagctagaagagaaagaatttcagatgtccccaacacatagaaatgataaatactcaaggtgatggataccccaaattccctgacttgatcattatacattccacacatgtaacaaatatcacacataccccataaataggtaaaatattatgtatcaataaataataataaattgaaatttaaaaagaaaagcaagaggcaggggacaagaatgtaataagatcccattttcattaaacaactgaaaagccatatacaaggctcacaaggccctacccaatctgccctcctccaattccttcccctccttctgtgacttcatttcctgcctttattcctgtcacatgctctgctctgtcccattgacaggacacatttctaggtacatcctgccccagggcctttgcacttacccttggcctcagtgctccttccccagaaagccatatggctttctcccaagttccttttggtctctgtgcaaaactgaccttctcagtgaattctaccctgatccctcctttaaaattacaaaacagggaggaactttatcctgttttatttttctccatagcacttatcattggctgcattcacttctctgtaagatatttttgttttgttttgttttcatttttattgagactgagtctcactttgccacccaggctggagtgcagtggcgcgatctcggttcactgcaacctccgcctcccaggttcaagtgattctcctgcctcagcctccccagtagctggattacaggtgtgtgccaccacacctggctaatttttgtatttttagtagagacagggtttcaccatgttggccaggctggtcttgaattcatgacctcaagtgatccgcccaccttggcctcccaaagtgctgggattacaggcatgagccactgcacccggcccactgtaaaatattttaatcccctggactgtcagctccaagagggcaagggtttttccctgtcttgttccctgtggcatccccagcacctagcacacagtaaatatccagcaaatttttgctgaatgaatggaaaacctgtttgcctatcttgacccgggcctggggaaataagtggaagggtccaccctaggccctaagcacttggccaggaaagctgcaggagaggagtgcatggcatccgagagccatcaaacagtaaataagaaagactttctttttctccatattatgattccaccagttgctgtgaacatatgctatttttataacttttgaacacacattaaataaaacaaaaaagcaaagatgtaagtcagactcagaggagcagtgtggaggggaggggagacaacgcaaagagagagggacccaggccacgccaaacaaccgcctggctctctcctccctcagaagaacccatccctgccccgcatccagtgcagcaagcgtcctgggaaggtcaggctgtggctcatgaaagacactacagagtagatgctaacccaaatccgaacactcccagactctccctcccacccagctcagctggtactagaggcagacaacgaaaagctggcagaacaagacaaatggtggagaaagtaaggtctgaagaaggtggggtgggtagaaagcagcaaaaaggaatgagggttggtccagggggccaggccccagctcagcctcctagtcactgagtcagcttgggcaagggtgctctaacctctgagcctctggttcttcctccctaaaagtcaaaataaaggtatctgccttgccccagtgggctggatgtatacgatactgctttatcatgctgtacaaatatcattagaaagagaatcagcagcgtggatgcctcactggataatgcaaaaccccgccccacacggagccttggtttcctctattgtgttttccaattatttgctgttggtctatcaaaaatgcatttaatatgcattttaatatctgacctttggccacctggctcaactctgttgcttctaataatttatacattcggagtctacgatttcctccagccagatgatggctgcaccagaaaataatgatgccttcatctcttcctttccaagacttatgtctctattggttttctcttgtggtattgcgctggctctgacctagggtgcaaggttgaataagagaggtgatagtgggcgttcttgtcttctttttaacctgaagggattgcatctcatgtctatctatcaggaataaggtttgctagagatttcagtagctatctgtcttcagattaagtaagttcccactgcgcagagttgacgatgtgtgatcatgaagcacctactggatcatattgaatgtcatttcagcaattagagagatcattacatgattgttctcctttgttttaatagaggtctgcaaaacaaggggatgcctctacccaatactgcctttcagggtcaggaggaacaaggcctgggacccggaagataatgacaccactcccacctcagccgccagcctgagcccctgatggtccgtcctcctgtgtgccacccctcctctcctcaactctgtagctctctgggccaatctccttcacctccatcctgaactctcactagtccttaaaatgccacagacttgtccctgtgtgaagtcacaagagaaagctcactgccaaccatctccatgtcacaagaagtcaccctgagcatacgctgtgggaagcaggctgatcgcatcattttttcaggatgagcagttcaggattctgatgcaaagactccacatccaccttggcacatgctaagattcacatgaagctattccaaaatggaacaacatacctaggaggcagtgagctccctgctaccaaagatgagaatgtccccatgacatttgctacagaggtatttctacaaaagatgaagagtgacccagagtcatctgtaaaatgaaggtaatcagacctatcaaaaggtaatggaggaggaggaggtggcagcctagtggggagagcaggaggtgggatggactgacattccaagcacctgacatacacctcgtcacttagtcctcacagcagcccctgtggctatcaggacacagagaagttgctacaaaacacacacacagaggccgggcacagtggcttatgcctataattccagaactttgggatgccaaggcaggtggatcacctgaggtcggcagtttgagaccagcctgaccaacatggagaaaccccatctctactaaaaatacaaaattagccgggcttggtggcacatgcctgtaatcccagctactcaggaggctgaggcaggagaatcgcttgaacccaggaggagaggttgcggtgagctgaggtcacgccattgcactgcagcctgggtgacagagcgaaactccatctcaaacacacacacacacacacatgcacacacacatatgcgcacatgcacacacacacatacacagacacaccttgttcaaggtcacatagtcagtaggtgacagcgcccaggcatgcaccaagggcttctgttccagtccttaagctcactccactccaccactccccctcccaggctccagggtatgcttgtcaaactgcctaacacagtgacagccacataatgggcacttaatgattctccccagattcagatggtcagacatccctcccactgagcaaagtcaattttctcatctgcgaagcaaaagagagacttcatcttggcccttcacaggcaggaaggtctgactgcctggcttttacggtcagcccttgccacctttgcaaaatgtattcagaaacatgatctcctttgagcttcacacctctaagaggcagggtctcggcagagaaggtcactggggctcacgtggggaaggttctgcctgaggtcccatgctgaactagcacactcacatccagggacatcagccacctttactatctccaccccaaagcctcatgagtgaaaaggacggacgatctctaagatgtcatgaaaacacggagatacaattgaacctatcttcaaacccaaatgtgtgccattgactaatgtgtgatgtccactctctaaatggtgaagtgaagaagcagtcagcataagattccgccaatcaagcacaaataacaccatcgccttagactcggaccatgtgatgacctttatacccgtggattacatattgactctcctttcataatctaggcaccaaaatatctgctggcagcttattcccatcagctgcaggacaaagtagcttctgcatttggttccaagacaggagtcagcaagacactggaggccacagtccaatcccaatggtctgtttattgtctgaggtcattaccatggtgtctcctctccccgggccctggtaagcaccaaggccactttatttgtcagtgactcaaccaggaaccacatggacttcaaggcaacctcctggccctcaaggacacagagtagctaagccaaggatacagcaaattttttggaccaagagccaaagcaggtggcgcagactctgctaatgatcagatccaggcagtacagagttctgagcaagggatatagcaggagtccagctccagctcccttgatttcgagaagagccacaccacctaagaaactcaccttgctcctcatcaaaactgccctattctaaatggcactgagaatgagactgtcctttatacttttcaccatcccagttggtgggaggggtcttttgaatgtattcccacttgtgagggacacaaaactcaccaatgcctgacagcaaaatctgggggcaggcttcccaggtctcccatgtctgccctggcactgaagcctggtttgggggagacggggatgcgcttgtgataatgccaactcttcaggttctgagcactctcatgtctgtcatagaataggataggggttcactattgtagcatgacacgggctcagaaaggccacctattgtatgagcacatttagatggaatggccacaaggggcaaatccgtacagacagacagcagttcagtagcgtctgaggctggggaaggaggggtgtggggagtgactgctcatgggtatggggtttgtttcttttaggttgatgaaaatgttctggaattaaataatagcaatgattgcacaactctctgtatatactaaaaaccactgcaaatgagtaaattttatagcatgtgagtgatacctcaataaagctcggtttttaaaatttgatggtgtagaagaatatggaggtagcacactaggaggtgcttccctgccccacaagctgtctgtcatttgtcacctgggcactgggcacatatcagtcctacctagcagcccttgcaatcctaccataggagaccagcaccccacacgggcatttgttcagccctccagcagcccctcctgccagccaaccaccctcatccctcccgtggatttcggggttctgagtaaccaaagcaagcatgggaacattctcagagcatgtccaggggacacctccgggaatatgcattcatctcagaggggagctgagtgcttatttgacaagcacaatgtaaccaagccaagaatggggaagggtatgaaacaagagaggcggccctcttccttctcagggaagccggggctggcaggaagtggggctgcaagtccaacagctgacaccatcgtctatgttcctctgagctgtgtgcaaggaagagtacagtctggggctgcaggcatgacagacttcagagggaaacaaatcaggcataaaaactgctagaggttccattagcaagacagagcaaaaaataggattcccacatcccccctggtgccctcagggctccttgtaccactaaaaataaagcaacaggcaatggtgtttttaatgccagcgttcgcaggacttcctgcagagtcaggcttgcacagcttccttcggtcccccccacccatctccaccccctcagccatggatttctgcagcaccaggggccagcaaggagcccaggactgaatgagatgcgtccatggatcatgaggctgagatagatttccctctgttgtcccacttcaaggatgcagtctggagcttgcaatccaaacagggagacaggttctgtgtcccttcaggagaacagggtctgagcatttgtgtcataagcagggaaggagagggacctcagatccagtccatgattggacacacctccctctaacctctggcatcctggcaggcatctgggaggaggagttagaagaggaaacagctggggccgtaagtcaggcgagttcacacccaaccacctgccccattacacagcagaaagcacctcccttactccttccacagcccacaccccacaacccagcccccagggctgcccagtactagctcttgacagaggactctagtctctcagatcaagaacagccctcagaaaggcaatatggctctcagtgattctaagtgcagacactggcattgggctgcctgattcaaatcctgcctctgccacttgctacatgtgtggccttagacaagttacttaacctcagttcccctacctgcaacatgaggttaatgacatttcctgcctccaggactaatgtgaattgctcacaacggtgcctgacacataaaggtgtgtgataaaggccagatattactggggaccaactaacactatctttcctagggagccactggcatctgaggctggcagccttctcttgattctccaggttgccctgtgtgcagcaggatgccaacttgtcctggccccgaggaagtgaatgctaggagttgctcctctagtctaggtgacaatcaagtcagttcagtggtagggacaggattcaaaccaagctttgtctgaccctaagcccatggctttcactaccattctacactaaactatcacctgcaaaacccacagtgggcataaaaagcctcttttgtcaaggacagtgagggacatagtaacagaaactgaaagagaagaaaaaaagaagtctcaagaaaaaacaatcagcaggcatgatatttattttagtttttaaaagttgttggccaggcacagtggctcacttctataatcccagtactttgggaggctgaggcaggaggatcacttgaggccagcagttcaagaccagcctgggcaacagaatgagacctcatttctacccccaaaaaatttacttaattaaaaaaaattagctgggcatggtggtgtgcacctatgtcgcttgaactcaggaggtggaggctacagtgagctatgattgcaccactgcactccagcctgcacaacagagcaaaaccccatcccccgccccccaaaaaaaagagttgcctaattcttcatctcaggtcccttttagaaaaacttatgtcatatcccataaaccaggctatcattccttcctaaagattagtagacctaagtaggcaactagaaaaacaacacatccgtctgaggtctcaggctcacctggaaatgcaggtcctggcctccctgcctccaccctcccccaccccttccttgtcaggcagcttgggccacccaccatatgccgctgcagcccataaagactctggaacatttcaaaggccttggcccccatcaggtgtggctccaaaaaacacagggtcacctataaaaggttgagcacaaggaaacagccataaaacccgcagtcctaacagcagacacccagtggccagaacaaagcagccagctgccgggctttccaggaaccacagagggacatccctcccaaggaccgcgcccagccgcagcccaggggcacatggctgaaaggtcctcagaggccacctggtaagaagggccctgtgttgggtgcttgctagttgccagggactgtcccggatgccctccttgaagagggttaaggaggtaacacaggaaagagctggcatggtgcctgcagccctgagggcctctaaaagagatgcttcatctttcctgagcttcaaagcacccggcaagtgggacgtgattcccatcttttaggcggcaaaactgaggccctgaggagtaacacaactaggaagtgagcttcaagccaagtctgtctgttcatctcatgctttctcgtgggttcctggagaggtcagatgatgggctgtcagtgctcaaaggggcctggagacctcccagccctctgctgggtaccctccctacacagtgcagccaggcttccaaggcagcctccctcctctgctgggacagtcgtcaggggtgtttcagaaggagcaagccccgagcagcctccccacactctggcccagttgagggaggtgacagggcgccatctcctgctccctttctggaaagctttcccacatcccaggccaggccctgcaggccctcaggctggctgatacatggcaatgacaacagaaatggctcacacttggtaggtgcttcctaactgccacatcctttacacacaactgcacaaatgctctacatcagggatgcccatgttatagaaaactaggacttatggaggatgtgcaacttccccaaggtcatgcagctatcagcagccgagctggaactgaatccatggtcctcaccatgccacgctaccctgcttctgcctgaacgcaagcaggtgcagataagccgcaacacccatgactatacccacacactaccatcttcccagccgcatggcagtgctgcggcctagacccatggctcaggctctgccatccacccttggtgcagccctccagcctcccagacacccctgcatcagcctctctctaggtaacagataatactgctgaaataccaggctggctttaagttttgggtcccactgtcccactgtcctaagtcccactctgacctgtgggactaaaaggagggatgggacaatcattgctgtacaagcagctcctccagagaaatgcccagacccagagcagcaacccctcatggccctcaaaaaggcatctttggccaggcacagtggctcacacctgtaatcccagtgctttgggaggccaagaggggacgatcgcttgaggctgggagttcaagaccccatctctacaaaataattaaaaaattagctgggcacagtagtgcgcacctgtagtcctagctacttgggaggctgatgtgggaggatcacttgagctcaggagttcaaggctgcagtaagttatgaccatgccactgcactctagcctgggcaacagagtgagactatctcttaaagaaaagaaaaaaggcaccccttcctagagtccagaaagacgtctgtatctggcagtgcccgtcttcctaagtcctttctgagggtcctgagctgaggggagccaaggatgcagcttcactccatcactgggtggtctcctctgggaacttggagtattcccttcctgcagcaggaagagccaccaagagtttatcgtgttcagtccttttagtcacctaatgcccacaggcaccttgacaccatacaaagaacccctctggggaagccaacaaccccaaaacccgtgcaacccttgcaccctctgcagccagcccttggtagtggccttactgtactctccctctccatgactcagtttgcctccaataagccctggggcctcaagttcagactcacccaactagacagaccagaagtgagcctctgccctgacatcttcaggcactcttttgtcaactactcacaaggatttatcagataggaagggaaaaggacagaaagaactgtgggataaggaaggctctgaatgtcagaaaagggtctgagtaggatgatttgagactgaagaagctacgtggtatcacttaggagcaataaaggaaagattagggcaggtgaggaggataatggacagtggagcctggccagtgccagctgacggactagaccgatcttcctacctctgcttgcaaaaggcattgcttcctgcttagcatgcctcactgattcccataaaaatggcattcatctatatgctgaggtgggctgaatcatggccctagaagatgtccacgtcctcatccctggaatctgtgactgcgaccttaactggcacaagggactctacagacataatttaattaaggaccttgagatgaagagattagcctggatcatccaggtgggccctaaatgcaatcacaaaggtccttcaaagagggaggtagagggagatttgacacagaagagaaagtaagagatgtgatgatggaaactgagatggagcaatgtgctttggatacggagcagaaagccacaagactggggatgcaggtggctactggaagctgcaaaaggcaagaaaaacgacttgcccctcagagcctccagaaggaaccagccctgcagacgctttgactttaaaagcccagggaaactgatttccgacttctcgccttcagaactgtaggagtatatttgtgttatcttaaggcactatgtttgtggtcgttacagcagcaagggaaaactgacacccacactcagccactcgagaggtcccttctcctgctcaacactgctagccattaggggttaagtaattcacaaaagagacccatccctgccttcccgtaacatattgtcatcctctttcctccatcctctttcctagggtccctgtggcctggactatgctgctttctgcctaagtcctccccgtccttccagctctcattccttccatgaagctttgttccagcctcagagtcttcaaagacaccattcctctgcacgtccccctgcacccacccctggctaatgcctcttcatcctgtagatctcatttcttttttttggagacagggtctcactctgttgcccaggtaggagtgcaatgatacaatcttggttcactgcaacctccacctcccaggctcaagcaatcatcccatctcagcctcaagagtagctgggactacggggatgtgccaccacgcctggctaattttttgtatttttcgtagagatggagttttgccatgttgcccaggctggtctcaaactcctgggctcaagcgatccacccgccttgacctctgaaagtgctggggttacagtcatgagtcaccatgccgggcctgtaggtctcatttctgcagggaagccttccctgagccccggccaaggagaggatgcacccccacacacacacgcattatagtccatagtctctcatcacactccaggctgaagtgtgcatatacgtgtgtaagaggggattatctgttcaatctagtcactgatgatggaattgctcagacctctgagggcagggaccttggttgtcctgttcaccagtgaatcaactctcagcctgttatagacacttgcattgatctccctctgcccagaactgctttatttaacatctctatcaaaaagaaccgttgcatagacatttttccaaggaaggcatacaaatggcccacaggtatataaaaaggtgctcaacatcactaatcatcagggctacacaatcaaagccacgatgagttataacctcacacctgttaaaatggctataagcaaaaaaagagagagagagagagcaagtgctggtgtgggtataaagaaaagagaaccctgttacactgttggtgggactgtaaattgataaagtcattatggaaaacagtatggaggttcctcagaaaaatcaaaaatagaactaccatatgatccagcaatctcactactggttatatatccaaaggaaatgaaatcagtacgtcaaagagatgtctgcattccaatgttcacagcagcattattcacaatagccaagaaatcgaacctatctaagtgcccaccaacggatgatggataaagaaattgtggtacatgtacacagtggaacactattcagcctttaaaaaagaaggatatcctgccatttccaacaacatggatgaacctagaggacagtatgttaagtgaaataagccagggataggaagacaaatactacgtgatctaatttatatgtggactcttaaaaagttgagctcataggagcagaaagcagaacagtggttaccaggggctgggatgggagaggaatgctggtcaaagagtacaaactttcagttaaacaggaggaataaattcaagacatctattactgtacatcatggtgataacaattaataacaatgtattgtattcttgaaaactgctaagaaaagagattttcagtgttctcaccacaaaaaataggtatatgagataatgcatacgataattagctcaattcagccattccacaatgtatacatatttcaaaacaacatgttgtatacaataaacaagtacaatttttatttatccagagaaaattttaataataagtgttcattttaaaaaaaaaaatacagccaattggcactctcaggcctgcgtcaggaacaagaggaagtcagggctcaagtttcaaaaacacagactgaaaataaagccccaaacatactcaaggatggaactccccacagcctgtcagcagtggacaaaaccttccatagcagaagctgcaagtaaaagatgtctgtgtgggaggaaccatttagaaaaagcagtaacaaggcgatgaaaacagaaacaaggcggccagtcacccaccatccccaattcgcccaaaggccaggtcaccctgttcccaccctgcaccagctgctcctctgcctgcggctttctggcccaaatcctgtgtggccctcactttctcctcagtcctgcctctgccatatgaccatctcctcctcaaaagaggcttctctggctacccaccaaagcagcccctctaacacacacaatcccatcccctgttcagtggtctcatggtgccactgtaaattatctcattcattgatttactgaagtgttgattatctgcaccccccaccacacacactgaaacccaacccagccctttctgttgcagtttcccagggcttcagacagtccttggcacatagagggtgccggagaatccagaatgaccctcactgtgcatatccatagctgccctcactgagccgcagcctcgggctgccccaaaaggtaagcggagtacaagggtggaggctctctctctctctagcacagaatctctttcttccagagtcggccagcggtgctgtctcttttctgctgggaaagataggaatggagattccttgaggtcagacacagtagatcctagtcagaaactcccattggctaagtgagagaagccagacacaaaaggccacatattgtgtgattccacttatatgaagtgtccagatcaggcacatccagagagcccacacagagtagaccagccagggactgggagcagagggaatagggagtgactgcttaatggtacaggacttccttttggagtgatgaaaatgtagataataatgatggttacacaactttgcgaataagctaaaaaactaccgaactgtatgtacactttaaaagaaggaattttatctcaattaaaaaaacaaaaaagcacttattgaaaaatgccatggagtggttagcagagcaaagctctggagtccaactgtccaggctcaattcctggcttaagccatgagctatgtgaactgagccaaattacttggcctctctgtgcctctgcttccttgtctgtaaatgggggtgataatcatgccaatttcacagggatgctatgaggattaaatgcaaccacccatgtgtaggggactttggctaactcctttccaaacttccaccttccccattccttgcagaccttgttttccatttgagatccataaggttctgaggatactgacaataatccctggcttcagccagttcagttacagcaactctcagaacctgtgctaggaatgctggtgcaaaggtgatttatttcctgacaaggttgagcagatcagcatgtgccctccagagctgcagcagccatgtgtgaacccagaggcaaaccagcctcaggacaaggccaactgtaaggagagcagattagagtgacagaaagaaactgggtccatggagacatcgttgagccaccggatcaaggctcatctgaagtcatccacctttccaactatatgagtcaatggagtccctttaatgttaagcccattgaagtgagcatttctgctacatgcaatcaaaagcttatcactgattcagctacgtaaagtccctcatacccagcccggcacatagcgagttctccattaagtgtgacttattatcatttttttttccaagcttctctgctgttccccaaggccagtgttcacccagatgtctagatacagaaactgttctactggtttatctagatccaatcctatgtccctgtaatggcaagccacagacaactttaccaaaaacccttgctgtgtgcaaaatcagtgcacacagcaagcattcatggggcgaggtactgtgtgctcagacaagactaggtacgcaggggacagcacatcagggaaggacaaggcactctgatcataagtccaaagaggagttcataatctaatcagcaaggcaagatcaaggtccacaaaacagtaaagtatatatttgactagtgacatgatttaagaaatgcaacagtgcaagctaaaggagtccagagaagaaagagatgggaatcctggtggcattctggtttctcctggctcccaatgctcccaacacatggacctaaccagatccaaaaacatcctcccaagaacatatggaggccacaggacatcagagcccagcaccagaccttgctcctgcaaatcccaaagataatgtgcacatttcacggacatggccaaagacccaggcacattctaggtcatggtcacgaaactggctgaactagtcaagaagtcctatcatcttttcttctcccaatttattttctttttccctctttttctcccaatgcagtaaaaatgtgatgcatgaaacaattattcttcagaactcaggggcaggtggggagcctcaaatctggagaaagcaaaatgtaaatgatgcaaaaagagatcaagatccatgaatattcatcttcctctcccttctggtggaaactagatttggaggggttcattgcgctccatttcctctgaattcctaggagcgcttgtggtcggcatctcctcattctgcctgaagaccacatgcaactcatagggctcttgcctccaagaacaggcggctgcacaggcgcatacattgtaccaacctgtacaccttatgtctgtgcatgccctacatgtatgttagacttcaattttaaaaaatgaaagtcaaaagactggtcaattccttctggtcctcaaggcatatttccaatgtgggggtaccttcctctcttcacttcacggtggaggatgattctctactctacctcctcacctccctgacacacctccttgccccaaaacaaaacagtgaaaatgaacaatcccctctaagccatttgcttatggaagacaaagctggagctgactcctttctggattctctctccctactccccccacccccactgagcacaggcatgcaatagatgctcaataactgtttattttgggaataaattacaaatggtatggaactatctcacacacaataagtctgtaagttcctggatgtctgagcttgtcttctacctcttgggatgcctgtgtggccctccccaaaaccccaccaccaggtgatttcttaacctctatgagtctcagctcctgaaccacacttgtccttcaggatcactgtgagaattttaccagctaagatgtaaagtggccagctcagaatgtgatatattgtaagccctcaataaatagtagctccctggacccaaccttcccccacaaccttccccagttgcagcacagagtttaaaacctcccaggagccccataaactgtggccgaccaggactgaccagcttcagctctgggtgctctgtgcctctctccaatacacacagtgcttcattaaagaactcaaagcttatctggcccaaaagcaatgcttttatctaaaatcagaccacatgggcaacaagtgaagcaggaagcctatcaaggcatttgggccaactggttttggctgccaagggagccctccttataggaggcggttcagaccgcaggccggctcacatacaacactggtgtacacggaggggttaattagcagtaaacagatgccatgattcacctctgtgctgttatttccccgtgtgcagctaaaactataatcactctgttctccgacaggatgtttgcgttcaagccaaaactgcctcctctatccaacttgctgcagttcggttcagcacagggcaatgaggaacttggctcctctcacgatagctggtggctggcctgacagaggccccttcagacagggaaggaaagaggagatggatggggtagagaagaaaaaaatgaatttgtcattttatcaaacacaggtgaaggctgtctgctggtgggaactgctcctcaacacttaacacccacagagctcacaaaataccctttcttctgaggcagtcaggcatgagaggcttcaggagccctgtgacaagtcattggcaagaaggagctggggcaaatttgcaggccaatgcctgggtcacaccctccctaccactgcccaggcctgggtgggtgtctagtctacttggagcctgggacctggtaaaggtggcctgaaaggctcaacctcagcttccagaaaaaattaaataccctgagagagccagaaaacaaagagattcagtgcccaaaatataaatgtaaccagtgtggagtattagtcaattcatcagcaagaggttactgaatgctcgtttgttcattcattcgcccaccatctaccaaatgcccaccagagacatgccacgtgtttggtgctgggaatacagaaagaaatgaagaagatgtatgtcctgtctcagtggcccacagaccagagtgtgccaaatcctgaaggatccagttaggagcttacaatctagctggaaagctaaagaagggaagcatgcggaattctccggggctcatcgccatccctcacctaaccagtgctttgtgtaagatagactcaaaggtgagcttgaataaactgacttctgctaaatgccattattctacctggatacatcacaaaaatgggagccattacctactgagtatttttcatgtgctaggtggaactttctctgtggtcttcaccctacatgtaatggaaactgaggcatgaggagggtagacaacttgcccaagaccacacaggggaggcaagagaggaacccaggtccttgcaccccaaccccatgccctttccacctcactgcatgagcagaggaaggagcccccttgtccatccctcacccagccccagctcagcttgggctcccccaagcaagcaccacatgactgacactcttggaatcctcttcataacctggcccaggtatgggacaagttgccaatgagcaacatatttgcttaaccaaatgcctgtggcagaataagcttgagataaaagggagtgtgaagtggaaagaagacccggaagtcttcatgaaggaacttggtgtacagaaagatgttttgggtgcctcagaacacataatccctgatagagaaaagagtctggagacaaataccagatgttaagcaaccttaacacaggcgcctgggctgcctcagcctatcagagtagcacaggttcctaaataggggaaagtgccaactaaaaagcccaccaggcaggagggctgggtctggagcctggcctttcttctttgttcagagcccaaaaggtgcctctggtccattcaccattcaccaggccccagagcagccccaggatcaccagatgggtccaccaggtccgtcctgctctggctaccaggcttctaagcctcttttcagaccctcagccttctgggagaaaccattccatgccctccagcactttccaccccttctgttccttttgacatcatctccaactgcctgaggctgcagaaggtgggtggtgtaggggcagaacaggcaggagcacaatcacaattcttataaaaatgcaagggactgctggagccaccagggaccctcagaatggcctcatccaatcctccgttttacaggtggcaaactgaggcctcgcccctgagttaaccctttcaatgcctgacatctcgtactgcaaaattcttcctttcctctctctccattcccctctccctcgtccttcctatagtggtataggggtgtgccgtgggtgatgagaggcagagggaagggagcatttctcaccccattttcctccaaccctactttctgcctccatctttagcactacctcactgtccgtcttggtgctcactgttggcccctggctaccctgccccttccagtggtctcctgtccctcagttcagcacaatcctggttatattgacaaaggagagggatctaaaataaaggccaacttcatcataacagggccatttattgaggacttacaagatgctaaatgctattatactcacaaaacctttacgtggctggtatttttagtattcacagtttaccaatgaagaaagtgagctttgcaaggttaagtaaattggccacaaccaccaagctaatgcaaggtagagccaggactcaaacccgcctttgaccaattccaaactaggctaagagcctcacaagactgaatttaagagaccaaaatgaacattcaaaatgttgcactgtggatgcaaagatggaaggcacagagtcctaggcttcagagatgctacattccagcagggggtggacattccacagacgtgcaatccaacctggatggactagagtggagacttaccagaaacagagtgaccaatgacctaggaggttattgtcaatgcccacattaggggaaaatgtcacagtctcccaaagatgaccaaatgaaagtaacagtaataactaacactttcctagcccttggtttgtagcaagtgctaccctcagcatttaacacatgatcctcccaacaaccccaggcagcaggaggataatgtggggtgacatctcccagcatttgaaagtcaatttgaagaccgggtgcagtggcacatgcctgtaatcccagcactttgggaggctgaggcgggtggatcacttgagatcaggagttcgagaccagcctggccaacatggtgaaaccccgtctctactaaaaatacagaaattagccggacatggtggtgcgcacctgtaatcccagctactcgggaggctgaggcaagagaatcacttgaacctgataggtggaggttgcagtgagccgagactgcaccactgcactccagtctgggcacgagagtgaagctccatctcaaaaaaaaaaaaaagccaatttgatactaggaactgtttgagggcgttttcagtattattttattcccactttccaagtgagtgaactgaggcatgcagaggtgaagtggcttgcccaagatccaaaggtcagcaagcaacacaactatgatttaagcctgagtaggctggctccagagggcatgtccctgatgaccacactgaactatctagaatgagagacgttgctcattgagacattacaattctggtccattggattttagaaaggcaaccgtattacttatgttactactcacgtttgagaccctgttttctcagcagtgaactgttgaacttactttgctgagacataaaattggacatgggtagaaggggctacagtgaagtgcatttccaaggtgaagcacatcaccacaggagtgagacaagaaacccgggaagcagcctctgtcatccatgagccttccactctcaatgctccaggcaaagagccacgccaggtaagattcaaagtgggagagggcagactgggagatgatgcattcaaatcatgagggcaggctcaggtaactactgtcaattcaccacccctgaattagggccaacgtaaaccagtgacaatctctttgaaacatgaagcagggaggcagttatgccccttagtccctttatcctgaaggtgtttaagaagctgagtagctttcaagctgcagacagggataagaagaggcagagctgaaggcactccagagcagcataggaagagggtaagagttaacaatctgaagacagaaaaccctgggttctaatgctggtactgccacttattaaggatgcctcttgggcaagtgacatcacatagccattgcaagccccagtttttgtacatctgtaaaatgggaaaaatacagatagtatctacatcataggctgatttagaggattgagataatgcatataaagtgcttgacaccatgtctgacacctagcaaatacccagtaaacattcagttttctcattgggtcatgataatggttctggcagagccagctatggacagcagaagccctcagtgtgggactcgggagccccttcagcagtccaggtgttctccaaatctatttcaatctcctgggtgcagtgctacatttcccaggatcccttgcagttaaaataccatgtgatcaagttctggccaatgaactgtgtgggtagacgtgatgtgaatgacttccataactacccctacaaaactacccctcatgatccttacttctcatcccctatcatccggacagatgcagagggtccagcagagaccttcaggggcccctagaagatttcaggtccacaagtgaaaggagccggggtctttaatgactgtctgaagtgtgtcttcactgcaccctccacacacaccatcaatggtactttgtatgagcaatacgtaaacttctgctgtattaagtcattgacatgttgacctcttgttacagaggtggcctagctgactaatacacagtttatcaaacctcaagatggactcacaggtccctgttgcctcaatgattccatcgccactgcacacaccagagtctagataccataaatatggtccaggagagaaaccagcagcgtggtgtggtaactggcaactggccaggtatggtaagcataaggtaaagcctgcagcaactcaagaaatgcagagggaagactactcgtctagaagaaacaggatggcccagcagcaatattacctgtgctcatagctactggttcttcaggagaacaggaaagagcatggtctcaaaggccaagcatatcagaggccatatctgcctgggatctacccagaaaagtgactgaactgctctgggcttcagtttccacaactgccaatcatggataacaataccctatgttctgtgacatcacactggtatcttcaaaccagccagggcaggaatatttataccataggaattgacgaacaccgtacatagggactttcttctctagaaatcccgttgttaatcacttaccagcacatccctggataaacaggagtcagctaagtggaaggggagaaggaggacaagaaaagagaagtccggcagtgtgaacagcatgtgtgaaggcccagaggtaaaaatcaaaaggtttaacgaaatgaaggaagtcctaagtggctgggtgtggagagcttgggaagatgttaagaggaacctagaaagagggcaggagctggaccttgtgaaaggacttcactaaatagtaattatttgttccagtcatccatggctatgtaacaaattaccccaaaatgtagtggcttaaaacaatcatttcattttgtttatgacttttaagtaaggaattcatagagggatcagctggtgggttcatctccaatctatgtcaactggggttggaggatccacttccatgatggcatcttcacacatatgcgtggtgccccagtagtgtctctctgtctgtctgtctctctctctctctctctctctctctctctcgtatgcccacgcacatgcttcctctcactctcgctcttccccctgtagtggccaacttccctaagaagtagcattcccagataacaaatgaactgccagggttcttccaacatagcctcagaagtcacatagcatcatttccaccacaatccatgggttacaagcaacccatggattacaggggctagctctgccccaaagggtacaacccaagaggatgaacgtgaggagtcgtggttcactgagggcctgctttgatgaccagccaccacattgagcgacccctggtcactgccctctaggaccacctgccaggcacagatccagaaagaaaccaggaccagccctgtccacaaggagctgtctgcagaggagacaggatgcctgtatagaaaatagggctgcagcatcagacggctgctccccacccaggatggaaggacaaacagagaggacgcatcagggaagggagaggcagagaaagctgactagggtaggtagagaaggcttcccaggaaggcggcattcccagcaagatgagctaagacttggaggatggaggaggtggagggttggaagggaaggagtaggccatcactggggccacccccagccttctatcacatttggatcactatggaccacgccaggtcatctccgcttttcccagcagggatgttgatcagacctgggcactctgcagtgatgatcagcagctcaagagcaagggtggctcctgaccgtgaggggtcagcaccaggcccacaagcctgtctgttgcaccagtgcccaggaggggctgtcgactgcagaactgttttctctggctcgacctcacccagaaccagcggcagaaaggccagttatgcaaccatcctcaccacagcctgccagcctcagaggctgggcctggccgccgggcctggccgccaggcctggtaaggagactgctgtggcctgcacagcacaaggccatcctgggccccaactgccactttccatgcaggtgcaagacgctctgctgacaaatacctggggaaagcaggagctgtgggagggaggtaaaaatagcacagttggcaacagagaaggcttttctaagtcctcagggtcctattagtccttgtccatgggatacacatgagctggcactgagcattctctcttctccaaggctcatgcttagaacaggcacagaggcctgggaggcctcttgtatcatgtcaggagctgcacagtgatcagaagttagggagagcgcctgttgcagaggctggatttggaggatatgctggggctgccgtcataaccccacatccccagtgggttctctctggccactccctctacggccagttctgttttctccccatttttggaaacccaaattcttgatgtttctgttattcacattgccattaagaattatgggctttgcactgtgtttttaatttgttgtgtaagggttttacacaaacacagctagatgcctagaaaagacaatgtatatgggcatgcaggctgtgcactgcacaactccagagggcttcattcatgaccaggatgtgagtggcgccctggaatcatgcaatgtggttaccggtattgccagagaggaaatgatgtcttacatgaccccatatccccgggaaaaggccagccatgctaataaagatttgctaactaaccaatttgtctcctgcttccaaatattccatgcacggggtttggcaggcacacggccacaatgcgcaatggcctagaaagagagccatattgaaatataataatgtatttccaggccacggaggtggagaggcacaaggaattgatctttctaaggcaaggaagattcataaccactgaatgagttaaccactaccttcttctgagtgtgcagattaaattctctgtcgcaccaacatccaagtgcgctaaattttaacagacctggaatttggatatatttatttctctttcacagaattcccattcttttactaacacagtttcagagtttgagatatgagcatatctcatgtgggataataaggcatcattccacaccaggttgcacaggcccatggtttaatgatgagacttcgctggtgggtgcaaactttgctggtcccccatgctctcttgaatctgtgtgcatctcacacatacgtacatgtacacacacacacacacacacacacccctctctcaagtttttaaaaacctacttaaattctgcatcctacctccaatatactctgtgtacagtgtaagtgttaataccaaaaatagtgtttttctgctgggcacagtggctcacgcctgtaattccagcactttgggggccgaggcaggtggaccacttgagctcaagagttagagaccagcctgggcaacatggcgaaactccatctccaccaaaaatacaaaaaattagccaggcatgatggtgcatgcctgtagtcacatgcctgcaagtcccagctactcaggaggctgaggtgggagattgcttgagcccaggaggtggaggttttagagaaaaatagtgtttttctccaaaacttcatggaagactgttgacactcagaaaaatgacccaatattgattctgtgcctccacataccccccagcacagagatgtggcacatgtgctgtggttcataaaatacatttatatgtcatctgatgtgaatctcatagcagtcctggagttgtacattgagtaacctgcatgactgtatatagcccactgcctgtcaggtagagaaaaggtgattatcccattttccagcaagaaaaactaagactcagggaatgtaatagaactagacaacatttaaggttccttctcatcctgggaattgacatacctgagaattcagtagtacaaaactctctgaacttgtcaagggacctcacatctctccaggaacaacacaccactcctcttttcagtcctgtctatgtcatcagagtttccctcacactgtggccaggaagagctaaggaggtataaatgaggtgtacagtgtgggattaggtgcatgggatccacagcccacctgcctggatttaaactggctctgctcctcacctgtgtgtgaccctgagcagttactcaacctctctgtgcctcagttttctaatccataagtgaggataataataccaccgaattcactgggttgttgtgaggattatataatacatatagtttaaaaacaaccagacacacagtaatcactcaaagtttgttatccaaaaaaagaaaaacattctcattctctatgcatccattttctaacctgtaaaatgggaatttaaaaggggactacatcacaggattgttttgaggattaaataacagaataaacataaggagcttaaaacaatgcttaatgcatagaagccactcaaacaagtttgttctgattttttttcccctaagaaaatagtaactccaattcccacagaaagacttcccaaaacaaaagtaccaataagtctgaaaataaatgcaagacctgaggaggaatcattgctgttttctaaaaccagtgatagacaggctatcttagagaccggaggttcttgctttacattcattttctgaggtcaggaagtaaaaaggaacatgggtgaacaggcactggtgagatgaggaagaaagaacaggaacatctcagttgctagtttctgttttcaccatgaaaatcattttaaagccctgcctagaatttaaatagcatcatccctggagatagctgttttagtttcattacagtctgtgttcgtagagtacaaatagaaaccttcgtgattttattagtttccatgcaacttaggagagatttgcatgataacatttcatctcctgactttaaaaagggaccaattaaaaatacagcacttgcattgcctgtcacgggaaaatgaaaaggttcacagagttttaaaaacctctgccatatctagtccatggtcataaatcaagtattcagtactacggtggcaatcactattgtctaaatttttagtttattttgtaagaagtacttggaacagctgggtgcagtggctcacacctgtaatcccagcactctgggaggccgaggcaggtggagtacttgagatcaggagttcaagaccagcctggccaacacggtaaaaccccatctctactaaaaatacaaaaaaaaaaaattagctgttcatgatggtgcatgtctgtaatcccagttacgtgggaggctgaggcaggagaattgcttgaacccaggagacaaaggttgaggtgagccgagatcgtgacactgcaccctagcctggacgacagaccaagactccgtctcaaaaaaaaaaaaagaaagaaagaatatttgcaggatgtttgcacccctgaaaagagttaaactatagtacagaagaaacaaaatgtacaagtaagtatttttgcctggattgcagcaagtcctacacaattaccaacaccccaaagctacctggtactctgtggatttgtgaagtgttaatgtaatgtatctgtgacaagttaaaatttaatgcatggctccggtagcataatcgaatcgatgttatgtaacctaagagaactattccagtaagttctgatgtgctggctgcttacggttcagggggagtttttttcggaggttactgagtatttaggaatcatcccttcagacacttgctcttttgccacagaagctgcagttatcttatccctgctttcggcagctggaatgctccgtggaacagggctgagatgaacgttctatctccaaggctgcgttttggggcaagttaaggaaaaggatcaaagtaagttgatttgcatgaccttctctttaatcagatgtttctttttatgttcaacctcaacaaagccagcctatcatagcacactatttatagtctataatctaagatgttctgaaccattcccccacaccaaaaattaaaattaaaacctcaatagtggtgtggctatatcattagaagtaatagtagagtcacaaaaacctatttctgagactttttttttaaatgacaggtttgatggtatttccaatggggcctgtgtccctagattgtaattcttaaatatgtcatcaaagtcaatattgaagttctggggacaagtcaatcaaatttcactcttgtgttttatagtagaacaagaacttctccctggattcactgccctcaataacttaatctttggttctttatcaggtaaaaatgatagttttaaaatctgacttaagaaatggctttatattgaaatcatgaaatcagagaatttgttatatgcatgagaaaactaaggcctggagcctatgacttgtctaagacactgtagctagtcacttgtcatatgtcaaaatcaaaaatccggcgctcccttaacttcactctaagagtagacaccattaaaccagaccccacaggcagaaagagggttgttctcttcatttgtctgctctcaatgtgggcagggcctacatcaaagtcagcctgggtgcttctagaggggctgcaatctttagaggaagaatatcagctgcccaccgagaaaacaagaacgccaccgtaaagaacatgtcagggaaggaaatgtgcccaaagataatgctggtcatctcctggagggggaatttggaggaatgtttttcccttttctcaaatgtttatttataattgtggtgaaatacacagaagacaaaaatgtaccatcttaggctgggcacagtggctcacgcctgtaatcccagcactttgggaggctgaggcgggcggatcacgagatcaggagatccagaccatggtgaaaccccgtctctactaaaaatacaaaaagttagctgggcgtggtggtgggcgcctgtagtcccagctactccggaggctgaggcaggagaatggcttgaacctgggaggcggagcttgcagtgagccgagatcatgccactgcactccagcctgggcgacagagcgagactctgccaaaaaaaaaagtaccatctcaaccatttttaagtgtgtagtacttcacacttaaaaatgtgcatgtttcacattgttgtgcatcccatctccagaactttttcatcttacaaaactgaaaccctatacccattaaacacttccctccctctggccctggaaactacccttctactttctgtttctatgagtttggcaactctatgtacctcatgtaagtggaagttatccttttgtgactggcttatttcatttggctgatgtcctcgatgttcatctatgtggtagcacgtgtcagacttgccttcctttttaaagttgaataatactctgttgtatgtacctaccacaattcgctaatctattcatctgtgaatgaacccttgaattgcttccacctttggccattgtaaataatgctgctgtgaacatgggtgtacaaatatctccttaagaccctgcttttaagttttttggatatctaaccagaagtggaattgctggattatatgataattgaatgattaatttgttttgagaaactgccatactgctttccaccgcatctgtaccactttgcattcccacaaacactgcacaagggttccaatttctccacatcctcaccaacactggtgattttctatttttttttttttacagtagccatcctaacagatgtgactgtgtcctttttgtttaatgcccctgcacggcctacgttttctacaatgaacatgtagtatatttgggattaaggacaaaatataaaatactgaagttaaaaagtaaatcctatggagaaaacagggttgtgaaagaacttaagaaatgattgggttttttttttttagactgaggcaaactgttgagccctcttgtgggctcagctagagacatcattcctatactcttcaagaatctaccacctgatcggctgtggctgccacaagccacaggagaaacggccataattcatgggcagctgaaataattcctctaagctctgggaggaaagtgttcccagatgcaggaaggagaacaacaatgtatattaagctgttgccagctaatgttggtcataaaaatccctagcacttgggtaaggcctttcatcttccaaatctttcctccaagccttagaacacttatctctgagttctccatttgaataactggaggcccatttttccccttccagagccacaaagggtccactttccaaaaccacataaagagaaaacaacgtcaatgtggcaacttctcccaaagaggagcagaattctgctcttggttaacaagcacacaaagaacatctcccacaaacccttccaacgcttcacctctgagccacacaggccgcgtgctatcagttcattccacagaatgtctcgtttgaagagctaaaattttccaaacgtgaactcattctacccactggtagaatgctttactccttggaggtgaagtcatttgacatgatttattcattaagacaaaggtgaggtaactaaaaccaaaatccatccaattagctatttatccaacctctaactctcagaggagaaattcttttttccttggtgtcaacctctccctctacctcctgccctccctcaccttcttcctttgtgtgttttgctctcttttcttttctggtttctttctgttcagcaaaataggggagatgacagcagaggcatacaggagccccagaggaaaggagacccaatgagcaggtgggaaagaaacagcctcctattctaagaagcggctgtattcaagtgatgcaaaaagaggttcaagagcactgtctgtctccctaggtgaaaaagagtcaacacctagaaaatggaatccaactcgagtttcctaacaaaggctctgtaccctacatccaaattcttggcagggcccccaaattacaacccccacgtgaaactgagaagggggctaaaccttggagatacaaggcacgtgacattgataaggaggtgaatttatggcccagcaacagtcaaaagcctccagtcacagctgctgacaagaccgaagagacctcagaaggcaaacttcaagaaacaaccagaatgggtcgttttctgaactctgggcaaaggggcaaagggaaaccacactgtctcaggaggacgaagaacccagggaagccatcagggagaaaaataaagtggccttcatggaggaaacacaagttaaggttaaggtcattctacgtctcaacactgcggacatggaaacaccacccagctctgtcccttcctgaactggatttagaatttgaaatctaccatccaccaaggcttgttctgcatgtcccagacacagactagaagcaaacaaggactagtgcaaacagaaagatctttccaagttcatcgtaaggtgggtttgtccccagtggaatagtggcctcaggagatcataaacacactggtagggtgggcttccagcactggggaggaatcgcacagggcctgaggccccaaagcttccttccaccactgtgaatttatagttccatgcgcttctgcacttgttaaatcaggtcgctatttgttgtctactaatctacaaacctgaagcccccagccagcagaggccactctcgatcccaccccccagccccagttcactcccaaagatgaagacagagaggactgtccagtctctaaaagggaagaaggagcaagaacaagacatggaaccagaaaataaaataaatactcatcttatactcccaacttgaaatgcacatacaggcagcccaacagcctgtagataatttggtttacaatgatatgcaaagatgcagacccatcgtggctgaatagtttcgtacagttagaagtgaccctggaaagaatattactgacagtcttgccttaaaaactcttttgcaaaagacatcatggtcccagacttcagcagttaacagatggaaattaacttcacttcaagtcaaaaacctaaaatctcgccgggcgcggtggctcatgcctgtaatcccagcactttgggaggccaaggcgggtggatcatttgaggtcaggagttcaagaccagcctgactgacatggtgaaatcccgtctccattaaaaatacaaaaattagccaggcatggggcatgagaacctggaatgccaggtactcaggaggcactagaaccctggagggagaggttacagtgagccgagatcatgccactgcactccagcctgccagcctgggcaacacagcaagacggtatctcaaaaaaaaaaaaaaatctaaaatcctatttttcctttttaaaaaaacaccccttccccaagtaaaagtcaactctgataatggggagatctacataatgtttaccttaattacttcttccccaaattgaagtattcctccctattgtgctagaaaccaaaattaaacagcaccaactttccacagaaaccctcaggaatgacagccactaaggaaaaaaggatgtaaaagaaaggatggagcaagaggaggagggggagaaggctggaattcaggctttcctgtgaattcgctttgaaatgcctagaggccactggatctgagtccccaagaaaatctggtagagaggccagtgaaccagcataaagaatagaaaataaaggagatgtgttaaataattttgattttggccacgtgaagaagtattagtcatacaggtaacaagatcttacagggagatgattccaaggctcggcttgacaacgttaagtgtatatccattctgggcctggagtgccaattacatttccaaattggcaattagacacaatgtcccaagacaatcaccaaataatgccaaaaacaaagcaagttccatcttaaagcagccattcttttgaaactgcccttccctcccgtgcctgactcatccacctcacaaacaactgcccattatgaactaaatccttgttagctactgatcaagagaaaccaggtggcatgaataattaaaatccacgaatgattcaagcaccatgttgtcaacaaaccaagcccatctctttcaccaggagtttctccatagcatctaacaaattacccaaaaaagcaggaaaatatatttgccacccccaaccaatgcattctcgttcagcccccagctaactactggaaagagccttccaacatctacgtgtgtttacatttgcatgactcagttcctgccctcaaggagtttgcaggcaattcagagatcagatgttcatattccatgagaagataactgttttttcctctgctcagcctgtcaagtactaataaaagccctaacaagcagggagtcagaactgggtcttaattatttttcccccagcacctagcttggtttctggcacatcgtatacacttaatatgcaacaaaagcaaaaacaacaacaataattataaccagaagacttctttgagggcctactgtgtgcaggccgccacgatgctaggtccttcttcattctgcctgctgcagacactcatggtgctcccctctgatgatgaaacaacataaaaagcacatctcatggaaaaagtccctgacagtgtgagctgtgaaaaaccctggtatggtgagaaaaggagctactttcactttcatcttctggaattcttaagaagtgcattggagggccacacagcacggtgccacgcgtgtcccccagtcactccacgggcagctcttcagccaattctttgaggttgaaccctccatttgggaaggcccacccaggcccctacagaaaatcaggctggcagtcttaatgcccactgacttcaaacactccagagggagtggtccccagccagcctggggcatcaccgcagtgcagccctggtgacaccaccagcctttaattttgcaaggaggtagtttggctgggttgccctcctggacttcgggaagtcacaccctttgcagaatgaccaactggcacgaggaagagcccacacattggtgggtaacacacagaccacaccctgtaaacactgctctggccaccacaacccaaccctaaatccacaacgctgatgggttccttaggagcaggcacctggaccatcagttttcgcaaataagagcccagcccgaaccacagctaccctggtctgaaaggagttttctccacccaacgatctggcagagcaaaccttctgcttctcatcccttcccccttcaagagctgggaatttccacatttaaaaataagcctgtcttcagggatggactgcacggaggctgagggatggaccagatccttgatactcaaagtgtggtctgcacagcatcagtatagcctgtgtctcgccagaccagcataatctcaggtcccacactggatcttctgaatcacagcctgcattttaacagctctcggtgattcctgagcatattaaagtttgactaagccaggcacagtggctcacaccactgtgggagcactttgggagaccaagatgggaagatcacttgaacccaggagttcaagacaagcctgggcaacatagggagaccccatctctgtaaaaaatttaaaacctagccaggtgtggtggcacacacccataagtcttggctacttggggagctgaggcaagaggatcacttgagcctgggaggttgaagctgcagtgagcagtgatcatgccactgtactccagcctgggcaacagagtgagaccctgtcccaaaaaaaaaaaaaaaaaaaaaaagtttgagaagcccaggcctagagacactctccagtccttggagataaagatgtgatattcccactgaacattccccaggttttctgtccaaagtgctaggacacccttgcctccgagggtccctgggtttccttttctaggtgcctaatgcgtggggttccacccacccaagaagcagttctaaaagagacatccttggtctgctccctgactgtgcacagaaaggcatggccctgtctgatccccagggatgtctccaagggacccagtgttccccacacggcccagggcctggcatcacagcacaaacagccctttcactggaaccacaaaggcgaccttccaggggatctgcagcttggcaaggtggtattggctgctgtgattcacagattagcatggtcactgccagtgtgagccgggacgcccactttgggaaggaggtcctggcattgcaatcgaatgccaatgtaactgtttctgcaccaggcctctcatgccctgatgagagagagagaaagagagagacagccccaaagcaagcacttactcctggctatcagccaccaatgaatgtccccatccagggaacaaaatagctgtgaggcaaagagaaggtccatttggacttaccattggaatgctttatcccccaggccaaacagcagggggcaggcagctcttcttttcctcctgttgtatgtttggtcaagtttcctgggcacctagaagcagggctagcccaaggctcccaaagggaggccataggttctcagtgtcctcctaggaaatgctataaaatggggttggtgaaaaaaaccaccccatgaggctgtgctctatcacagacctcaatttgcaggtgaggaaactgaggcacaaaggcatgacgtctttgcccaggatcacaggctgaaccttgggcactgcacagcacccctgacactgaagcaagactgctcacaggtagcacatttgagggcattttaaccactttctctaccagcaggatgccgccaagcctgtgatgtggccctccaaaggggaagctcagccacgccatgcctgctgattttttttcacaaggtaatttaaaaggcaggtgtgccacagaacacacttggggaaacctggcctagggggtgtcttggaaaagctggtctgggtagacagtgagtgtcctggccaagagaccgtgacatcacttgggagacaggtctatgagttctggacttgggataacagggatggaatttgtccctcctcaagggtacaatgctggacaaccatacctgcccaccaaatgccacagtgtttcccttctgccagcccagcagctcctggtcccccatactgtcgatgttcgtccactgataccccaccatcaaaactgtaaccatcctgccaggaccccatccgtgaagcctacctctgctgccctgccctaactttccagccttgcaacagccaagagccataagcccatgtctcagtctgactctaaatggttttttgatctatgacagtatacttcaggatctaaagcctccttttggctcaaaaactttatttgttatagtctgcgcccttcaggggctataagttcaatgaatcaaagggaaaataaactcagcacttcatgaagctatgatagttaccacttacaagaggcctgctaagtgtctggcatttgcagggtgctatgtgcccattattcctgctccctataagaaccctacaaagtaagcatcagtatgctcttggtataggtgatgtaaccaaagctcaacatggttggcagtcaaagatgccctgctaataaatgtgagatccatgatttgaacttgggtttgcctgattgcagagtcttgtactaaagtgtgcatttccataaagagggccaggggctggacgccgtgcctcacgcctgtaatcccagcactttgggaggccaaggtgggcgaatcacaaggtcaggagatcaagacaatcctggccaatgtggtgaaaccccgtctctacttaaaatacaaaaattagccaggtgtggcagcgtgcgcctgtagtcccagctacttgggaggctgaggcaggagaattgcttgaacccaggaggcgcaggctgcagtgagccaagatcgtgccgctgcactccagcctgggtgacagagcgagactccatctcaaaaaaaaaaattaataaaaggagagagagagagagcaaggaatgaggagcacgagctctctggacaagggcaggtcagctggagctcccccgtgactaggacccaagaactcctccaaggccaccccaagtgatctgctcaaaaaggagtatctcaaggtcatctggtgcagccaatccccaggacaggatgagatgaggcacaagggccaatctggaatcaagagctccacggcactgaagctccagccctgattgactgcgtcaggccagaccctgggtaattaccaagctgtaatgggatctgatatttatattagtcacgagcctgacagagaaaacgtgttgttttctcaggcacagccatggagacaacatctcgataattcattacacgcagaccatccttgatcaagcccaagcttctacaaggccaacagctcaaactgagaatggaaataactctatgcccagccacactcaggcccctcaacaaaccacagctccaacaggaagttggcctcagtttccccagttatttaaagagaagtagaccacatgctggaagacgagcagaagatggaaataaagatatgtaactgtcccaaggctgaattcctaaaggaattgctagggaactgcaaaacacattctgagctagaaactttaaccctcattcctcaactcctccctctctcctatatcgaatcacagagcaggaagggacattagaactcacagaattcaatccccacattttatacacaaggaaagatagacaccagagaggttaaataacttcttcaaagtcatggctttattcaggctaccagagcagctccctattcaatatagtctatgacaggattgaacttcacaacgtcacacccaagtgaatagagagctctgatgaaatcccacaaggaaaaaaacaataatgtgaaaaagtacagcaaagaacacagtactggaatgactgtgaccaagttcccaacaggaggaaattgtaatgttttcttcttcactttctgaaaaagtccacatgccactcttttcaaaagactaaagtcattcactgtttgagattcagaggccaaaggtactaatgaagagatgtcccacgatgcatgtccacagtcttgggttcctttgatcaaaaaggtttggtgcgatcccagagaccaaacgctcatgaaattggagctccttgctgaattttatctcccacagaatttcagacctgctttcctctggactccagctcttgatcaaaccatcttggggctgaaggagggtgagggtgaacccatctgagggctggtagaattttctggaaaggcagcctatgttttcttgggaaatctagcacaaaaattattattctaagcttaagccaaatacatgcctgtgtatcgagtcttgacaaaactaccaaatacttggaaagaaaaaagaaaaaaagacaaacacacacacacacacacacacacacacacacacaattgcaataaaaatacagacctcaagcatagaaagaaaagcttttaaaaggcctaacttaccgttactgcatataatgagctggctacctatggcttaagtgagcaaatctaggggcaggtatcaagagattctaggtgtgctttaaaatggacttacggtatcaaaaggaacctgcactcattctatactggcctcacatcttccaaacaaaccaccatcacctctcatccctggcagatttcttacagcaactcacttccagttatgtccactcagcaggtcttggggctacaaaacatagccaaatatttacgaattgttttttctaatcgttgccaaaaacctattttcttgagtaaactgacagaagttatgcttgctcatcatttaggagatcctttgtgtgtgcgatgggattagcatttcattacagacactgcaattgcatttatgtaccccctaacataaaaagactttggaagctgtgtttaggaccccaggttcacaaaaacaccacaacttattttcaatcatggaaaaagttttcattatgataaaaattgccccctgcctgaaagaaagcaagctgttaaaaagttcacccagatcactctatctagggaacatttcagaggcacacaactatgagctatctttcccctaaagacagtcgctgaatctcagtaaaccggggaacaaaattcccgagactgttgggggaggtggaggagaaggatggagagagggaatgtgggaatttgaaggctccaggaataagctgttctcagcaggaaggctagtcagggatctggtgtatagggctttgcttaacctgagggcttctctggaaggtgggaggtttgcctccttaacaaataagaagaaacctctacggctgagaaggtaattccaaagaaaactctccgaccagcacctgcaggcctccggagaagccagagaatgacgaagagaatgatggttttcatatttctccctttgttccaatacaccagtattttccaaaacacaaatgtgctgccacaaaacacagctgagctccagcacccaacaggatgtataattaatgatcaggagagacaggctccttcccccctggtgttttcatagccagccttcacccatagccccaggcttccctacttctctcagccgccaaggaggctgctacaagttgctgtgccctgtagaagtttgaggggtcctcggtttaactttactagaaaagatgtgaacatgtggaggctgcaatgtgtatctaccctgcactattcccctggatttcccttccctccaaaacggttcgcgcgtgaagtcccctaggatgggaattactcagaaagaaggcagctggctcactctcttttttccagttctttcttttttattctgcagttttctatcagtgtcgggtcccccactccagccagtggctgtggggaagggaagacatctctagggacacgactacagaccaggcagtgagcctagcaaccatacatcgaaggtgtcgccagcctcagtgccggtgggcgtctgcaccaggaatagctaaagccgacgacatctagccacctcgagcgccagggaagacgctccgcgtaaaaccgcggcctcaggcggactcccgctccagctccgcgctgctggtggcatttccggggacccaaagtgggtggcctgggggcaaaggaacagaggccgaagaacttggggtatgttccactagagcacctaagggacggagtgggaggttacatcagatatgcgacctcgacacattccaaaagtggcagccccgtgggctacccccaatagtgggatggatctccccaacttctctcgcccctcgaagtccccctgttatctcgggccatgctcctcccccgggattcccttgtgcaaaattattctctcccttgcccaaaggatttttcccttctttctgaccccacgaactcatctccccaacaggttcctaaagtatgggcggatgtgctccctctcgcccaccgccaggagccgagccccggcaggtgagcggtgcaaaacacgcacccagctgcccccagcttcctccgtccccgctgagttggctgtccccaccccgcaccacggcacccgagcctgtgagtccccgaccccggccccagccgcagccgccaacaaccctacaataaacaagaggacaggattgagcgtccgcgtcccggagcgcactggctgggggcaactcctcacccccggcgcgccgcccgctgccccgatccgagagcaccgggagagccgagggaagggaaggcggcgaggggaaggcaggcggggatggagggaggcacggcgcggcgcggagcgaggaggtgggctgcaggggacgccgagaagcggtggggctggcgcagagggcgggcgcccggggcgcgcgttaccttcgtcttgcccccgcagtggcagcacacggtccacaggtacttgagcgtccgccagagcaagatgatgaagaggcccccgaagaaagtcaccatggaggaggccaggaaagcccaccacatgcgttggccccggctgtcgcacggcacctccatggtcaccgggatgatgagcgcatccatcttgggctcgtggaccgaggacgaggaggaagaggaggaggaagaagaagaagaggaagaggaggaggaggaggaggaggacgcgtctaggctgagatggttcgcgtggatattgctactcattctaagactgctgcctccgccgccgccgccgccgccgctgctgccgccgccgccgccgccaccatttgccatagctagcaacgggcagccggcgcaggggctcgggggagctcctcccgccgccagcgccaccccaaacacccatcaacagccatattgctgctactgctgccgccgccgccgccgccgcggagcgcgggaggggggcggggaggcgcctgggctcggggcgctgtgcgcgacctggcg

SEQ ID NO: 907 - DNA, 752944 bp, Homo sapiens; identical to SEQ ID NO: 906

SEQ ID NO: 908 - DNA, 752944 bp, Homo sapiens; identical to SEQ ID NO: 906

SEQ ID NO: 909 - DNA, 768220 bp, Homo sapiens
tgttttagaacacaaatacataaatttttaatctgcgaaaaatacaaaatgaaaccatgtacaagttatgtacaaaccctttttacaagacaagagagttatcactggttgttacagatgacagagttgggtagatcatttcagagcaccagcatatagtctcttcttcaattcctgtcaggtcagagtaattaatcataatcataatcataatgccaacaatcaaaagattgaaagatgaataagccacgctctttttcctcaatgaacatgtaggctgaactctgcatgtgtgtactttttttttctttgtcccctaaagaaaccttgaagtgcaggttttggtgttaagcagagaaaggtttcttttcaacatctgggtggtgggatgtgggccagaagttttaggcaggatgtgattgtgccacctgggaatgcaacgtttttaattaggatttcccaacagatctgggtttgtgtttgaaatgttgcagttctggtcaaaggcgtgtcaggctgcattgagcggaaggaaggggaggagagcgagcgctctggggcagatgggactctggttttgtgtggaagtgaggctcagtccaccttgcgggcggggctcctgtccctgccagctgccttcccacgctgaccctgagtcccatgggagggaagcactgggtcactcccgcaggcgtgtgtcaatgccttgtgtacatttccatctaagattctaaacagtggggcccggtagtgcttcccaaggcaggcatggccgagagcattggtgtcacttctgcccctgttctgttaactagcaagatggaggagaagcagcagcacagaagtcctcaagggataagcaaaggaaacctttctaaactgaaaaacctacctaaaaataaagtccactttcacctggccagaacatctcttctcacaatgcctgttcagaaaagccaccaaagcaaggtggtcgtagcatttgttttcagacccctgaaactaaggatgcagtgtgtgtgctgttcagggagggaagaagaacagtgcagtgacatgcacaggaaggtgaaaggagatgcccaccctgagacccctccctggtgagtcctccagaaagactgccgatcaccacaggttctgtccagcctccatccaccatggcagccacagtgatacatagtggccgagtgactgcccacgtgggccagacctcatgacaaactctgggaatatggacaaataagcagagttcctgcccttcgagtgagtcttttgacttgtgcctcaccatctccaacacctttcatctccaacctcatagatgatcttccctctctttcttaaaattcccctcttgtttctcatttccctggttctggagtaccctagatctcctgtcccaagaagttctacttattttgctccttcttagtcctgaaaaacttggctgtagcccacaaacacatctgccagctgatctaaacctacactttctccctaaaataattcatccaggatcctcactttctaagtgcctctgtgggtctggcttccacatctgcagggcctgttgtagcccactcctttactcccctgtcccactcctcttgcctgtgtggccttccctcacggacagctctcagcttttcttgctctggatgaacccaatgtaacatttcttagctgctgtactcactgcctccgcttcttgcctgcttctcttgttttcctattcctccacatggttctgtccttgaggacagattaggtgtgtgtccactgcacaatgaatatactctagacccacagccattgccccacatccagtccctacaatcccaaccaatcttctacaactattacgatctataacatttatttgctattcagtgttcacatttattcaaaaattatttattgaacacctgttttgtgcaacatgatctttccaatatatgtgtgccttgtgttcccagttaggcaggtgggctgtcttcctctaatagtcttaccatcgtgaggacacagcagctgctcagtaaatatcaattagcagttactgattaacatcattcaccctgccacatgccagataatcctgccttcatacctagaatgctgatcctctacttatctaactcctaaacccccctttctctagaaatcctaccttgttgaaccacttcaaaccacagcatttctcccttgtttcaactcctaccatattgaatgtgaaactatgtcattagggctcaccctttctctaatggtgctttgagcatgttttctttctttagttgtattataagctgattgatggcagaacccatattgtgctcatttctcccccactcactccttgtacaaatattttatgagtgctaattggtttctaaacaagggctacctgattagctgcaagggtgttttcataaggggaattcctatttggcagttctggactattaattattctctactatttgtggatgtcctgcctcatgttcttattatattactgtctagaaaacagtatgattggcaggtttttaaaaatttatgtatctattcctaccctctaatctactttgtgagtttgttgctgacattctagtaattcaggagagtcaggacgttctacgtctgatggtcctgtgacagaaagcaaagcaaaatgtgtgaggaaggtgctgcacacggtgagttgttgacttggagtgtgcaccctttagcactccttgctgctgagaaaatgttcagttttgtgtgcattctcatgatatcttccaggaagaactgacatctcactactttcaacctgaaaaatgcacagccattgctgccccatcactctttgcttaaaactctgagtggcttttcatgactttctaaatcaagtttcaaactttatctaggcctttagactgtactttgtagccccttccatgaagtctcatctcagttttcctcagttcccctacacaaacttatcacagtagacaaaatagtcaatctattgaaatcacattcctacaaatacatcatggcccattaagtcccatctccctggaaaaccctcatattccacatctttccagtcctgtcacccatttactattgaaatgcctccaaagcccatcaaacattgtatacctctgcattcttgccagcctacgcagttcaatgcaaactcttctttctttcaacccaaagaactactctttgtaccatatgcatgcccataactcatggtattttaaaatactgcttattatatctttttcttttttttctttcttcccagattcttaatgtataccccaagtttggcttatctttagatagggagtctcaggtcctttttgtgattaaaaaaatatgccaaaagaggaaggtctgctacaggtggtctaagtcagaattctttctccaatctatccatgtggggctgtgatatcatggagcttccaactgttgtagggctaaaggtgcctctgcctttgagcatgtaggcttctttttatacatgttttaagcaagcttaccataaaaattgaaaattaggctctgtggtctcttaagaaataaaattaaaaatgttttccaagttttcttatttttatggaaatcttgaaattattaacaactgatactttattggaaacaaacaatcagaagagactccacttaaacaaccaatatgaccaaactagtacaaactgcctaggaatcatttataattactactgtctcataaataaatccaaatagcgtcatcacctcctcaaatgacctgggatttatatgctaaatcatctctgctggattaaaaaaattgccttttgggaataaggagaggatcagaaaggtaatttaccagaagattgtaagtaaattctgtttcttttgctttttaaagagggtgagtcaagtcctcattagtgaaggtcctttcaaggctcatggtgactggtggctttaccaccattccaaaagcagcaagtaagaacaaaacagaaaatggacagattctgccctggaactcagtgttcaagctgaatggatctacttagtctcctaggagtcaagccggctcacatctcagtcaattggttggatagtctttgtttctctcccttcctacctttattcctcaatttcttccttccttccttcaatgagattctctttcacaatgaaacacaatagattaaaattacatttgtgaatgtaagtagctaagagatggttagtttattaatgaaagaaaataaccaaataaacagaggacaggaaatgaagtgagaaggaagactggttacttcctgaagattcacatggggaaacataaatggggaaaatggcaggaatttggggtctcttgaacctctagttacatactaggaattggagacatggcatagagatgaagggattaactgaagctgggccttgaaccaaaaaaaaaacaacaaaaaagggaaggcagggatgaaactgagaagaaaaccctagaaacaggcagcaaaatttgaccaacgtgatgcaggtgtgtccaaattgagaaatctgcatcttgaacctaaagagaatctaaagtgaaaagaccaggaatgaacctacctattctatgtccagagcagaaaatgttcaccactcctgagtaaggctgggagtgttgcctgggtgatgcagcaaaaaggacctttattccagtcctggacacaatagtctgcatgggcttagccaaggagaagcagccactcccatgttcccactcctaacttagatcacgtcccctgggacctgaaagagaccttagagtcatctagatgaatcactctcatttacaaatgaagtcactgagactcagagagttttaaaaacatttttaaagatcaagtttgttgtttgtaaatgtggctcttgcaccctcatattaaatggtaactagggaacttgtgctttttctcctttcaacatgaaaaagtcccaaatttcttatgctttttcacttttcctttatctaaccctaacacttctaatttcctgtttatttaaaatcttcaatcaatttttttacaaagtacatcataaggtgccagaacccttgggaggaaagattggaatgttctccaacgtgccttagtcacaatcacttttatttaaggtgttttataatggttcaagatgatattctaaaatataaaattgcttagacaaaaataaaagttttctcaaggagaaaggttatgatggtgatgatattttctgctttgtaaacagcctgttggtgacccacagcacccaagaatcattagtttgggagaatggcttttctggagccctaaactgggataggaaatcagagcctcataatgtggactgtaccaaagaccctccttggtctcaggcggatgtaggcagaaagacagactgttgcagtggagatggatgggactcagggccaaagagctcaacaagtaggaacaagccagggagaagctctggcatttgcttgagccctccagtgatttcacaaatgttatttctgtttccatttcgtttctacttaccaggcaccagcttttgccaaagggcccaacaatcagtcattttcctacccccttaacaaaatgcctcattttgttttctagtccagaacaattcattattacaacggcaacacagtatgaacttattgctctatttaaaagaaaatgaatttttaccaatttggtttttttgggggggaggtgcttatgaatcaaggagccctttgctataggaaactatcctaactattatgattttttttaaaaaaagtttagattaaaatttctagccacaaatgcatcggtggatgtgtggtggggctggagtttgcatttctgcttccagattgccttgttaggggagacacagggaagagagggtcatgggaatggagctttgtgtcctgtgtccctctaatggaagatcctttatgtggccaccacagcctgccagaggagaccaaatcactctaacaaatttggaggtggttattacgagcaggagtgaagagcccactatggttcacgaaggaaagaagagcgtggattgacgtgaatatactaaggtgaccccaatgcaaaatcattatgtaaaaaaggcctagctttcaggaaagttgtcaaaatcctagcaaaacgttctccccacaaacacatttgacttctgttggaaaccaagaaatgtttataagcctgaatatagactgttgacatcattttagtctgctgagtaggctagtgattaattataagtagtttttaaacaatccaattggacatacattgtattcacaatacttttatagaactaattctacaaaatgtgacgacagagtaaccacagtccgacaaatcactgcaggacaatgcctacgaggtggaagcacgactatattggctctgcagggagtggacagaggtggaagctcattttgcctacgctggtaattggagtacttagtggacatatgtcttcatgatgatctcattgctttgctctgatctgatttgcactaccataactaggtaccacaggtcatggcccaaagagttaatggactagatatcatgaaacttcggggagatactttggttagcttggttccattaagtgtccacagtttacattttttaagaaaatagaaatcactattacatccatgcttctccagagaccttgatgatcatatcaaagattgataattttaaagttgaaagacttgctaagttgattggaacaaaacagttgccgggagactgtacaccgagcatgcaagcgatagcagagctctgagacatcgtaattgcatctgatggctagaaaaatcttttgaccgcagtttaaagtggctaatttatttgatttcactgctggtaattttcaaaggccttttctaacagtctatatgaagtgcattcgttgctttccttttgttattattatttttaaattgttgtaacaagttcatgtgtttggccccagcaactaaataaaggagagcatgcaaattaaaatctgtctccatgattgtagaaatttcctggtttttaaacaaaaactcagtgagaagaatgactgccctctcacatcctatggtaaagtaaaactactaatcagttttacaaacttccaggctaaaagctctgagacttggggagtggggagaaagtccaccagaccctcccgaagttgacattactcgctcaggtggtttggaaatataaaatgagaagcataacagcacgtaggagtctccaccactagaacagcaaacagagcaatgccttgtgtgcatctggtcctcagcttccacatcccaggtgtgcccacaaccctcctggtgtccttagttggccagacaaacctgatctgccaattgtagaaaagcagcagaaggtcttccctttaaaaatatgaacaaaggggtgagaactacagaatgaaaactagaactacaaaaatatgactttcaactgtgaaaataaataagtttccatttattaagagctggtgtcaatgcagatcaaaatacacacccatccaggcgaggagcaggtattcacctgtccccttagtcttcttttctggatttactaaaatacatgtatacatcattggccattttaaaattgttttaataattcatttcccttaattacaattaattgtggtggtgaccatcattctcctcaaagaaaaagagagaaagaagagaaaaacacattaaggagtctgaccacttattcatttagattttgcattgtttagatatagggaagatatttgacaatgaaaagaaaaaatatattttctttctaataaataaaaataatttaaaatgctagaggctatacatgactattttagtatgttcatttataaatgaaatcattttcttttccaaaatacatggaagcaatattcaaggcagacaaagagaaagatctgtctactttattttctggcaattcttgcttatcctaacgtttccaccagtgattcagcatgtaagaagaaaagtcacatcaccatttatgaagtttgtcaggctttaaaaaaatagttctggtctcctgggagtcaacattcatcttcaacttctctgattggtggaatcaagctgcttgtggatttatattggttgatctggttagccatgtgggtactcatgggcttgatttgaatgtttctgggataggcattatccggttcatctgtaaaccatttcttttctgctaaagggcaaaatggatagagaacaagaaggagaaatgagaagtttaattagtcctagggtaaagcctttggaaagttcattgaaaaacgcaaaaaggtaatcgatagaagccgacagtgagtaattgctaagagagacagtgcagtgtagggaggaccccagaacctgaaatatacctctgcttcctgtagcaagtgatgaacaaaatgtgccactgggactcataggcaccatgggcggacctcagaggctaaggagggattggagaatggactctggcaatgtcccttggagttaatttcatggccagaaaaggtttggtggggaggggatgttgcatatatcagccattgggtacagacattgtgcctgaggagagatgtgtgcatccattgatttgagtggaacggaagggcaccatcacccttgctgcagagcgagtgatccagaatcttacacagaatcaccacctcccagccttttcttggctttgcttataatacacacacttaaagccatgtctcaactataccactctcctgtttcatttgtagccactttggggggtctaaactaaacccatagattttgctggccaaaaatctatgaaaatcagaatagcgaccaatgttttaaagaggattttgaggtggcttttatttcaagaaagaaaactctgtgttggtataaagttatgaatagagttccaagtggcaatatcttaactgactataataacccaagctgtcgacaagggagctcaatgaagtcttggcatttcatttccaccctaaatacagaaatggctgagagagaatgctgagtcagggcgtttgggggctggggtgagaatgaaaatggtctagcatcctcttagcagtgcaaagctattttacaagactcaaccctcatccccacctctttctaggattgaaattttctgggaaattggccatgtgtatagataggaaaggactgggcaaataggacattctaacttgggaatcatatgcctcactttagtggcttagggaaagaaaagaaaaagaaaaagggtaaaagctatcaagcacgtccactgctatagagacaatggcctctgtagctgctttttctgcttaccagaacaatttgtaactgccttgtcagtggtcctgaatggacacattagtgaaaactgctcacctggtttgatagggggcgttgggggtggggtatgtgcatgtttggctaatgatttataaattatctatgatcagttcatgaccactctgcttgtttctcctcagttcctacttctgctgtttcaagtgccctgagctgtcaatgtcgaggagggctgtcactggagctgggatatgcctgagtcaaagcctcgccccagtttaatgcggcagctcagtttaccccacaggaaacttgctgcctcttgcctcgttctccccaccccctctcctgctctggctcactcacctattataattaagttcactttgatttgaacagattggacgataggaattcataatgctacatcctcacagtgaagctaactgattaagtgctttaaattattccccctgacagaatgataaagttacaatctgttctgagatgatctacagcttgccagactcctacagcttctttctacattcatttatctttttgtcaagcagagttttttttttttccctaagcttcaattccatagatcttttaaagtcatcagcacatctgaattattaatgaggctttagaggcaaggttcctgatgggctggttaaaaaaggttgtatagaaatccgggactgtgtacacatcaaaataatttcagctccatttaaaaaaccatttagttcaagtgtgacatagatgaaccattatgcatttgtggaaaccaattttttgtgatctacgattaaactaacctttcagagaggagtaaagtgtgatggttatcatgttttaaaagctttgccaggccgctgaaacaatttcacactacgactttttccaggggtttatgtgtaaagatgattttcagagaggttgagcctggtgtttgtgctcaggttgcctgagctgccctcggttttggccatgctgttatgcagactgactttgcaaagggatttagtgctaggttggacatgccaggttggaagagtgaactcagctgatggaaatgagtaggtcttttgggtgaaagacctaagacagctgcaatttgctgaaatttttacaactgctgaagagaataattgttcggaatttagtctttacagttcaattcaaagttggcattttgacctttcgcggcagagagaatatcaatttccttctgctgtctgtaagaaagagagcattatttcctcatttaaacttctctctttccttttacatttcttgccattaaaaaaaaaaatctaagcagagtagcccatgttttggccatgctgcctcaacacaaggagtgagttgtgttaacacacattgtggtgaggagttgaggtcttccttatgcctgagaaacagctgtttaatttgggtgcctcctaagatataaatgtgtgtgtttttggagacttggttatgtaggatgttcaggaaacggaactgtatgaatgctctgggcgttttactaaaatgtctggtgcaaaggtattttacgaacagattctcccaacatgcttccaaggaacacacatttcaatgatcgccagccattcagcatccatggagagtgctgcaagtaggacaatgataatttgatgtattgaatcttgccttctgaagaagaaacaatgccaatgggtggctacaaaattgaccacgaggaagaggactcagggaagcagctctaatgaatgctgccatgacaaggataaatccaaatccctgactttatctccactccctgtttcatctcacataccagaaagatttccaggggctttattttcatctctaagatgagaagggcaattgatcggggtgggagggcttcctcgctgccagagaaaaatagccttatttcttaataagcttcttaaggatgagatgcctgttgtcagtgctctgagtacaatgtgtgacatgtcaggagttcgtggagttaggaaagaagagtcatttcagtctgtggctgggagggggctagtgggacaagataaaactctggaaaacaactgcagagagatgctggtagagcaattgccactgccattggcagatgtcacctatcaagaccagctatgctatgagctgtccaccatgaagaagcaaggagatgcgggctaaggagacagcgcagggcaggaggtgaaagttaagcagatctagctcacgtactagttgcatggctctgaacaagttattagcaaatttatcttagcttcattccttttctgtaaaatagggctgatgatacaaacttcctaatagtgttgtttagataaatgaagccagtacccttgaagcacttacacaggtccagatacatggtaagtaaatgtgagttgttaaggttatgagtatttggaataatatcagcgggcattatatcacagtggctaacttcacagactctagtgtctctcagattctgtgtctttcaaatggagacacagcatctccatctgaagctgttgtgaggattgagtttgtataggtaactaaagagtgctcatgagaatgcctggcccaaggcaattgctgaagcgttagcttttagagtaagtttagtactagcctgagtactatcagtactaaaggatgatgtaagcatgggtcgtacctcttgaatgtgatgacaaatgatgcccttcagcagagattctgggggtagagaacaggggtgtgtatatcggggtgtatcctgaagaacatggattgtggcagcagaggtgacagagggggatttggttggtcatcttcatttggaaggtaaaggagaggaagaggtaacctggtgttatttctggggagcttagggtttttcccctcccagggtgactctgtgcctctgaaatactggctttgactcaccaggcatcctatcccatctgagagccatctgtttcttgcatttctagtttcatcactgagatcacagggtttaaaataagggtcaaaacctcctccagccacagggctgcaggtcaccctggaggaatgggctcttgcagggaagggccccagagctgggctgactgagctgccaccagcagaggaagaaacaggctgcactgtgataattgagcttctctgttggctctgtgggttgtcagtgccatgggatttagccttttcacagtactcccttgagaagatcgcagaaaaggggagacaatgatacagcaaaagcatttggaataattggccctcttctcactacaccacaagctgaggttgagagagaaaaggctcaaaaagaaaagatgctgtttggagagagacaaccgtggagaacagtaagggctaacaaggagcttcgaccttcaagggtaatgctgtgtggtttcctgtcccgcgcttgtgataggcagcctggcacacttcctctgcccagcaaaccctgatgcctcctccgtccccacccacacatactacctcctctcctctctgtgagcaaagtatgcttatttcatagagatacaaattatttgtaccagaacaaaagcaattaccgtttatgaaaaaccttctcacttctttgcaattggctaccatgactctgtctcttttaactgaaagtctgatgctgccattctttgagcaaactgctctcccagccctcctctgtggcccttggtccagccaacaccctgaggacagattcttcactaatccctttcggataatccctctcacctccaatggttgcaatgggcatgcaatcttgcatgggagacagtcagccagtgtagtgacaggtgcccacagctacttctttatcatattgtgacaaagcagggatgggctgaaagaagctgattgagaaattgatttttaccctgtcttgacttccacaggccctggagtttctgtactctcctctttctccttcaaggagcctgttgctataggaacctggcaggttgatttaattgtctctattgggatgcagacacctttaggcttttcccatgctgcagaagagccagacaaaagctttttctggtcatctgggatcttgatgatgctgccaagaggcatactcagtgtctctactcattgagcttacagggctattcccctttctcagaagccatgtgaccagcttgagaaagtgccaccaacacagcagcatcataaggcatgtagaggcactcatatttttttaaaaaaatcaaaccaagaggacaagggtaatatagaaaatggttaaaggtataaaaatgtgtaaagtcaatttatatcaaatatttattgagcaccgatggtaaggttctgggtcataatctttaatattcagaacagaatttgaaacctctcccaattgtggcagaagtttaactgtgtgtataagagtccagctttctccatccatttgaactggctttgggaagaacctgggtagcagactttagggacactgatgatgccacgatcacccaagtgttgagactgagaaggcttcaccgtgccttctggtttaccagcctacttattgttcacccctttcaaagcccaaagcaagttggactaaatggcttacaaatttcttctcttctagaatggtgcagataacagagttcctaactttttaaatgtatatactttattttcaaagaactctcactttctacccttacttccttgttttttttttttttttttttgcgggaggcagtgaacaggaagagatataataataagaaacttgtatgcctacttcctaagtaagcagatgttctactgaaagaggaaggggaagtttggagtcaaatagaaaacaatggaggggactcttcactctattaaggaaagtataatatagtaattttggcaaataaaattgaagtagtaatgatccttctccatcatcaaatttatcattagtcaaatatggtgaattctcaattatctaccactggggcatgactgtgtgcccaaagtccaggaaaacctcaaaattccatctcttatcatagtctgttcccattccattcccatcacaatatcatctcattggagttgctaacagactgtatataaaacgcacttcggatttacttctctctatctgcccggtctctggttgggatttaacaaatgtctgaaaggcagctggcaggaaagatttgggtaatacagtgactgaaccatcagctcccagataactgggtgtgggctactgagttgatatacacagcagaacacttttaatttgagtcatactgatcaagcataaagaagaccaatgcttttgccattaataaccctcctggtttaaaggaggatgaaatattgacagagaagcaagtttgccaaatggaatagctgtaaatgttttccagggaagtttatcaactggcatcatcacttgattgagtaggtcttgccaagatgaacacagagatgtgaacagaccgatggggggactgggattggggggtggcaatgggggaagtgaaggaagctgggtttcttgataggaaaatgctttcggacttggagcaaggtaccagggtgggcagggaggccacgtgcagattaaaaggcaagccagatggagagaagttccccccaaattacccaaccccacacccaagaacaccaaaacaaactctaaggaatctagcgatagcagcagcacagcctcattgcgctgagcaatttagaaagtggaagaaggaaggaagagaagaaggaagggaaaaggagagggaaaggggagggggggaaaagcaaaacaaaataaataaaaccacaaacagaacaatataaataaaaataaacaaaccaataacagaataaaatttgtaactcctttttttttaatttcacaaaagttttcacaaggacaacgttatagaagaaaacccccagcagtggctaggtcatgcagaaccattaattgtcataccttggcccattctattcatccttgttgcactttagagagagaagtaagctatgtgagttttacaatgcttttaaactgtcatatttcctgttgagcactttaactggcacattcttatagttataaatgttctgagggcgtaactttataacctcctttgcaaagaatgcatgaagagctcttcatgatccaatactaggggatacatatatatagttatatatatagttatatatatataattatatagttatatatatataattatatatagtttatataaagagatagttatacataatataaatcaatatatagagggacaaaaataatttgaaaaaattcttccactcatagggcttgataatttacatgtatacaattattccccaccacaatactggtttgaatactacgctgcccctgtctttggtgtgggggagggtggaggttctgactgagcctcaccatttgtcagtaaaagtgcttgtcaattcacacagcaagcaaatatccaaaactatcatgcttgaggggacgggggatccaaaatctaaatccaaaacattcaccataaaaacacctttttagagatggtacagctgtgacatgttttcctcctcccttttacccctattctattcgatggaattctttgaagtaaaacttttcaaatatgtatataccagcctagtccatccataagggaaattggttatggtgaattggccagtttttaagaaataccgcactgcctaaagcatgatttgcatgcacaaagcatctgacaactatatgttgaaaaaagggtatttttctacctctcctctcatgcttactaagtgttaaaaaagaaagaaaacaaaagaagaaaaaaataactataccaaaatgtgtttggctcactgttgcactcttcttatcccacgtctcataatgacaaggagcagctctctattgccgtcattaccctgcctaaattggctacattaaagaaagtgatgatgaggaattccttcccaccagctttctgcattgggacagccagcaccgcacagctgtgccaacagttgaaggtggtggctggcttttgtctttgttgagtcaactgtggctgatcctcctacattctaatttatttagcatgtcggctcctagaaaagcatgatctgcagctgggtttgtcttcctctcactctaccattgccccagcccttcctcctacctggcattggggccctaactaatcaaacaaaggggagtaaaaagatcccctgagaatgcatggaaaaatacttgctctttcctgagcattatttattctgtacataaggtaagtaattcaccttttaaaagatgtaaaagtcccaggaaggcagtttttaatgacttacatctgatatttatgatacatatggcttttcatcccaaatgtcaaaagtgaaagaaaaaaaatagctattcatatggcaacataaggagacagaataacaatttaatatgcaatcaaacctcttttcacttaaactaaatgactagaatttgatacatccatgattggaatactattctctcctccatattaaggtgagaaatgttcataagaactcccagagggaactggctctgggacaaaaggccttggtgagtaactaaaaaaatcactgatgttctcttgcaacaagcaggtccttcataatcatctacacaaatcgtgaaagcttttcaaatgcttcgcaatacttcggcccagagactggaaacaatcaatatgttttcattgctgtttggttgcttgtttcaaataaacatgtgctaacttattgtgtgtataaaaaaagaaagaaaggaaaacaacaacaacaacaaaatcaaaacccaaagcaccctgataatcctgataaatcagaatcaacttttcttttacattaaataaacttgctctgcctaactgacgttgatcacaagtgctcccttctaatctgtgaactcgttcctgcagtgagctatttatgtctggagcatgcctttgggttatttttcccccagaatcataaataacttttggtccgtctgcttatttgctgttgtgctcaagggttttatggtggtgaaataaaaatgacaaccacatgcacactatcatacatatgcaaatatgtgtaaaaaaaaagggggggactacaggggaaaacagggaaagttactttgttggaaacaccaactggggaaatgagtggcagatacagtttcacacagtggcggtggatacacatatcaaagccgctcttcctgcacgtacttctgtttgtcccgggactccctggacttgggccggttctgtcggtttgctgtggatgggatggagtgaacagaggagctcttcttgctggaggactgcgacgagtgggaggaatgggacaggctggcccgggactggccggcattgtggtcaaactgcattaagcagaagatcaggtccgtcggcacgagctcaaactcatagggcgggttggtgatgacatacctggacagggaaagcagagatgtcacctcctgagagtaactgagtaaagaattcaactctctctgaaccaaaagcaatggcctggttactcaggactttcagaggatctggaagatgcactcctagctggtctgaggccttaaacattctttttcttgttaaatggaaacttcctctgtttaactcaataaaggaggccagccaggagcccaggcagagatgtggaattagagccagtaatggaagaaccaaacttcgcttctcgtggtctacatgtacctttctatacaaggtcaaagtcactttcaagtagcccaaccgcaagaggtttcatgaagtgtgatgcaactttcatttcataattttcggacaatcccagatatacatcacaagatctttgtttaccatgacagagtgtctccttagactattctcgctctttaccttttaaaatctactttggtgagagaatttggaatttggaattcaccacatggaagaatctaagaaacctgcctacttatcagcactactttgttgttcttcacaattagttggagctttctttggtcaacagcagatgtgactaagaaaatcacgctgtttcacttagagcagtggtcaccaagtgtggtccttaggccacacaggtcagcatcacctaggaactaggaaatgcaagttcttaagcaatcccacccagacctactgaattggaagtgctgaggatggggtccagcaatctgtggttgaacaagctctgcaggtgagtctcatgatggctaaattttgagaacccactggtctatagcaattgttctcaattctggctatacactataatccctggttattatatataaaatgtttacataatttaaaatatatatatgatgttttcttccttccagaccagttaagttagagtaatcagaatattttttaaaagctccccaggtgattctactatgcaagcagggatgagaaacgcttgtctctgcagcactgttgcctagggtatattatgcaaactcactgatcttggtaattctaggatgtacttttaatttttgcctgctatgaatttattttaatgcatatgagaaaaatataattggcacatctaaactgttatttctctgcttaaggtgataatatataattgtctcaaaaataaatatataaaagttaaaaagcgagtcaatttaaaatatgtgaagtaaaaatatgggattctgagatatggcagaagaaccacttatcttagggcggggtgtggtggctcacacctgtaagcccagcactttgggaggccgaggtgggtggatcacttgaggtcaggagttcgagaccagcctggccaacaagccttctctctactaaaaacacaaaaattggctgggtgtggtggtgtgtgcctataatcccagctactcaggaggctaaggcaagagaatcactggaacccaggaggcagaggttgcagtgagccaagattgtgccactgcactccagcctgggcaacagagcaacactccatctcaaaaaacaaacaaacaaaaaacaaaaaaacaaaaaaacttatcttaaacactagcaatgtaaaatatctctatattaggtaccaacagatgttatcctagtagctagagtttgggagagatgtttgtgtattcagacttttgtaattaggtgatggaattattctattaatacaaaacttgaattcttaccaaaatgtctttacatctactattagtaattatagaaaaatgcttcccatcacctccaaactcagtgttggatttaatatgggcagagtaatttgcatgttgaggagatgtatacagacctttgcctttacagtaggggacaggaaaggatattaatatttctgtgattaggtgggagggcagagttgaaaccaatactcacctctttgtgcactgactgggggtgctgaggtgagcatctctcagccggtaaattccaaaacaaagcatattatatgttttcagagctttgcagaacagatcaccataacaaccaccatcctgggagacagcaaaagaacagagagaaacatcctttttatttgcctgaaaatcaagggacagcagggaaacgggtcttttcatcaaagcttgttttggtgtctcccaagttggagggtccatgtgccaagggacggcagtggaagaagtcaacatgtttaacagactacacccaatatgtgtgatttttagggatcaggtaacaatggggttttcctctggtgtctctccagttttccacctgtcgcagtggggtttgaaagctctaaggagattatgcttctccctcactttaagtcaaagtgtaaagcttgatggtctcagatgtatgctcagctgaggagatgaacccttctctgcaaaatggtgattatgttcagtcccagctcagctgtaaccgctgtgataggctcgtgttgtcaaaactgtctgagtgataatgaaaaccaccgcaaggaggaggaccccaccaggtcctatggtgacagactctttcaggaggtaaggaccctgtgaaaagcacaatttacagacctcagagatggcaagggtgcaagagaatgtgtttccctaggagccaggggtctgcaggctgaataactaggattcgcagttctgatcagttcacagccaccttcccggggtctggggcctgatgcagaaagtgaaagcaaatgcatccacttggaaatgctggcttcagcggccaggtggcttcaggtagatgttacctgtattatatgaagggcactgggcactgcgggatggcttcactgggtataaaatgactgtctttgtccttccaatcattggaattctcatattggtctcataccaaagaacactgatgggaccaaatcttaccattatctaaagtctttatcctaatcaagtgcatcaataagtaaatgataggtataaagagccactagctatgaaaattccctttcaaaaaaagcctagtctaacataggtcccagtccatgatcaaactaaaatatggggaaagtatgcagcactgtttcagaaaaaacagagacagaccctttccttggctccttttccactatttagtctttctgggcgacaccattgtttgtgtaacaggtttatcagtttctgtgacttatggctgcatctcttaaatgcatctgtggggttgggctgggaataagggcaaagacagcacacttctgtcacagtgcctacactaggcagatacatggaatcagaagggagacgctggccacttccgtcacagggaggacatgagggaacgtgactgggtccactctcagaaattacaaggtctaggttttgatttacaggcattaaaggatccacataagattcggtttgtttggccggtggttctggatacatctgactactgactaccctggtgctttgaaaaccaccagtgcctgggtcctattcacatataaaaactaagaaacctgcaggctgaggctggccacctccatgtgctattaatgtatagttgggttgagtatccctaagctacgctaagagcctgtggaaatatttcccaaccttggctgcatgctggcatcacctgctgcttctcaccttgtgcagaggatacgtgaagagaacaccaaggagggagaaagcccactggctctgaagccaggatgccttggtgcaaattcccaataggtctagtgctcattctctctgggcctcagttgacttagaaggtgtgatactagaacttatatcaaagggttgctatgaagattaaaatgaatgactatgcatagagcaaagtgtctgatccagagtaaactataaataaatatcacctcttacagttatctacaataggaaggagaaaagccagatgcctagcttgtcacatctgataccacgttcttcaggatcaagcttttcccaaacagcaagctcaggtgacctcggtgctgtggactcacccctaagtccgcaaatggcccatcgagcagagctaactgggccacgcggcagcggtccctattggccagtgtctgcggggtgctgtagccacctctaagggcgttttcctcagcaatcagagcctccagctccggcgtggctcctccggtcaccagggtccgtatcagggtgaggatattgtcattgaagtacgtctggggaaggagagaaagtgagggaaaagtcctttaagcaaacaccctaaagtcatgacagccgacatccaaattacaacttttcttggtatctcctgtttaaagttctggcctgtctcttcaaataatttcatgtggggagtgaaaagacagcagcctccaattattccgttattttctctcttgcttggctctgctacgacagcctgacttaaaaaacccagttcaggggattttttagtaaagggctcaaatctgaataattagtgtttgccataattggttttagtagggatacaaatattgcctccccctcctaaagtctacgtgactactatgagattctggacacgtgtaataaaatgcagcctgccccagctactaacccaagcagcattgtctctgaggccctgtcatccatgtgccaggaagcttcctccccacgacaacggcaaaacctttcattaatgccacacgcttaacgatttaccacatgcgttgataactgtctaactcagaaatctcgatcaattaaatatgccggataaatttatgaaaaggtgaatgtcctggtaagtgtactttggcttttgttttctaaaataacctcagtagtctgaggcaaatatcacttattaaagaagtttccctctaagtgtacatttgtgtcacatctgaaacataacagatctgtcaggaacaaaagaatgggagtttaaaaaaaattaataggatgtcaaataaaggagctttaaaaggtatttgtcaccagcctaatttgagaaattctcaggtaagggtgtgcattccattttcctatgtaagtagaaatcaagcaggctaaaaaactcaaatcaaagtttgcctgtggcttttgaggatgcactttggaaagaggtaaggaaagatgcaattgcacctcagcagcttcttagagagtttagctggcaaggcatagtagggaacaaaccaagtaagggtgagctcaagttcccatcccaggtttgctaactagttctatgtcttggaggttgcctagtcattctggactttgatttttctcgtctgtaaaataacagtggtcattaaaaccaaatttatattcacataattccatgaggacttctgaattaagatgatagttactagcggggctggattcacaatcctcattgaaatacttacaaaaacacccattgtgatacaaaattccaactgcaaaagaatttaggaatgttatccatagcctgccagaccctaaaggaaatttatgctcagagttaagatatgcccttaggcacagaagcagaaaaaggatacttaaagtaggatatgtttctggagaggttatgggatccagggatccagagctgggctgaggggtttaatgctgacttcacctctcagaagctgtgtgaccttggaaagttatttaacatttttgtgcctccgtttcatgatctgtaaaatgtaataatagaaggctgtggggctctatgacctacccatgaagcacttagaaacatgcttggtgcacaggaagcactgataaacattttggcctcatatcagagacatgaggcctttgccaagtagaggaacagtcagctccattctcaactttcctttgaatttttaatcttctttgttttcttggaggcgtggggaactcagggctttaaaaaccaagcaagggattttaaactcgatgtggtagaaaatgggaggtcagccaagcatggtgcacacctgtaatcccagaactttggtaggccaaggtgggaggatcatttgaggtcaggagtgaggtcaggagttgggaccaggctggccaacgtggtgaatcctagtctctactaaaaataaaaaaattagctaggcatggtggcgggcacctgtaatcccagatcctcgggaggctgaggccagagaattacttgaacccgggcggcagatgttgcagtaatctgagatcatgccactgcaccccagcctgggtgacagagtgagattctgtctcagaaaaataatgaataaaatacttagaaataaatatattgaaggaggaacaagactggtatactgcaaactacaaaatattactgaaagaaattaaagaagacctaaataaatggacagacatcccatgttcctggattagaagacttgatttattaagatggaatactaccttaatttccagattttatgtaatacctatcaaaatcacaaagtccatttttttgtaaaaatggaaaaattgactctaaaactgcaacagacccaaaatagccaaagcaatcttatagccttataaaagaaagacgaagttggaagtttcatacttcccagtttcaaaacatactacaagactatagtaatcaagatagtaatggcataggatagacctatagaccaatggaaaataattgaaaatccagaaataaactcattcagttatgatctattaattttcagtgagtgtgccaagaccattcaatggagaagttaatatagtcttttaaacaaatggcatagcaacaactgggtatccacaggcagaagaataaagtgggacctatacctcacactatatgcaaaaattaacacaaaaggggtcaaagatctaaatgtaaaagctaaaactgcaaaatgcttagaagaaaatataggagtaagtctttatgacctttgatttggcaatagtttcttggacatgacacaaaaagcataaactacaagaagaacagattaaattggacttcataaaaatttaaaaaatatttgttctttgaaggacactatccaaaaagtgaaaaaaacaacctacaaaatgagagagcatgtttgcaaatcatatgtctgataagggtctaatattcagtattaaaaagccttttataactcaaccaaaaaagacaacccaattttttaaacgggcagaagacttaaacatttctccaaaaagatataaaagtggttaataaacttatgcaaagaggctcaacagctctagtcatcagagaaatgcaaatcaaaaccacaatgagatattttacacctactagaatagctgtaataaaaaagactgatgataataacaagaattggtaagaataaggagaaactggaactctcacacactgctggtgggaatgtaaagtggtgcagttaagggaggagaccacccctcacattgtgttatgcccaatttctgcctccaaagaaagaaaaagtaaacattaaaaggcagaaatgaaacccacaagcagatagcccggtgccacaccctgggcctggtagttaaagactgacccgcacttaatcggttatgttatctatagattacagacattgtatagaaaagcactgtgaaaatccctatccttttttgttccaatctaattaccggtgcatgccgcccctagtcacgtaccccctgcttgctcaatcgatcacaaccctctcacacgcacccccttagagttgtgagcccttaaaagggacaggaattgctcacttgggatactcggctcttgagacaggagtcttgccaatgccgctggccgaataaacctcttccttctttaactcggtgtctgaggagttttgtctgcagctcgtcctgctacacagtcactttggaaaacagctaggcagttcctcatatgtttgaacattgtgttgctatatgacccagaaattccactcttacagtatatacccaagataaataaaaatatatgtccatatgaaaacgtgtacacagatgtttatagcagcattattggtaatacccaaaaggtgaaaataacccaaatttccattagctaatgaatgcatgcacaaaatgtattatatccgtgcaatgagtattatttggccgtaaaaaagagtgatgcaatgatacatgctacaacatggatgaaccttgaacacattgtactgagagtctatcagacaaaccacctctgataattcaatgtacattcgtttctatttccttaagtgtcggccagtctgagaaataaagggaaagagtacaaaagggagaaattttaaagctgggtgtctgggggagacatcacatgtcggcgggttccatgatgccccctgagccgcaaaaccagcaagtttttattagcaattttcaaaggggagggagtgtatgaatagggtgtgggtcacagagatcacatgcttcaagggcaacaaaaggtcacaaggcaaaaggtcagggcgagatcacaaggtcagggcaaaactagaattattaaggaacttccatgtcctgctgtgcaggcgttgtcattgataatcatcttaacagggttcaagagcagagaaccggtctgactagaatttgccgggctggaatttcctaatcctagcaagcctgggggcgctgcaggaggccagggagtgtttcatcccttatctgcaactccataaggcagacacccccagagcagccattttagaggctcctcctgggaatgcattcttttcccagggttgttaattattaatattccttactggggaaagaattcagcaatatttctcttacctgttttcagtaataagagaaacatggctctgttccacccagcccacaggcagccagactttaaggttatctcccttgttccctgaaaattgctgttatcctgttcttaaggtgcccagatttcatattgttcaaacacacatgctttagaaaaaatttgtgcagttaacggaatcatcacagggtcctgaggcgacatacatcctcagcttacaaagatgatgggattaagagattaaagacagacataggaaattattaagagtactgattggggaagtgataaatgtccatgaaatcttcataatttatgttcttctgccaaggcttcagccagtccctccgtttggggtctctgacttcctgcaacaagagtctatttatataaaatatccagaaaaggcatgtctacagaaataatgagtagatcagtggtggcttagggttggtgggttgatgggtggagttgtaggggagggtaggataactaaaatacaaagtttctttttgatgccatgaacatgttctaaaattgactgtagtgatggctgtacatgtctgtgaatatgctaaaaaaaaaaccactgaatcgtacactttaaatggatgagttgtatagtatgttgtgtctcatttttttaaaataaatagttaaaagacaactaaatttgcactggccaactttttaatctaaggagccatgagtattagaggtgaaaattacacacacacacacacacacacacacacacacacacaattagtgatacggaagtaaaaccaggaagttctaagctaaatagagaaagatatagggatttttgtttgtttgtttaataagagtgctggttgatattgagaaaaagacaacaaaggtcaagtgataaacagtaagtatttacaaatcaaagttgtaaacaaaatgcaagcgtgtaaaacaagcaaacaaacaaataaaaataacctgtcctgagctgggaaatgaatctaggatgcagatcaaaagcattcagcaagttaatgtggccaactcctagacctgtactcggtgaatatttgaattcaaaatattaaatggagaataaaaatgacctaaaacaatgctgtaagaaatacaagtataaaataaggctaggctgaagcttctctagaaaatgtaagaggaatgtcaaaggaattttgacaggacacatttgttccaaaaattctacatatagttaaattgccaataatttgtgaaggcaactgaaatattttttgactctttgcgtacataagcatttattgatttaatttttttaaatacttagaaacaaaaattagcttctttaaagataattttaaacccttagtaactaaaatatgagcaaatttggtttactgttaaaatatatttaaaacagaattgtaaaagattattgtatatattattacaaaatggaatgcaaatgtcaaaactaattattaaaaaaatgacaaaactagctattaatatagtattgctaaaattatgttttaaagttagaaaaatgagatgagatagagatgatgatggaaataaaggcatgaaaattgcctgatcttatacaaggaggaatcaagaactactaaatttttctagacaataatacttagaaaatacatctatagaatggctggtaacaactaactagagttaaaaatagaatggaaagtttacactacagaaaataagcatacaaaatatagtccacataccaaaagatggatcataaaacatataattatgatagaagcatgtaaaaaacataatgcaagactatagcatcttatgttatataactaaacataaatgagctaaatgatcctataaaatggcaaagattttcagacttgttcaaatgccaaaatcaaactctgatatctttaaaagagaaaaagggaagaaaaaaagtatagcttcaaagaaaaattttaaactattatgttagataagttaattttatattcatagttgacacaataaagctataattttttatggacaaatattataactgaaatatagaaagcaaaactaattagaattacactagaataaatctggactaagggtaatacgtgaaatattcccactatcactgtttttagcttttacaggccaaatagatcaaaagataagaaaattgaggatataatcaggttgatttagtgtatttttactaaactttgtaacaacgattacaaaaaaaaaaatcaatggccaaaaccatcaaatctcaatacatataacaaagtataagctgtataacctacattttaaaaattaaatacaatgtaatagaggcaaaagtaaatattccagaacatcaaaaaaattttgttaagtatcctataactactaggtcaagatggaaatcaaacttagaatatgaaatattttaaaattaaagaatatttgagaatgacatataaaaatatcatgtcttgaggccaatgctatagagacaaattcagagcctttaatgctattattaaatacaacagaattataataagtaaaattaagtattaaaagaattctttttttaaaaaaaagcaggatgaaaagtgtcagttaatgaattagcaagaggatatttagtgaattgttaaattcaagaaataattccttgaaaaaataaacttatgacaatataactgaaaaaacacaaataaaattagaaataaggagaataaaatgtcagatacataggagaattaacagtattattccagatactctctttaataccaatcactggacgtgaataagaatcgctactgtttttaggcaaaaagcaaagtagtaatcatctatgaagagacagaggagagtattaggaaaaaaggaaaattccatgttccttaacatgtaaataggccatttaatgtcattttttccagtaaaattgttgtttgacatatgtgtaattgcagatttgaattggactttttaaaacttgataaaattatgctaaatttcccctggaaagagttgtacaaaattgtcctctcatgtagtatagtaaattttaaaggtttcctaaccaaatattgtagacaatgtgaaaaattagaagatcaaccagaatggatttatgagaaccatagcttagtagttataagaccttaatacaaaagttggcaaatctggctcttgggccaaatcttgctctgccatccattacttttttaaaataaggttttgttgggacccagccatgtccatttgtttatgtattgtctggggctgctttggtgctaacaaactcagagttaagtagttgtgacagagactatgtggccctcaaaggctgaaaatatttaccatctggctctttacaagacagtttgctgatccattccttagtataacaaggaaagcattgcataccacagggaagggattttactcaatgaatgatttgggggaaactggctctctgataaaaatttttcaacaatatggtaatgattaaacaatggttctttgacatgactcatattgtacagacatgaatattgtgctttcagataatatttaatggcatggtaataattatataatactaaaatgttttttaaaagtaggatccccaaaacaccatgaatcacaattcatgttaaaaatgcatacctgcaaaactattggctagggaaattaactttttctgtatttaaaatttaattttaagagtacccacttttaaatattgaatctttatggtactgggttttaagttttaatattacttttaattggctttttcatactaatgattccttttaatgttttcaattatcatatgtttataaaatgtagagatcatttttattattaaactttataatgtacactgtttcataatataacaaatcatgcacttattactttttgaattattttttaaatataaatcttcaatgtttaatggaaagttatcagaaaatgatatcctgtttattattatggtcactcatttatttctaccataaagtattacaaaaagtacataatgctctgatttggggacttccagagggaaaaataatgcatacctgaactgatagacgtatttatgtgaaagtaactgtaagtagtacacaaaatttctacttagtagttaattcttggttttagaatttggggtttttttcctataattttattttatatattttctgctgtgaaaatacatttattttaaatttctgtaaaaaagaaagtaaatgttactaaatagttaaaggcaaaaaatgtagccacaaacaacttcacaaaaatatagcaaactgtttaatctcaagatgcttgatagttctcatgttcagcatgcactttttatgcataaaaactgaattcactatataaaatatgtatttacatcattatatacagattaaaaactgatatgcttcaaaactatcataaacacaattaaagggcctcctaggaaaaatgacaatcggcatttgccataatgtatgagatggctcagtatgacgagagtgtggattggtaaaattgtttcttggagatatcatgacaatatgtatcaagaaattttaaaatgtccctatttgttaaaaaaaaaaaaaacccagtacatttgcctcaatataataagttgctacttgttcaaagatttatgtacaataatttttattacaggattaatcattgctataacaaaaattttttaaagctaaatagccaaaaatttagtgataaatcgattctggaacatccacagactggagtctcataaagtcctatggaggctctgcaaatcatgacacctaaggaaataataaaatactctggataaaatattaactgaaaagggaaaaaataaccaacctataaaatgagataattctgtatttatccatccatttagaaggaaagacaccaaaatattaaccatgcttatccttggtgttggaaacataggccatttatattttcttctttatatgttttctttttatttttatatgtttcttctttatatgtcttcttttatatgtttctgtgctttccaaattttcatcaagaagtatgaataactgttctaataaaaacacagtcaattttttttaaacaaagggcactataggttatccattgcaatgataaatctagaaggtcaggctgggaggttattgttttgtcaaatctttgggatttgaccctaacatgttcccacttctgtgttgaaatcagttatacccaaatctttttgatcagtcactgacatttattgagcacctactaatcgttgggccttggtttagcctgaaattgtgtgaaagtcaaagagtgcatgacttttagaattgctcatcaacaggtacaatttcatagtcagtcccagggtttcacaggtgtctgaacaactctgggaccactcatatctctgagcataattgtctgctctctgagctggcactgcatcccagatgatggctctccttgatttttccatgcaggcatccaggagcagagctgtggggcagcagaatctgtgatgacagagaatgatgatgtatttttgccagcagatgcttttgctcctgttttgataccccaatattcggatgcagaaaaggactctgagcattgctgacgggtgtgctctgcacacctatctcttcaggatctgaataatttggtggaaagacaatgccttttctggaaaagggtgtcaggtcagtcatattggaggatgcaaatttccttatgtgatgggagtgagggttggggtagggcacttcacggagcattcagcagtctgcaattaagcatcactccaaggctttctgcataggtgatggctgtttctgcatcatggggcaaaccaggtgctagaacttcaaatgccaattaccaaaggcgcttcctgcggaggaaacctctctacaactcacctgacccagaaggcacacatttttttctgggttaacataaatgctaaaattgaagaaatgaaacattctaaaggcaggatcatgtaggtgagatcctttgcctcctaagcttttgtcctgccagtcttttctgtgccttaccatgatacctgtgctagaagtcttctgggaagctcttgtatagaacctccaactctggcagggttagtcttcagggatgcttcaggcagagaccttctcaatatctatccttgcgtcacatgggcattgagtataagacagctgagttagggtcctgttcagagcctgggatcagggaacccgcatagtctaaggaatacaggagtccctcttcccactgccaaggacaagtttgcaaacctgactagcgaagcccttcttctgattaaggcaacgtggccccctggttatgagtacagatttccaaatccaattagtgtggcttttaatacctgctttgctatccaataggcacaacaatgaaaaagttgcctaacttttctctgccttgaattcctcatccatataacagagatgaaaaaacaaaacaaaacaaaaatttatagattagagttaaatgagaggatttgtgaaacttctgatagacaaagcatactcaaaaaatgggagtttataaaaagaaccatcaactagcaatgcaaccaatttagacaattccctctccgggtgtctcggcgttctgattctaatctctgagagctggctcagaacacaagggtggcccgcttggcctctaaagtttgatgattctcaggtcctgtaaaaggacactgaggaaaccatgaaatgccaggggagggaccaaggcactgtaacagggaaacctgagcccacagcgccatctagcccgcttggcccacgccccgctgtgcctgcaagtgtaacccgcccaagcatcctcctctttttatttttttaaagtataattaccggagcttatgtttcacagttaatgctgtcaagccttttaaactaattggtcttttatagaaaatttaactgaaaattaacacatcttttaataacattgccttaactttaatggctctctgcctttcgtttataattgctctaaaattgtcattttccatgtcatagctgccattttttatatttgctagttttcatggtgtagatttttatttttagtatttttctttcgtgagggatgaaaatgattggatttttttttccctaccccaggcctgcctggcctgatgtgacagcagtggtctgtcctgagtctagcaggacatacctccatgtacccgactgacaccactgctagctcctctgcctcgggacggccatgtgccctctgtctccgtgtgagcagttgaaatggaggctcttgagtggagtgtaagaaatagggttatggagcaataaattgtttatgtaactaaaatcacatggcattaggttagcttggactgatagagaactcaggcctctccataacaccaggttcaagggtttggcccttaatgaaagtacaggaaagacagtaaatcatgtgaacccacattccagacggtcacaccctccagtcttactgatataacttcgtttctggcaaacaggccagctctctgatattaaagatgagaacatggaatcatatcttctgggtaccccaactcatctacccactaagctcccaaatattatctaagatgtgtgttcatgaaagagagaaagagagaggataagtgcacacaaacacataaatatatatacatatatgtacatgcatatataccaaaaaaatctgcttctttgtaattacatgtgatcttaagaaatacgtatctgctctgtgaaagatttttatatgcctttgccattctccaattagcagaaagtcataaggagtaacatcattcccatttaacagtagaaaaaatgtgcaagggctgccggtgagccaggaccagaagctacaagtcctaattcatggcccagtttccctcctccaagtcactgcctttgttctgaaaatatgaatgcactggacatgcaaactcctgccctgggcattgtggtgcagtgggcagagcaaagacacacctgccttaactggctcacattgaaatttctctctagctcctgggggatcctgcgcatgggtctctccataggctggcattcacgcttctcagatgtatcgtacactagcaaaaggggcctctgcttttctctgctctttctcttaacactgttataatatgctttttctttatttttccagattaggtaggccctgcaaacctaaagcttcattaaatcttgttttctaaaaaaaaaacgacaacactcccaacttgtgtgcattggaactcattagctcttgtagtagggttcccctttttctcctcagaaggaggtggctcctcactgctccttcaataacgatggttcagtgtgattggtatctgtttaggaaaggtccaaggctcaaggaaaatggacatcatgtgcacaacctcctaactcagaggacaagcaagtgaccggaaggccaaggatgctgtctgaccacagacattgcaatgcagacacataagattagaagcaaaacgcaggaggctggtaaggccaggacagtgggatgaaccaagcagggaagggacatgaatgaagcaggcctggtgggatacaatagagagtagtgtggactgtggctaaagggagcagctgctcagctcaagccaatagctgctttacgggaatctgggactctgccttctgactctaatttaaagaaggcaggaaccccgattttatataaaatcttattttaaaatattggcaacaaattcaatttaaaaataaaaacttgataaatgcagaagttgtctgtggggtagatgtagactgcaatgtgacatttcgagacttctattacagatcttttattagaaacaagatatcaagccaagtactatgccaatatattgtgctatttcttcttctaaaatgagtgcatgaggatggggtgttggacaaaaaaataatcaagggttgcgcttcaggaatcaactcagtgatgagctcactgtcctagccagcgtatccagaaacagtggcattaggaggaagctggtggctttcagaagaaggaggatcctctcgccaagtctgaagtgtctcattccagacttagaacttggccagatgtggtctattgtactcggaatactcagtgtggccagcggccttgccttcttgattgccttcctgtctaccacattccaaccataatggcctccaactgcttcctccaacaaaccaaacccagcttgtcaccactgtgcagctttggcctttatagtgttctctccctctgtttttttcagtgtcagcttcaatgttacctcctaggataattttactctgaccactgagggtaaaacaggtctccacacccattcaagctatttcatgttcttcaaatcaattatccttatgtgacactattcatttattcacttacctatttactcttaacccactagaatgaaagtttaaataacatgaaggcaaggtcttcatccttcttttttacaactgaatccgcagcatggggaatcatgcctggtgtccagtaagtgcccaataaatgtattgattaaaaacactagcaacaataaatacatacagagcttgtcaagtgctaagcaccgctctaatcgctttacaacctttacccatttactcatctctgcaaccctgtgacataggtactattactatcttcattttaaagatgagaaaactgaggcacagggaggttaaggttacccagccagtaaacagcagttctggaatccagatctaagccatctggcgcttgagtccatgtccagtattcacttttcagggtccaagtggagcttaagttggggctggggttgggagaaagtgatagctggatgaaaaagaaatctgaatactcatatgtgagtctcatccctaaaaacagagaggattcctttcacctggtgcgactgtgtgcatcaagatggtatcattctgaaaaatacatttctaagttgtgatcttcttagagacatatatccaaaaacctaattattccctctcatcctgtgtttctgctgttgatttgtgagataaagccacagggccatgtctgtaacatcctgatctgttccaggaatgcctgtgatgaatcaaaatattattcttttaacaaatgaagcagtaagcagcaggagttgggttatgaaggacaatattcagagaatgtttagacacatgattaaatgacaatttggggaggagcgctagaataaggagactgtcaacagctgaagagatttgtgtgtggatgttgtgatgttgcttatgagtgaatgcctgcaatgaaagtttacctctgtctcctgctgtttggaggagtctcactttctcaatttatattcatgacagccctttttgttccttctagttactgccttggcacttgactaatctgttttttcatacattaaggttggggtagaatgcaaagaaatcacaggtaacattttaccaaaacgtctggatccaactagatttgtggactcagaccctactcaagacctcattatgaagcttgttcatcctagacaatgaaaacaagacctggaataatttgataggcattttgattaatgatttgaaaagttaccatcaatgacttacttaaatatgtcttgcttcaacacttaaaccaagagtattcacattattgtccaaaagattcgatagtgtagctaaagtgcctcgcacagttctgggcccttagtaaatgatgctcctgatgataaatacaatgacagttaccagattcctgatacccttttatcctaggctagaatgcagaagacatgctgctcccatactattgcatccaaacatgccttagtcacactatcccaaacatttttgtgtgcatttcaaaggagatgagagatggcttgtttaaaaatttcaaatcaattcactttgaattctcatttgaatttccaagaactgactacctactgatgatatagatgcttgtgcaactcaaatccagatgggcccccacctccaccctgtggctaccatatgcccctttggctgtgttgaaaagaagttctccagtgctcaaaccgattttattccttggaaccagggctggtttcatgggtgttcagcctatgtggttgcacagggctgtactcagacacatctctgttgttttattttattttattttattttttgagacagggtctcattctgtcacccaggctggagtgcagtggcgctatatcatctcacagcaacctccacctcccaggctcaagcgattctcaggcctcagcctcccaagtagctgggattacaggtgcacaccaccacacccagctaatttttttatatttttagtagagacagggttttgccatgttgcccaggctggtctcaaactcctgggctcaagtgatctgcccacctcggccttctaaagtgctgggttacaagcggtagccaccgcacccagccccaagtctcttttgttttaatactctgctgtcaccattttgaaattcttaataattcatgaaaagtgaccttgcaaattatgtagccagtcctgctagaaacatactaaatatctgatatgtagaaacataaacaattttataaatttggaattttaaaaatgttatcagagtattttgtagttctgaaaaaaaaattctactgtaaatagtttaaccagctcttagaacagtcttctgagatctctgtaattaggatcagaactaaaataaaaatttctaatgagatgaattaccaaaatccatttgaaactggatttgcagaatatgaggcctatgactgagaatatggtcttcttaggaacacatcttgaggcttctatcattccttctggcttgctcaaggagtttgcccaaactgagcccaacatcactagcaggtagaaaggttagccttggtatcatcaggccataagaaagatcatgagccccaggaaaccaagggagcccttttccaaggaccattttatctccttgttggcttggaaagccatggcatggcatgaagcccagttaaccttaattcagacgaatgtcatttcacagtcatttttaaatccaaaattctgatttttaaataagatatgcttgcagttggacaatgttcaggcatacagaataacccaaattagtcttaaaaagctttatgttttttctttcctcaaatagaggtccttctgggattagcattatttaatgaatagatgagaccagtacataattagcatatcagttgtttagcacattcaggagaataactttcagcactttaagaaatatacgtgtgtaaaaactctgagttctgtttatggttttaatgtgttcagaaaagctctttatcatggattctccaaaggtcaagtttttgttcagcctatgtctgcattttcacaaattgagaatttgagaactccaaaatgaagaagattttctacataataaataaagatgctcagtgggaagacttcataatacccaggttatgactcattctaaatgcctacttttgccttttgcagtgaaagatggctccataatgttgggacccattttttaatcgttatttgtttttcggttgcaaaagtgaaaaaacaaatgcctgattgctagatgcacatcaagttataaaagaaaccaaagctgtgtttgatccctgggccagcccactgtcctctctctgccactaactcctccctccttccagccaggccttgcctccatgcctggttctctcccaaggacttcagtctcagtgacaggcctggcagtcatctttgacccactgtcctctccaccttctgctcatgctcaatcttttcccaagtcctattaattgtactgcccaataccactgagctccatccacctccctcgatcccaacaccagctctatcctagtccaagccatgacagcctcttactcagacctcctgccgccatcttgtacctctgaatcatcctccctacaacagccaaggcaatccccttaaagcatgaacctgattatgtcactctccaactaaaatccttcagtgcctcttcattattcttaagaaaaagtccaaaaccatgaaaatgtgtttcaaggttctgcaggtctaaccttggccatcctcctgcacccttgtctccccatggtccagcctcacagggtttctttgccttctttgagagcctcaggtcccccccaacaccaggttttgcatttgctttctttcttcttcagagaatgctcttcccccaagatctcccctctttatggctcaaattttagcataaaatgtacaactcccttggggaatttttctgggatccccaaaaccaggtcaagccctcacctatatttccttctagcctgccttgccttccttgcacttgaggaatttataatcaaacatttacttgtgtgatggttttataatgtgggtctccccttctaaggtgtgagcttctaggagtcttgctctccactgtggccccagtgcagcccagggcctcaaaggttggaggtgctctattggcacatcctccacccttgagtgaggaggagggaacaggataactcaccgcgctcatgagtgagtccaggacactgacggcaaatgctgtcccacaggcaaagggctgcgtgaggtacagttctgtatcagggtcatcatcatcgtcttggtccaaaaactgaacattagtatcgttcactagaaaaagcataaaataagaattagctctgaagaccacacacaggcattgaagccagagggagaccaggctactggtttagaaatactgaagtcattgagaaggaaacaaaagcatggaataagctgtagatggatctttgggtaaggggggcagtgggactcaatggactgttcctgtgtcactgtttaagtgtctgagacctggagagcaataagttcaagcaggcttgctccacggcaggccactggaggaccaatagactgtgctggccagtcctttggcatagctttaggatcatgacctaaaaacactttccagtgttttttggtaaccaagtcctttgagagatggacatatttcaatgatgagcagccatgctgggatagtcattttagccacaatgaaaagaaagcagcttattgggagtaaagagcgctggaaggggagcacagcaaaggcagatagcaaggaattcagccacaggcataacccgcagcctacccactgggattggcctgggtagttcccggggtcccaggccctaaatctaggtccacacccaataggccctgtttaatacacaggaaaccccaggtgggatggatgcctggctgtctcctgctgcttgctgacaaggacttgctctgaattttgagttgcatggggacgcccacgttctccctttcccatcctaaacagctcaatcttttatatgcttgcattcaagcagatgcagcattggatgctgtatttcatttccatctgaggattcctcaaggactcctcccgcatgtacgtgcaggctgattagttgtgtcactcagatgtctttaacttattaaaaattaaatgacaaattaatttccattcccatcttggctttggaaattatcagttttgcagagcaagtaataggggaaaagtcggtggggggatgggagaagggggcactcaaaatttctgaaataattattgtgattttaggaagagaacagatgaggtttcctttccctgattcctttctaaatgtatcaacagctaattcttttttctagagtgattgttttaatttttaagcaactttcttgataactcttcttttttaaaaaaaaaaaacttttgtttactgtatgaagcagaataaatgatactagcatgaaaggctaggcatggaattagtattttaaaatgacatcatcttgtttccccagagaaaaattctaatggggaaaatctttgctctgttcttccaaaattggtcacatttgggtccccattgtttaagcagcaattgaattgcaggctagtggtgaaagtccaaaatccaggctctgacaactgggcttcagtccagcctgtgctgccaacttccttgggcaaagcatttcatcattctataccttagtttgtttctgtaaaatgggggagttacagcagctctctcatgaggctgtcaggaggctcatacgaatgggatggtgcccagtaagcctggcccagcatctggatcatgccatgacttgataaataccagctgctgtcatgatctcccttctgacattaaatacctgtccacccattatagcatgaaaatacccagcttccctctgcctctcttggaaacactgaaggtcttgctcaggggtctttcaagaggtagcttttcctcacctcccttcacttgtccaaagggatgttgtaggccactgtttagtctttctgttttgtgaatcagaaaatgtaaactggagaccacatatggaagaatgcagttttagttacttgtaatagccaccaatggtgtgtgtggcaatgctccgaaaagcacagcatctgttacctcttatcaggaagatggggaagggttggtaccagatatggaggtgaagtgactccaagtagggggaggggactcccgattgccagtgagctagacatctggggtcataggaaaagcgctccaagagaccagccagggtccagtgaataccttgtataccgttctgaaatacccagtctcagaaggagagcaagcaatgctactcaaggcctatttcacagaacagtaattatgtgggtgctaagaggtacccacgtaatcaccccaaagcatatgtggtcaaatacaattggaatagtcaggtgaaacagctgtaacacagtcctttcttgtgagactctgaggagcctttgccatgctaacatcaattgagagtctccaagtagatgaaaagtggaatgtgctacacagctttgaaagcttgtgtggccttggtgccctctgtgtctcttaaaattcattatactggcctggcataatgcagaacacatctcagaacatgtagataaataagaagtatttgtgggggatgtgggaggtgaaatggtctgaggagggtggtatagtggctagagaaataggtttcaaggcagaagacaagggtggtgtgagcacctgaaagattctctgaacacaaggaagaaatctggtgtgggacaaaggcttcaggagagtcaatgatgctaatcaaataccagaattgttgccttaggtttggggcaccaagcttttccttttctcgtctactaatgacaaattaagatatcctagttagtcagcggcacgtgaattccaaatagaaaatgaaattcccggcagtgaggattctgaaatgctgctgtaggtttgtgagatggagatgtttggattaattttccaaccagaggcgtggaccacatgagccctgggtctcttattgccctccagttctgaggagagcaatccagaaacctagggcttttaaacaactacactaaacatgaaaaagatacccctcctatggttggaaacagaaaatagtgtgatactccctgacctgagtgaatttgtcctgataaatagctatacctacaataatgcactgctgagtggtggacaatttattccttggtttctagacatctcgcaagcaagattactgtgttgaaagcctgctcccttattttgaaatatatttttgggccaagaaaatggggtgttcatttcatttgtgagtcatgtgaaggcaggtgctcccacctctctatccacccctctgctgagcagcacttttgctgtctctatttagaagatcaatccccagttctgagacttgctgctgatgggtgcccttcatggagttattaaccaagtcacggggaagtggggaagaacctaacaaatgcagtcacgactggaggcctttatcgtccacctgagtccattgtgaatctcccagagaggattctgggctgggattgggggccagagtgcagggctgcacgtgggtggctgctaaccttatcctccgcacccttcttgaaatctgcctttagtaaaaaaagttctcctagggaccaggtgtttttatggcttcagaaccagagcttctgagaaatgccctagtaggggggaaaaaaaaaaaaggcaaataaagtcagaataaagaaaaataaacagctggagggaaagtgccatcttaggtttcttatcttaaaattttgatattctcctttgacttcctctaagagctgtgaagacatgtcattcaaactgacagtatgttggaagaggagtagaagggagaaggcgggagagcggggtgacaaaaaaaagtggggaaaaaaggctcaggccagagaaaatgaattagagcaaatatgctttggaaacaactgccaggtcagatgggtgtgatcaaaggtttactgatgctgtgtggggaaaaaatcattaagaaaggccagaacaagacagtcgattccaaccagagccacaaataaaacacattcaaagcagtgccatggggtagcctttctgttacagccggtgaaataaaaacaagctgatgatagttggaaacaccaacaacagaacaaaaggagatactgatgtgaaggaaaacagtgcttcttacccagttcagttatcattagaatgtgcgtcccactgtttttttcctgattgactgataccaaaggcaacttgcccggtttagctaattggatacagcatttaagggttggggaaagggagtggaggaaagtacagaaaaagaagagagtgagggaataacagaggaaacattctcaagtaaagggaccccggaccacaggtagtttgcatttgtcttgggggaagaggccactctacagttttgcacactcactaatggtaacagggagtgccatggccaggttagaagttagattctattgtccaaccaacatggccctcaaaaccccatcattttgggggccagaatggcatttgctgaaaatggcttttggctgagatattcaactacgatacgttaaatgtcaagttattacacattagcccagggcttctaccttgttcccaaaatgggtttggcttagatccgaggctttgtatatcagtggaggactcagattgtaggagctgtccagacagaatgctcaaaagaggttcttacagtaaaaatcaccagaaagaatccgtgaactaagcctttcctcctttcctctccattcccaattgaatgccccaatcgcaaatccatcatctcatgctcctttgaaaacagtgaccagcatgaaggaaactgtctattcatctcagaagaaagatagatcagttttcccttccggtaatctgccatatttctccccataccttcctcccagccccctcaaaacaaaccccatagcagctacaaagttgaaagggctaagaaataaaccaacctcctcatatcctgtatggtttgaaagacagaacaaaaactccccccaaagctgacattgacccctacctagttcagtgatgatggggatgttgaccccagttgtgatggatggttgacgtaacatcccgtgcactgggctgttatctggagaggatctatccattcctggaggtgtgaaccctagtgggaaggaaacagaggaggaagaaaaatcagagaagtagaaaatttggaaataatcagagtacactatatacatacaaccccaaaaatgtagcttatgcattattcacaggtcaacaattagtattcccgggataaactctgatgattaattctttagaaggacagggtaggaaaccattataaataatcgtaactcacttcatagttccctaaaaaatccagacttcataccaattatttattctgctcatagatcttggctcccatctctttccagggacacaggagaattatcccctgtgcccccttgaagttaggtatggccatgtgacacatgaaatgctctggcccatgaaaagtgagcagagcagtgcatatcactgctggttcaggtattggacagccatctctctcttcccaggccatggcaactgtgagaatacaggttactatggagatgaaggctagacaacagccctggacagttacccagacccacaaagcatactgagtgagtcaagaataaagctgtgttgctttaagccgctgagatttgtttgtttgtttgtttgttgttgttgttaccacaacataacctaacctggcctgactgttaccgtaaaccaatcaattgcttatcctcttgctggtgagtgacttaggcctcagttttcacagagttctggccaatgggaggtgtcaggaaatcttcctggggctttcaggaagtgtttccttgctcttaaaaagaaacacataggaagagattctcttttaatttactgagcacggttttatgtgcctgtagtgccaggaactgaggcaccagctgagggcataactaacttagtgatattggctcaagtgaatgacaggaagagctgtcctggagttcctggggcaagcagcctggagccatcccacctcaggatttctccctatgtgagattttatacacataaacacacacacacacacacacacacacacatacacaaatgtatttatacatatacatacacacaatataataagatgttcacatttttttctttctgtttaagctaaatggagaaggagtttacttgcatctaaatcctcctgactaatgtatatgccacctgcttatggctgatcccttgaacttcccagtgtgccaaacacagaccacataaggtatatgtggacacaggaaaattggaaagcagcctgcttggtctctgattttgcagtttgggcttctttgggtcccaggtccaagccaagtacatacctggatgaggttggaacaactgtaactttcagtttagtgagagtgagaaatatcccggctaggcagaatgtctgcctcgttaaggttttgcatggacacatatcaatattagaaacctatttacttcctacattcatctggtaaaaattaatttttctaacgaagcatacggcagctccacgcaagtggcaagacccagtgcaattacatttagatgataggcaagcattcacactcacttcggtttctccttttttccttcagcggaatgctacatgggcttaccaatgaattagggacttttaggaacaaagtcacttgctaaatttccaaggataaaactccaaatagattattatgtgaccagatatctgactcactttccagcaatgtgacaagattgtgttgagtctggcattttggctaggtgtgagtcaggaatgaaatacgggagctcaataattgcctgttgttttggaggtgcataatgcataaaatgccagagaaatataaaagggttttcttactttctgctctcccgtgtatacatttcttatcactgagtgccatactttcaaaaagaaagacaaagttttacttaatatccattccctgactgcacttaaattgattctttacattaatacactatgaaaagggtaagtcattttgattgacattgtagtgtccatcttttcaaactttcgaatatatgtttttcagccaaccacataaccaaaaacacgcatttttaaatgctagctgttttcttcttctaggatggtgaaggggaaaactaaactgttttcattagaagtttcattcaaaaacatgaaaaactggaagtgacagctgtgcagattcagtggatgtgacgtttttgaatttcttcaacttgacaagtaaacaccttaaatcggtaatgctatatgcataatacatggcctgtattttgacatccatcatcaaatgctgacttgagaaaatacgggtttgtacgtcaaggaatagcacccataaagcagggagaaatgcaggtcacacggtattaggaaaactgtatttcattacagaactcgcaacaagccacggcatccttttattttatcttatttaaagattccattttcagctgtgaaaagactcaattcctttgcatgaaaccttcatttggaaatgacatgcttgcttcataggcttctttcattttgctttcatattccattttccccttcagtcaccaggcctggttccattagcatctgcaactgacaaactatggtaggtgtccaaagacatctctctgttgaaggcccaactctcccctatgcatgactccccaaaaaagtgtgcttttattgctaagaaaacttcatgcctctttttgtttccctacttttctagtcacacatttttaaaagcaaaaggcaacaataacagcaaagttggcttcttctttttccctggtgtagagttatgttaaaggtgaacataatttattagcattgtttctttcttaggggtactgatatgggaaaattatggtcagaaacggcaggattgccccagattccttaaatggctttggagagaagagaaattcaagcaccttccataaaggaatgaggcaatccggcctttgatgccataggatggtgtccaccgcattcctcatagctgcatttgataaaggggcaggtctaaattgtggcccaatctctgaccatcttgctctccttcccattattgcttgcagccatgactatatcatgggtagcacctgaagtctctctacattaaacaacgccctagttctgcatgtgaacacactggcacatggaatatactccagagatctacagctagagaacagtgaaactgggaaacactcccttcattagttaaactaacacttgggaagttaattttagaaacaaccacttattttgccagaaaagatgactaagaatatcaccattagagacatggaatgagaagtcctcaatcaggaaaagactgaagtttaaatcatccacagccaaagctatcaccagatgggctcctgattctttagccatgtacccatagcactttgttgatcatggccatgggaggcaagttttgtgctaaaaatgacttccatatgtttgttggccatttgtatataacatcactaagtatcaggaaaatgcaaatcaaaacacaatgtgataccaccttattcctgcaagaacggccataatcaaaatatcaagaaacagtagatgttggcatggatgcggtgaacagagaacacctctacactgctggcggcaatgtaaactactacagccactatggaaaacagtgtggagattcctcaaagaactaaaagtagatctaccattttatccagcaatcccaccactggttatctacccagaggaaaagaagtcattattcgaaaaagatacttgcacacgaatgtttatagcagcacaattcacaattgcaaaaccatggaactaacccaaatgcccattaatcaatgagaggataaagaaactgtgagatatatatatatatacacacacacatatatatatcacatcacacacacacacacacacacacacacacatatatatgtgagtgaatactacacagccatacaaaggaattaattaacagcatttgcagtgacctggatgagactggagactattattctaagtgatgtaactcaggaatggaaaaccaaacatcatatgttctcactggtatgtgggagctatgctatggagatgcaaaggcataagaatgatacaacagacttcagggacttaggggttaagagtgggagggagacgagggataaaagactacaaatatggggcagtgtatactgcttgggtgaaggatgcaccaaaatctcacagatcaccactaaagaacttactcatgcaaccaaacaccacctgtaccccaataccccaataacttctggaaacaataaaaataaaataaataacttccaaagaccacctgaactccttacactgtaagttttctccccactccaatcttcagtggctggtgtggcaggtttttgttacctattttattcattcagcatgagacataagtgcttgaccaactttatcctatgacagatattctcattctatatactgtataagaactttaggtcagagactggattttcatttctttgaacttcccagattatctacaaaatgcccagcacatagaaaagaaatagaatgaaattgttaacagcatgggctgtaaagtcaggtgtcctggattcaaattctggcacctccacctataagccatggcactataagcattgtgcagactctctcctagtctgcttcttcatcgataaaccacaaatacctcccacataggacaattgtaaggataaaataaaataatgtatttaaaacatttagtacaatatctggtatgaggcaagtgctaaaaaatgctggctaccaatattaatattttattaggtatacaataagtattcgtggatcacttccccttccctatggataaagaactgaagaagtatttagtagattcttaaaaaagatttttcacacacagaaaatcctagaatactaatgagaaggcaatgagcattgtgtgtgtgtgtgtgtgtgtgtgtgtgtgtgtgtgtgtatatatatatatatatatatatatatatatacacacaatattccttatgtgatcataaggaaagaaggactatggctcagacaagatatacacaagtaatggctggaaaagggttccaggacactgtaaacccaagtgcattggaaaatgagaaaggctcaatggcattgtttttatgagactcaaagcaaaggcaagaatactctagacctaaactggttaataattgagaatgaagaagagagggggaaggctgaactagaacccaaagaaaaaaaatagccaacacttactgagtgcttactatgtactgaattttgctcacgtaataacttcggttctcagaaccatcctatgtatatactactatttttcagaggaggaaactgaagcacagagaaggtaagcaacttgccccaggacatacatctaggaattagcagatctcagagtggaacccagataaacaagtcccagtgtctcctctaagccaccacgccatattgcttcttatgtgccaggctgggctaagggttttttcatgggccaccttgtttattcctcataacagtccctgtgtgtttagggactgttgatatttgcattttgtagaagaggaaaataagattcagagcagtggcataactggctcaagcatacccaattggtaagtgtccctgggagccgcagccaggcagtctgacctcagactcctgacacctgcaggctgtgccgcatccctgacttgggtgctggccttctccttctaggtactgtccctggcaggcaagtctgaggcctgagccagtcttactttttattgttttcacttttaaacaatagcagataacaactgggacccattgtagttatgcttaacttgctttggtatggcagcatgcacaactcagtacatataataaatgctttattacagtacttttccatgggggaaacacaaagtactttctaaatcttccctagttaaatccctgagcctttccagggagagagggagatggaaattcttatcaatcatctcccctagaatagatggagaaatgaaggtaagtgcttctcccaccccgatagacttaacataaaggaattggttcaaatggtgggccaaattatcttttattgtgtgcatataaatgatggttagaaatccatatgctacgttaaactagggaaataaattaggccgagtcatctaggtttgctgagacaggtattcaatatgaagttgtaaaagggaaagatcacctttaaaaatgatctataaagacatgttaaaatcaagagaaacatctcatattacatcatctatgagatgaattaaatttcctgttaatgccagggaaaaaaacctcaaaggcaaatgtcagatgaagtgcagatcaataaaaatattttgataagtaaatgcaacaatgctatttaacacatgattggcaactgctgaaacataaattatccaaatttcccattgctgcttatgggaaaattatgcagattagaacttgattaggcttatatcatgagactcaatttggacttttaatctattaagctccaataaatgaggcatctgaatagctcccctgagcaactacggtaatagccacagcagtcatttttgcagtatgtattccaacgaatgcttcagcagctgaagtaaagaaaattccatgtatagaagcacaattgctttctaacttgtaggggaagaaaatccacacacaccaggttgatttgggaaacaggtttttggaaatgactgcaagaaaaatccagccaaaggaaaaacctcagtttaaccttgtaatattttttcacagtagttttcagtggcttcctatgaagctagaatccagagtcaggaaggccaggcagctgaccatgtttactcaataaaaaaaagattatttaccaaggcagcagcttctcctgaaactccccaaaggccaccccaacagggtagaggtagcccccaacaaggtgctggaggtcagtgtcaaggagggaagcggggaaatgcccctgccaatttgtgactcccccgcacaaagcctaatgacagtgcttggaaactgtataaacagataattctgtgactcctgagccaaaccataaggtgtcttttgcctcttcagcaatcattctatgctagaaacacgagagttttcaaaatcctctaatcaattcctccattcttcaaatgaagaaactgaggcttagaatggagaagttattatatccaaggtcacagaaccagttagcagcagaaccaggatagttgatatctgctgttttctgttcctttttaactccttctatgcataagaaacccattccacagtgtttgttgggggtgcagggaagaaactccgcccccaccctggaaacagaagtggcaacatgaagccaggcatcctgacttcacagggccgctgatggtcctgcataatcctggccacatcatcagtttagagatgagtctgtcctcctcaatctagggcctgtccgtattctccccaggacattatgtaaaagatggtaaaggttctgtggttgcaaagtcaggagtctgcaggtgtggggctactggcaagcagttagcccaccatggggtgaatgaaaacagggcaaatgaaccaagaggtggagagaatgagatagagctctgtcattgttcaagttcctgcacacaaatgtgcctaaaaccagagacattccagttatatgtctctgtttttacttaagcctttttgcattggatttcacttgtgccaaaatgtcccaactagtacaacaactgagaaaaatctccattctcttcgcggtgaaatgattcatgctggcctgattttctactgaaacaaatgactgcatcttcatttaaggtttcctgcttgtctccagtgaccagggacaagacctggcttaatactctccttgtttctttctatttacagtaactaacagtgacatttttagcggtacatttttttagagactgtctttgattagcacctttgcaagttgactccacccactgaataaagtgccccatcctttttagagtttacattttgggtccaacccaaaccaaagcaaattaaaccaaccaaacaaacaaaacttctctatagttatttgcccattaagattcgtaaaatatattcagctcttagacaagtctcacacacatgaaacaaatatatttacaggacttgtctctccaagcagacagtctctttccttagaattaacttaaagatgtagtcccagctattcgggaggctgaggcaggaaaatggcctgaacccgggaggcagagcttgcagtgagctgagattgcaccactgcactccagcctgggcaacaaagcgagactccgtctcaaaaaaaaaaaaaaaaagaaaaaaagaattcgcttaaagagcttactgtgtaagatgtttctcagaagggttggttaaggggaggaaggaagaaaaagacaaagctagtaacaactcaaacacacctaaaactacagatttggagagaaacctaatattcacccggtctaatgtctccgtttacccaagagctcatggtatcattgctttctccacaacatctcaacttctcagttttaccttatcttaattcatcttacaatttaaagataaggccagatgcagtggctcatgcctgtaatcccagtactttggaggccaatgtgagtggattgcttgagctcaggagttcaagacaagcctgagcaacatggtgaaacctcgtctctactaaaaacaaacaaacaaacaaacaaacacaaaaaaattagctgggcatggtagggtgtgcctgtattcccagctacttgggaggctgacgtgggaggattgcttgagccagggaggcagaggttgcagtgagccaagattgtgccattgtactccagcctgggtgaaaaggtgagaccctgtctcaaaaaataaaatataatgagacatacttgcttggccagtgtggatcaaattacttataattttacctccactttggcctaagcaattgtacttctaaaaatatgtgtacagccataatttccttacattaaaaatttggctgccagggtcttcattcataggtattaagtaacaacattccactgaaaacaacatgaatgtccaattttagggaaattggttaagtatgcatccactaaaaataatgcagaaaaacatttcacgacagaaaaatggtcatgataaaatgtttgtgaaaaaccacaggtaacatactgacatgtatgatccatttttttgagggtaaaagtatttatatctatggaaataagacaaatatgtcaactttcttatgtctgagcagtaaaattacagggaatgtgcattttctttttggtttctataattgctaaattttctaaaataaacacattttatttatgtaatgaaaaaaattttttaaattataaattgatgttaaagaccctgaaatctcgaaacctcatgtgatctctatgggttgagagcagctgatgaacatgatggatggacacagctggttcatctgtaagggtctgacaggtctttgaacatccacttgatttggcagttaaggagactgaagttctgagatggaagtgatcaggccaaggttacaaagcaaaggggctttaaaagaacagggcccagagagagttttcaggcttcctagttctctgttatttcagcctcccaccatcttgtaagagctactcaatctcagagcagaggccatttacataaagcacacatgggcagtgaagagcccaagaaacccacaatgccccatgcacataggggaagggaggagcagtcagagctggtttccaacacagagggaaagtggcacctgctgatgcccatccctgctcccaccagccttacccacttcagaaacgctgttccccctcttccctcccaacccagctcctgtcgtttctttacctcttccaggacgtctgccttgaataacttctcacatttagttactttatgaagatgttttcctctgcctttttttccatcccctttattcgttattttaaaatgtatgaattattactaaatatatacaaattactacatattaatgtttaaatgttgttaagcatctttaattcttctgttttatcttcatatacccactggacttcccaatttcaatatggcacagcttatgctaacctttctttattgtttttatttattcttaattcctgttctgggaccctccctctttgctgccaccacaagaggacaaaggctgttttgccactaacatgggatctcctctttcatgatggatcacatttccagtaaactagaggcttactatgccagggaaaaggcagatatatacattacaagacaatgatatcaaggggatactaataaaacacacagacatcccccctcatgctgccaagactatataccattttgtttccattacatcaatttttttctccccttttgcaagcattaatcaaagaaacgtgaagagctcattaaagtgatagattgactgaaaatgtaaccactttttcattataaacagtttctttatgttcttggtgctatgggctttgtttttcagcatttgtcatgtagttcaaatgtccttttacatttaaaataccaaatgccaaatgggccccagttgtttggtttagtatgaattgatggccagcacagcagaaaccagaactccaaaatcacgagcaaagtataacatccatatcttaagcacacagaaaattaagtagctgtaaaagatgggtttgccaagtgatccaaggccttgccatgaaattcaggaaagcagaatcgcatcaacaactttcagccagctatctctgaatggttctagagacaagacgcctggcccaagatagcaccaaggttccaaacagttgatggttctttaaaagaaagaatctttttttcttaagtgttgaagtgtttcctgtacatacgtttatgctggcagatgaataggaaactgggatcttggatcttggggtcaggcattcccacatacatacacacacgaatcttcactagatgagggtttgatgctggtttgactctgagcatctctctgtacagcgtggtcaataacttttgaccactacctgaaataagccataccatttgtggtctagaacttgaacactgtggctagactgaatgagtttgggtcctgcctctttctgtttctaatttgtgatctggggcaatttatttaaattttgtgtctcagtttcctcatctgcaaattggaagaggaagatgtcatgaagattgaatgagttaataataataatacagggaaactgcttacaacagcacctggcacagagcatgtacttcatcagtactaacttactattatttatcaacaacagggttgtaagctgacagagaaaacaaaacacatgggttttagtcccaggtcaactcctacctctctgtgagaatgtagaaggattcaatgtcttatccaaactcagttctcccatccataaaatgaggttgtagcaatgtcccaaatccctttagattaccgtgcatcatacataatattgaaaccacgataattctgtgttcagctactcaatattcaggaatgtctgtggagtcattcatggggttgttcttttaaggaagtggaacacaggagccctctcttccagaatcctatcacattgtcggtatcaacaaacatatcaacatttcatacaagagatgcgcaccaaatacattaaaccacaacaaccatgtagcttgcacatcacaactccaggtacacatcatatcctctctcaggagtagcccctaaggcatgatcctccctccaggagccctgcatcctttccatttgctaacagtcaaatcattcatttgctgctatgcgatcacagtcgtggcaatggctgtggcccttggtgtcttcatctgtaaaataggaatgactctaaggccctctcagctttgagatttatgtctctttcatgaccccaaattttaaacgtgatctccaacaaaataagctagcaaagggaatccagaggatctccttacagactccttcacaagctctagtgtacatccagatttttttgattcagttttatacctttgcccagaggataaaacttcacttctcaaaccaaggagaaggaagtactttctccaaagttgctctaatggctgagaaggccataaataaccatttattaaacaaacactatgggctaaaggaagagaaaccaccgcaattaggcccctgaggcctgcaggcacagtacataacgatgggactctcataatccaggcaatatataaccagttgttccattttcttgaagttatcttcataatcaagatgctatctcgggcattgtgggctttaaaactatttttaattttaatttaaagagtaattaaagaaagacaatggatatgcaggataataaagtaagcgattagcagcatgcaaatgacataggcttaatgataatatggttctagtctccaaacagcttgtcgagagaaagccctttctacatgtggttgttcagctaatgtgtctcaacccacaattacaacattgctgacaccattaaccagtgaaacaacaccacttcgcgaaatccttgttgtctcattaaaaaggaaagggtcaggtaatttaccaacgttgtatgtctagttttgttgttggtaattagcaaacattacccagcatagactcccactgggaactggaggaactttgtgaaatattaaagaagaaagcctttatatttcactggaaaattgaaaagaggtgcagtaatattctccctgtcatctttttgcatttaggaaaaggaaaatgcaacttggaactctttaatttcaggagaaatattcaaaatgcattgggaagtcactacccacattaagaccctggatcaccattgtatactggcaaatagaatctgcatccctgtttacaaaagggagttggagatgggaggacgggaaaattgcaaactttatctttattgctcttacttatgttatttgaattaatctccttgaaacagaagaaaggagatataaaattttctttttgaaatgctacgggacttaaataagcaccagaattatttattcagaaaaatacacacacacacacacacacacgaacacgcgcgcgcacacacacacacacacacacgcacatacacacacatatttagacctaaagagagaagaaatatattccagggaagagacttcctgcctccatgcttcctaatagaatcttccccacattggaactcagaccccgcccccaacactggccaatgcttggtgtgttgtcagggagtagaatggtatcttattctttaaatggaacttttggaacataaaacacattccaataaatgtgagcagaaaattatgaattcattaaactactttggtatcttgtgctatatataatatttatattccgactactgtaaaatatgctttaatatctttaggcaactataaggacttaaatatttataaaatggctaaagataaagtatggccctcttattcctacatacagatgatgtaaggcatgcaatcaaagacaataacactctctgcccatttgtcatcttaaaggagccgatcaacgcgccatccctcgtgtgccatctacataagagttgttgccgacacaggcaactccagaggagtttgcgccttaaaaactacctagagtgctatacttcatagaaaacagggctttctgaaaatggagacaaaacaataaatttgcaggcaaaacagctccaagaggggcttcaaagtactgctgtatttatctctgggacatgagggaacaggaagcattttgatttaatatttcataagatagagacaattgcttccttgcatggtatatacttaatgctcacagaaatgagttttttttaaaaaagtttcaatatcttaaatgcaaataaataaataaataaggagacacacctgcataataggaagggcttcctttggaaatatggaatagacccatataatcccaataaagagaaagccaccacgaatttataatcacctaggggcctgttaaaagtagttttatagattaagtgtgaaacctcaaccctgatgttattattatttaccttccttgcttgcctttaggcccatggcctgattgattttcaaaattcttccatttcctatgctgattaggtattcaaagaattgtttgtgcccacctgccttgacctctcaaatggacaccccctggtttattttcccagctcccactagctccctgctgggaaccatgtggaagtttgtgaatttctcatgtatcttgcattttcacaatgcccattatatgctttccaaatctcctagcaatcatgcctaggagaatgatttattctataaataaatttccaagataaatttctatggaaatgtaagctttagtaaatcagctgcctgatacaaggatcagagatggtttccttgagtaagtaaggggctaggctggtgtttctcaacttgggctgcacgttggaatcaccaatgcatgcctgcatcaatgtctaatttaattgctctggagtatggcctgagcatttcaagaatgttaaaagttccccaggtgagtgcaatgtgcagctaaggttgaaaaacagtgggctagttcagaattaaatccacccatttaagggcaactaatctttgacaaggatgtcaagaacacacaataggtaaaggacagtctattcaatgaataatgatgttcagaaaacaatatttacatgcaaaagaataaatctgaacacttctcttacagcatatacaaaaatcaaatggattaaagacttgaatgtaaaatctgaaaccgtaaaactcctaggagaaaaaataggggaaaagctctttgacattggtctgggcgatgatttcttggatatgacaccaaaagcacaggcaacaaaagcaaaaattaaaaagcgggactacatcaaactaaaaatctgcacagcaaagaaaacaatcaacaaagtgagaagccaatctactgaacgggagaaaatattttaaaaccacctagccaataaagggttaatatcccatctatataaagaactcatatactcagtagcaagaaaataaataacctgattaagaaatgggcaaaggaacctaatagacatctttataaagaagatatacaaatggccaacaagtagatatgaaaaggtgctcaatatcactaatcatcagaaaaatgcaaatcacaataagatatcacctcatacctgttaagattgctattattgaaaagacaagtgataacaagtgttggtgaggttggagagaaaagtgaacccttgtacactgctggtgggaatgtaaattggtacagccctatagaagacagtatgaagtttctataaaaaattaaaaatagaaccaccacatgatttagcaatcccacttctgggtatatatccaacagaaatgaaatcagtatctcaaagagacatctgcacctccatgtttattggagcactattcacaatagccaagatatagaaaccactggtgtccattgacagatgagtagataaagaaaatatggtctgtgttgtgtatgtacctgcacatatatataatggaatattattcagccataaaaaagaaagaaattctgtcattcaacaacatagatgaactggagaacatcatgctaagtgaaataagccagttatagaaggacaaatactgtatgatctcacttatacatggaatctaaaaagttgaactcatagaagcagaaagtagaacagtggtggccagggactgtggtgagggtcagggggaatggggagatgttggtcaaaggatacaaacttgccattataggatgaataaattctggggctgtaatgtaaagtgtggtgactatagttgatagtgctgtgtagtacacttgaagtttgcaaaaagaatagatcttaagtgtcctcatgacacacacccgggcacacacacacacaatagtaactatgggagatgatggatgtgtttattaacttgattttggtaataatttcacaatgtatatgtatatcaaatcatcatgttgtaaaccttgaatatatacaacttttacttgtcagttgtatttcaataaacctggaggggaagaaaatcattagggtagacaaaactcttaaatttgtatataaatatttatgtgtctatgaagaggtaggaggagggtcacagagaagattcattattagctatttaaaggggtaggtacaagacccctttcccagttgagaactaatatgctataggttttctggctgagacccaaaattactgttttaagaaaaaaaaaaaaaagaggcaaaggagggaggccaagtgccatctgttgactaggtggagtagcatgggtcctgctctggaagggtgtcacttcaccaacatcagggctcctaccacaaccaaaccccagaggttggaagtgtatgaggttttctgtcagcgagctgtcccaatctctgcttcagagagcagctgcgttgcatggcgccatgctagcctgtctatggaggggaagcgccccatgctcactgttcatctgccctagtccttcctcaactcctctgtaggcttttgttagtctaccttacctggtctgctcaccttccaaaggtgtgttggtttctatcatcatctattttctatgcatatttacagacaaacagatcaacagtaattctggctgctaggtacaagtggataatcctaacttatgatttgttaatctgggagtaggaggggatgaaataaaatagtaaaattgtaataataataacaaaaatagctaacattgcttgatttctcccatcctaggtaggaagtgctttaacagccattcattcagggttgccatgtatggttgtgaaggttgggcactacacagtagctaatctaagtgggtaccactcatatcaataggcattgtatatttgcatatttatgacaatattttttcccagcagatgacagaaaagtgtattgttcaaacatattagtagattatcaccatttttttcagcagatgaaaataaggtgtcttgagaaaagagtgactttttctggcttacttaaaggtactgtatggacaatagaaagtcctgtatctcattgaattctcatagtcatttgataagccaggtgcatttagtattcttagtgagaaaattgagataaaaagaggtaaagtaattttcccaggcctagtaagtggcagatctgggcttcaaacccaagctgtcattccagacccatgtgtgccatgactgaacttgactgcaaagtgctatttctacagcctttgatgtttaataacctttctgcagccattatgtctttgtattcatacactgatccctcggtgttttggggtggggtcatttaatatatagatatatagatgaggaaatgaaatctggaatctttattatgtcaaattgctcatgatggacagaaccaggatttaaaagctgttccttaaccctccatgactgcatcattactctgacagccatgtttgtgattcactatcatgaactagagcaacaaaacacatcttccaagttcctcctgctccagtctaccgctgagaggaatgttcatttctacatggccagggaagctctcaggaagcattcacagctccctggagcagaaagcagagatattttctgccctttgttgaactttggaggtctcagtcctacagccttgggccctgggttggtactgtgtaatagtacattcagcgaggccagtcaaaggttgagggccaggagctattagtaaaggttaagggaatagtacagtttatattagagacaacctggccatctgataaaggctcctccagacaagtgcaacatctttgatctctgtaacccttgtccagtgcccagttgtcaaatgaagggagactaaatcctggagggaaagtgtaggtttttaatacaggtatttggctgctttatctcatttgagggcacgttaagagagaacaggctgcaaacaacagatagcaggattaaatcatgtattcatgtatccatcccctccacaaacctctactgagtgtctactaggtgtgaggtactgtgctaagcatttagaaagatttctggcagttggcgagcatgaagaggtcagcaaaacaatagaacaggctcttctttggaggatctactcaggttaacagtgcacccacctacaagcatttcctttgacatagtgagccctttaagtaccttggttataccattagtacacaaatagccaggtgaccctctgtgaaaaacactcggcctttcctgtttctgtgccttctgttactcagcttcagccctttccacatgcctgtcggaacctttatttatattaatcacacttattttcaaattctggtccctttactctggagtctttcctgactaccacagcccaaagccacctctgccttctcataacacattgtgtggcagcatgcatgggacactgaaaacatctggtagaacatctctcctggagatctgtaacaagatgctcaaggactatcctgcttttctggaattcagaaaataattttcctccagaccattccatgaagtataattgaagcatttaaggactagccatatccttaaatgttcaataaatccagaactaaagtcatttataaatcagttggcttctttgcagtgccactttttctttctttctttctttctttttctttttgcttgtttgtttttggttttgtttttgagatgggatctcactctgttacccaggctggagggcaatggcgcaatctcggctcactgcaacctccacctcctgggttcatgtgattctcctgcctcagcttctggagtagctgggtctacagatgtgagccaccacaccaggcttatttttgtactttaatagagatggggtttcaccatgttagccaggctggtctcaaactcccaacctcaggtgatccacctgcttcggccccccagtgtgctgggattacaggcatgagccactgcatctggcctcagggccatttatttctttatttttttcttgagatggaatttcgctcttgttgcttttaagaaaagaagtaaagtttttaagactgcacatgagctattgcctatagagaataggtgaagacaaaaatgcactgaatagctggctagatttatctgccagcttgaggcatgtgtgctatcttcacagcaggtgtattgaatgaaatggctcacactctgcacaaggaatacactgaaatgttccaagccctgtatccttaagtatgtgtgtcaaagtcattccatacaacttattttatgtttctgtcccttttgcctgtagaccccattacttctatgacagcatagactatggagacaacaggggcactaacctcatgcataggatgcaaaccaaactgacatgcaggataaggtagttgacctatccttatccagaatttcatgaggtgtcttagagggtccatgggattacaagacttcctttacttctctctgattctacagctgtggtttccccactataagacaatttctctggaccattttctgagcctaggctttgggcgctacagtggtctcttcattctcatctgctgtcacggaaacttccgcttgagcatggaaggagtaaataaaacctgaaaatgttatttaagtgtcttcacaaagaaagtaacagctaggtctcaaatattccactctcttccttacagctccgaagtcccatctatattcacaagaaaaacagaaaagaaagactccaacagtcatactgttcacagagacaggctaagcacagtgcttcacattgcccccagatttactcatttgtccagtggtagtagcaagaaagactgaagccaacagaatcctagtatctctcattgttggaacagctagggtcaaggggctcaaaaaatggggattcacagagacaagaaccgttgaaaacaaacttcagccccttaggtgcaaggaccagtttagaagtgaggctggcacaccttgagcactttcatccccttgagtgtttgtcctgggggtgcccccatgacccttgaaagtacatgtatagcttcaggcccattctcatcaggataacacttgccttttaagagacaggctgatgtgccgagaaaagcatagactttgaaatcagatgtttggagatcaactccatgtgcccttgactagctataaggctatgggaaaggtacctaattcccctgaatctctgctttctcaactgtaaaatgaaggtggtaactctccctcagcaggttgtcagggagattaaataagatattacataggaatgtgtctggtgtatggctcacctgaaaaaaaaattacattttcttaaaaaaggcattaaccaggcacacaaattttgaggagtaaactggcatgtgagagccagatgctaaaaccataagttcagtccaaccccaagaccacccaaaatctgctttctgtctctgaagctaagatttcccttcacgacagttgtcacaagccgggcacagcctgagtggggacatgaatctgctctgcatccatttggaaggaaaagatgattctgtctgtttttactttttcttctgcacatccactctccaagaaagtctttcatgcatggagggcataaaaccctccatgagttcaaaaagtagtccaagtttctcagtctcttattatagctgctgctgttgtttttccttgtttctcttgctaggaatacattactagaatagtaaatggcagggttaaagaggatctctcatgtgatgaaatatgctatataggaaaaattctcttaagttgaagtcatttagaaaacagctgcaattgctgctttgctgaaatacatctgcacctgagattcttgtgatgagattcatcttgggatgtccacggaagaaatgtaacagggcaggcccctttctgtacttgagatctgctcagagccctaagccagattttctttattgtttagtaagctcttttaatgaaatgtactactcttattatagaggactcaagataagatctaaatcacaaaccaataaaagaaaattattggggtagatatctaaagttactacctagaggctactccagtgtggtatttataaatctctaaacagttaagtataattgtctttctggtttttgggacggaagccaacagcagtttcagttacaatggaagaaaaatattttagcgctgagctttgttcgtttagtgggtataaagagaaatggcttctcccctatcaccatttcagaattgagagagaatattgtggtaatgaaatgttatatgggagcagctgaaaaaattcttctctgacttcaaggaggggaaatgtgtgtgaggatacatgtataggtgcgtctgcaagaaacagtgagcagcctgggggtcaggaaagccaggcttgtagaagtgggagaaggcagagccctgggaaaaaggcaggtgtggaagggtggtgtggaagttgaagatggggtggtctgtccaattaatggaaaagccagatctgcagctgctcaccccaatgccgtccgctccccatctttgaacacaaagacagtgccgttcaggaaggacatgaatgcttccactaaaagactcatgaccccaatcctgacaaacaccatagctctccctctggagttacaatgcaaatcatataaaacacagatccctatgtaataaaaatcaagaacatgctggatatccttagttataaaggaccacagaactcatctctctaccaatctccctcccatcacaaagagcgtgtcagtaactctcctttagcaaagagacagtcagggataggaggctcgctgcatttgcaggctgtccatgctgttctggaaatatcttccttatgttgggctaaaatcctgttctccttaattattaaccattggccctggtttttgtccaatggagcagaagattaaatggccctttaagcctgctggctttgttctcttaaccacttggcaagtgacatgttgtccaggcactgccccattctggccgtcctctttacaacatttttctgtttgtttgtcaaatttctgcttcaaatcttcacagctcttgacacattccctcctatcccaacaaagatgaaacagtcactgctcaaaagaaatgatgcttttatcaccaaggtttatctagcctgtctttactgatcatttgaaaattaacatgcagaggtcctcaatgcattctgtcctgtggatttcatcccagagttccactttaggaaggcccttttcgttctgctttttgtcatccagtaatttagagatcctaatccacactgtctcacacaaagataaaagagaaatcacattttcttctttggaacagtaaaagacatctcagactttaggatagggaaggtgtaccctatgcccccaattaatgctatctctccaaggactgctgccatacttccaaagaaaaatgtcattccctacttgaggctcttaacctttgttgaaatgtggagaaaggagggtgtccgcttatatgtggatgttcatttagtgtaactatagcttcaggtcaaagagggcgggaggaaagctgtgtgtgtgtgtgcgtatgtgtgtgtgtgtttgtgtgtgtgtgtgtgtctgtgtgtctataaagcataaaatatggaaaaaaggcagtggacatatgtcttgggtttgagatcttggctcctccctcccctgggacattcgggacaggctcagcttttggttctccggcttctaccaaagttttcctctaccctctctttctgagatggtatacttctgtcctgcaattctcttgcctctctccctctctctgaggctctcctttgctcctagagcatgagcaatgggccagattgctagaagcaaacttttcctggattaaggacttcatttccacccttcagcttttcatgcccatctggattttccactaagtccccgtggaaataaaccatgactaaaacccaatcctcccaacactgctttctcctgcagcctgtccctccactctgccatcctctgacccccagaaggaaacacacatccatgcagactgttttgcatgtacagtgactccttctagaacctcccattctttttccagtccaaggtttcaggcttccatctggatagccacagttcctaaccagagtccttgcatcttcttcctttccactccaaacaatgcttcacagggctgccagatccatctccctaaagctcaggtccaatcccatcactctcttgctttgaaaccttctgtagctccccagtgcctagtgaattatttacagcttcctaactcataaacacataaaaaattatttacagcttcctaactcaagaaagaaaagaaattcctcaatgcccaacccacatttcaacttcatctctccctgctgccttatatgtaccctgtattggggccaaattgtacttgtccctgtccctctaacacatccccaggaatctttgccgtcacttccattcgctccgtctcaagccagctcactttgcctccacctgttatctttttcaagcatggaattaattactcttttcctataaatctttgatgactcccccaaatccaaacccttagcaagacaagtctacactctaggactgcaccatccaatatggtagccactggctatggatcactttaaatttttatatttgttaaaattaaattaaaaggaaaaatttaattcctaaatttcaagtgctccatagccacatgcattcaagtcatccacagatgccacctcttcttttttttttttttttttttttttttttgagatggagtcttgctctgtcgcccaggctggagtgcagtggcatgattttggctcaatgcaagctccgcctcctgggttcaaatgattctcctgccttagcctcccaagtagctgggactacaggggcgtgccaccaggccttgctaattttttgtatttttagtacagacggggtttcactgtgttagccaggatggtctcgatctcctgaccttgtgatccacctgccttggcctcccagagtgctgggattacaggcgtaagccaccgtgcctggccgatgccacctcttcttgaaagccttctcaattcctcaaaatacctaaaccaaggatccctttgtgttcctctatttctagcctcgtccttgtttccttggactgtcattgtttatggggatacctcctccactcacctgaatcctgcaagcatagtgagtggctgaatccaagcaacctttggtcacctttgtgttctgggcctttagagtgcctgatgcatggagaacagccatttattcctttttcttttccttaggagttacctttcatggaagggtaagcaggaagcaactacaagatcatcatttcaaaacaatatgaaagcagaatgggaaatgccatggcatgctccctcttttcaggtatgaactgaagcagctcagagagcggacattgcctccctctgctcaccctttcttccaagatcagactcagttctcatctttttgaaccacagggaaacagtctggcaagagccactgttgtaccagctgatttaaattgaaatgttttccccagataaatgcgtgctaaataatacaccagctctccagccaaagggaagtgacaggcactctgtaaataaaggcacttagttgctggtaaagagctgtaaagtggttctgagctgatgtttgctgaccagcaagaagcagcttcatctgctttatataattgtcactgcagttttgcctgctgtatattaaaactgcatctcatagacccaactgtcacatcggatataccatctggcttgggatatgccaccttttctgtaattgtttttgacaacaagccatcacatcttgggtcttttcagaaagtgtctggtccagaatccctaggctgggtcagttctgacaccatgtgggctagaaaagtgacatcaaaagggagtgtgaaaagagaacagaagagaaaaaagaggctttgttagtctaggagccctaataacatgcagtggcagctgtccaatgaaggctctactttctcaatgtgaatgcacatttttcatgctaaattatatcatcttaggacagctttccatagggttgcatgcatattctggcccaagagcatgacatttgtcctgagtccacatttctacccagtgaggttctagagacatggagacagttcttcagacaatgcagagcatgaggttccataaaggaccatagaatacataagagggaaagcaaggtgtcagtggccagaaatctgtgtagttatcactcagaggaagttagatttgttttccaaaatgataagagtaacatgaaatccccagcactttgggaggccaaggtgagtggatcacctgaggccaggagtttgagaccagcctggccaacatagtgaaactctgtctctactaaaaatacaaaaattagccgggtgtggcagcacgcacctgtaatcccagctacttgggaggctgaggcaggagaatcacttgaacccaggaggtggaggttgcagtgagctgatatcacaccattgcattccagcctgggcaacagagagagactctacctcgaaagaaagaaagaaagaaagagagaaagagagaaagaaaggaaggaaggaaggaaggaagaaagaaagaaagaaagaaagaaagaaagaaagagaaagaaagaaagaaaaagaaagaaagaaagagaaagaaagaaagaagggagggagggagggagggaagggaagggaagggaagggaagggaagggaagggagggaagggaaggaaggaaggaaggaagggagggagggagggaaggagggaaagaaaagaaaagaaaaaaaatggagagtaacatgaaatcctttttgttccccataatccctattcccttggagcttgatcatgccaaatgcccagatgaaggatgacaaaagtatctcaggccagtgggcactccagttagtcaaaagggtctcagatatagaaaagcagggaaactcagctcacagagtcagctcacaggctgggaggagcccaaggagtggagtgctgggtctgcagccagaggtgagctctggggaaggagcgatttctctgtgttgatggctcccactggaccactgcctttacaaggttagagtatcaccagagaacagtattcaaaaacaagagaggagcagacagacagacaagaaaacaatgggacataaagtcttggtgggcctagagctttgacactctctcttagggagcagaacagactgctggctagtgagagacagatgctcctctccactgctgaccaggggtctacgagaatcactgctgagcatagaaacacatcctttgccttcttctgtcatttgtgcggtcttagtccatttgggctcctgtaacaaacaccataatctgggtggctgatagacaacagatatttatttcccacagttctggagaacggaaagttcaaggtcaaggcgctggcatgttcagtctctggtgaggactttctcgcagtgtcctcacatgacagaagggacgaggggtctctctcaggcttcttttactttatttatttgtttgttggtttattttattttgttttagacagagtcttgctctgtcacccaggctggaatgcaatggtgccatctcggctcactgtaacctccacctcccgggttcaagtgattctcctgcctcagcctcccgagtagctgggattataggcacccgccaccatgcctggctaacttttttgtatttttagtagagattgggtttcgccatgttggccaagtggtctcaaactcctgacctcaggtgatccacccgccttagcctcccaaggcgtgagccaccatgcctggcctcaggcttcttttataaggacaccagtcccattcatgagggctccaccctcatgacctaaacacctctcaaaggccccaccacctaataccatcgccttgagggttaggatttcaatgtatgtatttggcagggagtaggtggagggtacaaaaacattcagaccataactgtgtgcatgtgtgtatacaaaagaaagagtgccctttttttctttggaggaaaaataagctccctttctctttcctccatatctcctgtcaaaacctatttttcttgcttatcctgtgctataaaagaataaagaaggcttttgggcaccggggagtggaagaattgttaccagtttggcctttatataggatctaagaggctgggatgaggtttaagagaactggaaggaacaactatatcagatgtgtatgtaactaaattatacactgacattctaatctgtggccctggaaaatcatgatcgagtttggaggaaacaggcatgttggggaaagggagtgttttcctgcctcctcctgctggcttctgtctgtacttaaagggagaatcattgctttcactgttttcctttccccttgatggttcactcctccccaggagaggaggagcatctaccaagggttggtcacatcctgttcatgtgaaggtttactgtgctttaaaagggcacatttgagttgcctggggatcttgttggaatgcagattctgacccagcaggtctgggatggcccatgaggttctgtaactctaacagcctcccccaacagacacccatactggggcagggcagagaggacacatattgaaagtcaagggcttaaaggcaggaaccaaatgccggcttgcctctttcaactcctagaaggtcagcttactgtcttctcacatcctttctcgcctgtgctacccgggcaggccgcacaggatgcgggctctacctcttcaggatgcagctgggagtaagctcagagcctctcctaggccttcacatgttgtgctgtcctgcgggcacagctgagcaggtggataccaagatttagatttgggtgtggcagggaggacggtggcatggagaggtcaaaattaggcttcaggctgtatcagggtgatgtcagaaggacagaagccatttcacatgcaccaccaaaggggaaggttctcttaagcttgaccagaagctgctgtgaatctcaagatcctcagagaagccccagcccctctctcagtctgtagcagtgaagacactggctcccagaaagctcatctgatagaagatttgaacctgggtctgccagggtctggctgcagttgcctccaaagaatcaaagcctatctttctcctccactttccaaatctcaccccagtgcccatctcccaccagctgactctagcccagagccatgcagggaagaggattccaggaactattgttcctggcttttctgcaatgctaagcaaatgttagaaggcagtggtggtgatgtcaagttgacaaaaaataatgtagctcacaggtccaggatgcatgattcagctgagcttctagaaagcctggcatgatggggaggaggtcagacacttgccaagctatcaataaggtgatgcttcatatcccagtagccatagctctcatgggctgtgctcctacacccttccatcctggactgatgggattctggtccccatcaggcagccaatgccaccctctggcagctcgtctgtaacaactatcctccaattcatggctagcctacacggaggtgtcactcaatggaaaatgctttgcatcctatcctgccagatcctgattacagaggtcattttttatgaaggttttgctgtgttgcctttctgagacccctagacatctttacttgtaaccacctgcccagggtcccaaagcaaatgacaggaaagactaggggcagagtaggaaggcagacgtgtgtcacttaaggctgctttgcctcctataggaaaatgtgtggtctgacaagtgtcaccatttgctaaatgacttttagtgtccatagagttgccactctccagagattaccatcccttggtcagcagagtcctagaggcggctctaacaatagcaaagcttcattcccatcccagctcaatggcaaaaacatatactggaaggaaacggtcagaattgtgcagccagcttcttttcagtgctctgacatttagctgatgacactggtcatgaagccactccttgggaaagctgagggggtggctatttaaaggcttgtttatcctctggaaaggcaacctagtctgtgtgtgggtgaccaggtctcaagcctgcattctggaatggaaagaagaggcagcagatgcccctttgaaagccatcatggtgaccgcaggtttcactgccaggcaggctgatgtgagcctctttgaattactgagtgaaggatatccctcttgccagcccctgtcccctgcaggcacagcaaagaagtattacaggctgtccttaccttgggaattagcctgcaagactccgatgctgtcatcaaactgcatagatttgatgttgagtgacgccaagatgcattccttgtcctgcagcgaagtatcatcaatattattctgattggctgacaggataacgcacatgtcacagaggttgatgttgacagcccttaaatcagcccgacttaatggcgtaccctttggcatagaggaaagaaaaaaaaacagagatggggggagaaagagacagagagagagagagaggagcaaaagtgagaggagagggaaagaggaaaacaaattaaagattgagtcggagctttgggaaattatttaacaagtatcttttttatgccttgacattaagctggcctaactacattcaagggaataggagctgtgtgctaatctaaagggtagtcggtgctgatggcagcattttaagcttgttctcaatactcaatcaagctattactaacaaacgcgggagaggaataatgccagggttctacatcttcttcctgcctggaaattgtcttgatttaagtaactgtcctgtggcaacctctggctttcagaatgtaacaagggggtgggtttcaaatgcctgtttatttaatagcgggtcacttctgtctcaggcaaaagacagcagttccaatgcagccaaggagaaatggccagtgagcacagagtgatgaggtgggcctggatgtgcggctcaatttggaggctatggatggagtggaattaatgtgtgcaatgcaaaagagatatggaaaggagttaagcttcagatcatataattttattgcatattttcagcaagaaaaaaatacacagggaaatgacctaattgtccaacaacataggaatggagaaatatacttttggacatgcacacagtgaaaatgtatgcaggaggtaaagaggcagagctggctctccatgcaggcattggtttagaagcctaagatagagggggaagtgaaaaaaaaagttctacagcagttaaaaaaaagtatagtttcatttatgtaaaaaaaaaaacccacaaaataaaattacatatatataaatgtatgtaaatttggaaggaaagcacaggaaaaatagccattacactaataatggtaattccctctgggaagggaaataggattcgtgggggtgaggggaaagtttgcttttcactttatatacttctatattgcttgaatattttataacaagaacatatttgtatattacaggtacatttaaaaaataaataagccagtaaacagattttttaacataaaaaataacaacaaaagacagtggaaaaatcccagatccaggaagtaacaacagagtccgggaatgcaagcatagggaaaatagaagggttaggttaggacagggccatggcctccacatgctctgtgtcttcaggtgaagccacagcaaaatcatcaggccaccccatgccatagctccccagtggccacgcggcatcattttggggctcctgtctggccaccagcttcattggtcctctagcttgaatctagcttcctctttgcctgtgtggtgacctgagttaccttcaactcactgattgtgtagaccaagggtttgccaactgtcacatatctgggaatgtcctcctctaatctccctttctggagaactggctttggaaagagacttggctgcagagatggagcctatctaccctcttttatgagtcactggtagtcatgattctattctcaggccctaaaatattgtgcaactatggaggaaggggcatttagcactgtggttgctgctgagacacaactagttccaagctctggagcagcgtctttttgagagaaggagaatgccctcttctcctgtgatctcttggtacaaaacaagtccaaccaacttcctgaatcattttgccagtgcataagcttcaattgcctgcatccatattcttttaattttcatcttgtagggaagccagccgtaattgtgatataagatgatccctgtgcagttgtacacacgtgatttcaaactacaagaaatacaaatgacatacatagaaatcgcttatgtttctctgggctggccctataggcagggtactgtttaaccaataaactctgtgaagacataggtgaaggcccattttgtgaaaatctattgtgcttgagtatgttaaattttggagggtttgaaatgacctgcaaagatgacagctcattcatatacatgaagaaagatgagtgaacgtgtacaagggcacacagagccgggcgcggtggctgatgcctgtaatcccagcactttgggaggccgaggtgggtggatcacctgaggtcaggagtttgcaaccatcctggccaacatggtgaaaccctgtctctactgaaaatacaaaaaaagtagccaggcatggtggtgcatgcctgtaaacccagctactcaggagactgaggcaggagaatcgcttgaacccaggaggtgaaggttgcagtgagccgagatcgtgccattgcactccagcctgggcagcaagagtgaaacttggactcaaaacaaacaaacaaacaaaaacaaacaaacaaaaaaggtcacacaggaggaaacatacacaaacacacaaaacacacacacaaataccaaatatcacacatatacccatctctctccacacacatacacacacagactcatgtatcctggtaaaataataaaccctttacaaagacactttcagaggtcaggggactatgtggaggagcacatgacagaaagataaccatggaatcatataatcaaatcgaccatatttctggaatgagcaaagcatatatatgcttatgctctcctctgtgtatgactgtttgtctataggtgactattttcaactgcctgtgctcactaaggcagtgggtttttggcccagcatccaaaagataactgtccgatctttttctcactcctttaaatatttattgagtccctattgtgtcaggcattatgtaaaggcacatggtggcatctaatgagtaacatgtactgcttgtggatagattcttgtgtgttctttaatgaattatattacttggctctttttccccccatttctgaggttttggaagctgataacagaaataatacattttagctttgtaagtgggggaaaacccagacttcttaacatgtagagaaatccatgttcctcagttgtttcttgttttgtttttgtttttgtttgaggcaggctcttgttctgttgcccaggctggagtgcagtggtgctttcacagcccactgcagcctccacctctcaggctcaagtgatcctcccaactcagcctctcaagtagctggaactacaagcacacgccaccacatcaggctaatttttttaactttttgtagagaagaggtctcaccatgttgcccaggctgctcatgaactcctgagcttaagtggtcctcccgcctcagcatcccaaaatgcagggattacagggattagccactgcacctggcccctgtttctcagtttcagggatgtgaacttacaagaaaaatatttggaggataagtgagatttgcatgaatttgtgatgtggagaattacatcaaatgttgaaatgcataattctctacaatgttttgagagtttgtggactatgcattcattatgattaggaagtagttaattacatgactcctaaatcccatatcctcacactaaattgtggagtcccagactgttttttcagactgaagtcctaatgttttgcagtcaagaatatcatgcacacatgcacacacggacacacacacaaacacaaccatgaacacgttgctggacttctaaatgaacaggggttggggctgagctgcagaaggagttggccttctgtacagcagaaataaagaactctgttatttgcatttatttagttaaaaacagaaggtggcacagatcaatgtttcttcaagcattaaaaatgccataagtataatgctataaatagttctgtaagcaaatccttactataaacatcataatataacaatgctctaggttttgtataggcaggagtgagagtgtttagacgctgatatggttaatatacttgatacaagctaaacttcatccctgatgagggactgaacttggctgcaaattccttttaataaggtctcccagggtttggattttccttgacagagcataggggaagtgctgagtcctcaggcccatacccagatgaagaagcacaggcatgatcaaagctacaactattatatccatccgggattttcttttgtgaatgaaaagaagaaaaggcatcaataatgtgaccttggacttacaggcaatatggacactttggggaagttatgaagcgtctcccattcccgcttgaggtactcaatagagcccacaaacacaatgtgcttgagctcatggtaatgaaagttgctggcacggagcggcatcaccaggttccggaggccgatcagggctgagctgacgtcgccaaagatgcagaccacgacatggccactcaggacggtcatggcagcttcacttcgagtctacaacagggagaagtgggtaagagtcagagagaagactgcatagggctgttgtaaggagtgaaataaatcatttgtgcaaagaatcaagcaaatatttgctgagagcttactatgtgctattatttttatttcatcaatgttatatacatgccatatagagctataatttgagcacgtgtatatgtattatatttttgtaataaatctgtccaaatgtatagccatacacattgctaccttctttgacaaaagatttaagaaaggtatgccataaatatgtgtgagcagaccttcataataattttcaggaggtaaaataaaaaggaaaaggaatatttatgctatttggaaagagaagtcttagtttccatgaaattgttgattaaatgagctgccttttctggcttgcttgctgagatgatgataaaatggtcagatgcctgcactgggctcagtgggagaaatttgactttagaattctagacttatcagtgagatgtccgtgcatcagcaggtggaacatgctacctaaagccaggagtggaaaactacgacccacaggccaaatctggcccactacattcttttgtatgttcagtgagctaaaaattgtttttgtgcttcaaaatggttgaaaaaaaatcaaaagaagacaatgtcataatctgtgaaaattacataaagttcaaattcccataaagttgtattggaatgcagccatgctcatacgtttaggtattgcctatgggtgcttttatgctacaacagcagagctaatcagtagcaacagagatcttataccctgaaaaacctaaatttttcattatatgacttattacagaaaaagtttgctgacccctgtccaatgctgccttggactttccagggacatttctggaggggcctgttttgcttaaatcattcagagaaaagatctccccaaataatcattacaaggggctagagagagattagtaagagcaacaggccagtgtcttcctccaactccaaacctctatctacaaaggagacaaatgaaagaacacagtcactctattagaggagaaccccaacttcccaggaaatacaaatgtttagtcactgctggccctttgattcactgagctagtgaagccaggaggccagccgtggacctttctctgcctctccttctggttcaatgcctcccattcctgtccacccactgcatgcctggatggccccatgtggcttacaatgctttgggggaggcatattaatgtccactgtacatatcaaactctgcttgatttaatctctagaattgaccactgcattgattgtataaatgccaatgttgcaattcacaacaatgtcagggttattacagtaacccccaaggagaggaagaaactagctttcactctctgatcattagaataaagcaggggctgtcaccattattggtttccctctgcaatagtccagggaaaccggagacataagctgtaagaaatgccttagaaactgtgaccaaggaagacccactggggagctcacatcacatatccccacttcctgcagaagacctggagttagttatctgggccgcacggaagtgcaagtgcctgggtgccaccaggagacagccaaccagtctataaagcactgttatgtgatggggctcctaattatttgtaattggccaggtcacctgggaggctagctcccttcaacaagccagaggaatataaactgggcccagggtggaagtgaattctagaatagggaggtggggaaggcacagttagttgagtggccgaggcacagatgctgaccccaggaacttcgatctgggatcaaaacacccatcctcagactggccacagctacatcacccagagaaccttatgaatatcctaattctagagcctcagccccggtgtgtctgattttgccgggtttaaagcacactagagagagaaactgatcatttctctatgtatctggaattcccatgcatccttccaggcccaacccaagcacaacctatgtgtgtatgacgggacttgcctggtcacttaaacacaccctagtccttctcccctacatttcaatagcattttgcacctcttaccacttagctttaaatacactgtttcatgggttacattttatatcttctctctaattaatccaggaaattacaattgggactatctcttatatcttcaaatccccaaagtagttagtttcccgtgcccagtgggtacacaacctcaaagcatcctcatgtagctggccctacctgtcattcttatctctagccgtgttactttagagagggcttcttggatcatactttccagacagcacctcccagtctctttctagcctacaatgctgctttacttttttcaaagcatcctataaatatctgaaatgttattaagtactcatttgtctacctagagataactcctcttcccccagccccaccctgctagaacacaaagagataactcctcttcccccagccccaccctgctagaacacaagctctgtgagagcagtcgttgtcagggattgcatctccagtaactagaatggtgtgtggcacatagtaggcctcctggagatgttttgttaaatgatgttatttttcataggatagaagtagtaactcacctccttaaacttttttatgctggcaggagatgttgattgaatatcagttggcatgcatactacaccaatatccaggcaagtcattaaaaccctaggtcccagatacggcatccagcctgtgacctgccacaagtggtaacatcaggctaaatttaggccaccagggcaaaagtgccatgaatacatcagaatgtacatatatggctgggtgcagtgactcacgcctgtaatcccagcactttgggaggccaaggttggcggatcatgagctcaagaaatcgagaccatcctggccaatatggtgaaaccctgtctctactaaaaatacaaaaaaataactgggtatggtggcgcgaacctatagtcccagctactcgggaggctgaggcaggagaatcgcttgaatctgggaggcagatgtttcagtgagctgatagggctctgcactccagcctggcgacagagcgagactctgtctcaaaaaaacaaaacaaaacaaaaagaatgtacatacgtgaagcagctttgcgagtagaacaatttgcactcctggtcagttggacaacagctgtttgctaagaattctgactttctgtgctcttgcctgcaactttcccacctctgagacagcctccagcttgatactgtattggctgttaatgctcatttataattaagctgagaacacacatacacatagataaagcataggggaaagtccagtgtgttagcatacaaagccattccgaggacccagaacagtccttgtttaggaagggtggtcctgacatcagaaatgataggattttcctggctgacaaaaaggaacagacccataccaatctggggattagaggcccaagggagaaagaacccttccatctgactttcctgattattaatccatttctcatggattagcaagacaataaactgtaggaaagccagtgtaggcattaagacccaaagctgttaatagaacaagggcagagagtagaatggattgttacctatgctgacattcctgggagagactgggtgagcccactgctgctatgaagatgttcacaagccttccacgaaatagggctctgagccccagcctccccaaggggactgtagttcattattgtcatcattatgtcatgcatcatcatgcatttccctgtctacaacatgcactaagaaagctcacagatgcacaaggctattatctataagaatacaaaacattgctataaaccaataacaatacaggcagcattcagctttcctcacagcatttaataatagtaagaataagaggtaactttactgagtcatctgttggattttaatcttcactacagccctatgagttagggtcattctcatctcatctttttacagataagaaaaccgaagtgcaaaaagtcaaatgaattacccaagccatgcagctaataattggtacaggcaggctctgacaccagcgccatggccacaggaattatgttcataccacctcccaccatggctttcccacagcaagtgctcacctactcttatgaggagccaatatattcagagattgaaaaatctgaatattgcttatgttctgatcagaggtctagctgcttcaatctatgctcagaatttcactcatcaaaaataattaggaccagggacagtattatcccactgtccaactagggaaaccccattcctagcaaatgtggtttggggcagaagcgggcaacatcagatgcacagtccctcactcaccaggatgactttctctatctccttgggtgcacaccagtgaaacatcccagtagagtcgtacttcttcacattggagtccatgttgtcaatctgatcattgccaggaattaacaaggggtcatgcctgggaagaaaaggacaggaaaacctaagtggaaaatgtgataaattataaatggaaagtgccccctgaattacatctcagaggatgtgaaagatgcagaggaagtggttgtcactgaaggccattcttctgcttacagaatccatcctttgagagacaactgccccaaaccaccaccccacttctggaagtgcaggtgacctttgtcagggagcatttctgcctttcccccgctcctcttttcctaaatggtcttcctaacattttgtggattcagcctccctttttaaggctacctcactcctcttcctctcattttaccagctattcgatctccccagcgtgcacacacacacacacacacacacatacacacacacagacagacacaccaaagggttgctatgagcctcggcaatgaagaggaaggaataggaatagagcctcatgctgactgactggcatgaggatggaaagccaattactcgctccttctgactacaacttctgacgtgatgctcttcgcagtaaaagctttaacaggctgcactttaaatattttagcaatttgcccaatcagattttgctctccctggctgaagcctttaaagattcagcagcatgtcacttcagagcagactgactaccaaatgcccacatctggaatacatgatttcaatactaaacaacaccctctctccttgccttgacaactgtatatgcactaaccatccaatgatgctccccaccaccttcacctcccaactgctgcatatcttagatgagagcctcaagctcagatgcatcttaataaacttgtttcaaattctcagggcaacattcgccctctattgccttgtctattggtggaaaaggaagatgcttccataaaggcctcccgtctagtgggttggcagagcctcactgacaaccttaagaactgcaatggaatcaggcagttctaacaagcttatagcacaataaataagctcctgcaccttgaatcatagtcaatgtccatgcttttatctctgatagtgattcagcacctcgggtttgggaagtcattgttccttcctgcaaaactggccatataattaggacattgtcccagctatacttaaccactcttgaaatggagctatcttttctgagtaatattgtcaacacaagacagaaaatatacatcgggtcacattccataaattgtaaagtgattttaccttttgaaattctatatttcaacatcagagggtgacttttttcttttttctttttttttttttttagacagagtctcgctctgcagaggctgacttttatttactttttactatttgtccttctgaaatgtctccgatacttcccacttatatgtcaagagtacagagtgggacagcaatctcttccatggcccaaaaacctaggattaagcttttgaataactaccacgaccctccaatatgctccccactcccacataaggtgagaaaactttctcactgcctttatttatgcctgagaatttgcttttagactacaccaaatgacaaatactatgtgaagccaacttgcaaagttatcttcaacgaacatgctagactactataggaatatctgtcatatctgatcttaaaagaagaacaatcccactccgagtagcatctcagtgtctggattgttgagaggtcttgaggtatgtaaaccaccaggccatcttccaaatactgaacttagtcaaagatgttaagataaaaaggctgataagaactatttacagatcagggtgagagcacattttgagggatgtttttgtccttgaagagtctttaacagttgcatagatatctattaatattatctggaataggtaggtagacaaaagccatcatggagaagaggtttgagaaaatgaacaaaattaactctttccagcccatgaagaacatatttcagttgcaagaggatattagcagacttgccctgaagatatagagccaggttcaaattctcttgccctgtttactggttggagagaaagtattacctcaggatgacctgagacctgcccctagtgcatttaggatttaaaagatactcagaactatgttcccataatatcagcaagcaagcaaatgaaacagcaagctgacaaaaaacacttttagaaaatgtgtgccttggggaagaggagatacattttggtttggtatacttgattctttctgggaaggagtcagacgttgttaacagtggcctacaactttcatccagaaaagcaaataagcaagcctgatgatcgatcgcccttcaataaaaagaaaaaagacagctaatgtcaagcttcattaactggggtagtggtttccagaaaccaggcataatttcacactggagctcaagccatggtttgcaatggaacatccagaggcatccaggaagtcttagaggtatgccacactacactctactccccacacatctctcatcctggcctggaccatttaaatataaacaatccaggatttcccccaagagactgacctgaggaacatcaaaaacctcccggaacaaagacattaccctctctgaccagcatggtacctggaattctaactttggtttattgaatcagtaaagcaaccaattgaatcagtaaagcaatcaataagaatcccctattctgagcatggaatggaggctacagtaatgattaagataaagtccctagtcaaagagaggtccacaagatagcaggaaaaaaatatatatacaccaatagttcaatagttacagtaccttgtggcaagtgttacagcaaagtacaaggtgatacaagaataccaagaaaaaagctgttcatatcctggtatttgggtagcattaaggaaggttttgcaaagaaagtagcatttgggccgggcgtggtggctcaggcctgtaatcccagcactttgggaggccaaggtgggcggatcatgaggtcaggagatcgtgtccatcctggctaacacggtgaaaccccatctctattaaaaatacaaaaaaattagccaggcatggtggtgggtgcctgtagtcccagctactctactcgggaggctgaggcaggagaatggggtgaacccaggaggtggagcttgcagtgagccgagatcacgccactacattccagcctgggcaacagagcgagactctgtctcaaaaaaaaaaaaaaaaaaaaaaaaattagcatttgatctgaaccatgagaaatgaagaggaatctcagcatgttgcagtgttgatccactaatagccagtaggacccacccagagaattgaggcccaaatgaaaagggccaaataatggcacctaaaaccatggctgaagatgccccataccataccacctaacctaaggtacagaagactcagaccaggccttccagctgtctccagatgtgcaatgacagtcaagttgaagatggattaaactgattgagtatgactgattgacagcagactaagaatgatccatgagattaagagagaacaaaaatcatggttccaaaacaggaagattgttataaaaattgaaagtaattcaaaaatgaaatgagttgttgcccaagacagtgggttttctatcattgagccattccacaagagcaagggatacagtgagcatatgcatataaaggttgggcgagcctagaagatcctgaaggtttgaagcactgtgctgtcactggagaaagacacagctagaagaattttgaaagtactggaccattgttggatatcagaaggctggagagccctgagtaggtaaagaaaggttgctagagtgaagatgagaggtaagcagcgtgggagagggattaatttatggctccagtaagggccagcactgttacacactcactggatttcacagtctgggagtaagctgggaacacaattcgttccagcaacaatagagtctgtaactgtttctggccagacagtataaatttctttactatggctgttgctgtagtaatttcaagtgccttaggctggcctgtgctgcagagagatctctggaacaggtggagagtgtacagtcagttgtccacagggactaaatcaaagtttctaaagcttctattgctagaagaaagtccaagcatttgccattgagcacaccaatcaacactgctgtgatccagggagacccagaggaattgggccgtttgttgtatggaaaggaggatcatgagaaatctccctgaacaagggatcccaacatcttcagtttgcaaggtgatagagacccacttccaaagcctctcccacaactcctcaaagaccagttagttgaaatcaaggaccaggattagatattgtctttcacatcataatgacattacctaagtcttccactcacaaagtaattttcaatttccctaaaaggcaccataattaattcaaggctcacttgtcacttgcgacttagccaatgtacatgccctattttagggtaatagaaactctatgatgtgagatatatctgctgtttcatttttatgggctgaactgtgttctcccccaaatttttatgtgaagtcttaaccgccggtacctcagaatgtgactgtattttgaaatatggtctttaaagaagtaattaagttaaaattaggtcattggggtgagttctgatccaataggactggtgtccttacaagaagaggaaatttgggccaacttttccacaggagggaaaatcatgtgaagacagagggaaaagacagagatctgcaagccaagaagagaggcctgaaacagatccttccctcagtacccttgggaggaaccaaccctcccagactttcatctcagacttctagccaccagaactgtgagaagctctgttgtttaagacactgggtctgtgatacttgattacagcattcctagaaaattaacacaatagcccaccttgaagaaaaacaggcacaatatatcagatatcccttagctgaaggcccccggctgcccttcttgaatcttaagtttttcttgtccatttaagggggggaaaaaagcatcccgccattatttcaggaatacatagacatatatatgtaatacccagtatctcctctaaaggttttcggccaatatccttcccctctccaaccaccttctctaccccaccaccaacatacaggcatgttagatctgctctgccagagtggtaacttctctccgtctttaacttagacatgcatttgaggatcaatgccaatgaaagcccagcttaaagcaaagaggaagcctgaacactagccagctaatttgagcagtctgacttatagagtccatctccaaatggagtgttcaggggttgataccactaagggcaggaaaccacctatttccttagtgacagtataccatagtggttaagcgccctggctccagagccaaaatgtctgtcttcaaggcttggctcacctattacttgctaagttgtacattgccttagtttcttcatctgtaaaatgggaatgttaatcattagcattattcaatggattccatttgaggattacatgagtaaagatatttcatgccctgaatacagcatctgacctagagcatgtcctcaagaagtgttaactagtcttatggttatcatcctttatactttgcttaggacccactcatgtattactagctctgattatggtgaaaggaggcaggaaagggagagcagttcaataataaagatatagagctactgctattatttctactactgctactattaatactactactattgctgctactagtgctattaccattgttgttactatgatgaatagctgccatgagtccaacacttccaaatgttggtgcactaaaacttttacctacattttatgatttgctactcacaagaacacctgtaggtaatttctgttattatcgggctctgtgtatacatgggaaacaaaatagataagtaacatgctcaggtggcacagccagtgagaggagaggcaaagccttaacaaaaaggtctacttggctgaaggccagtgctgcagggtgcccacctcataccctcccactttaaggaggcagccatatcttgttcattctccatcaaaacaccccaagttgcagtgttctaagcagccaagaaagggaaaccagcatcgcaggcatttacaaaatgcaccacttatgtgaatgattagcagaaattcaccccataacccttgcatctcagctcaccctccagtgtccacagctagaaattcagtgtgcctaaagtctaataaggaacacaggcatggccaagtatggtggctcatgcctgtaatctcagcattttggagggctgaggtgggcagatcacctgagctcaggagtttgagaccggcctaggcaacatggtaaaaccccatctctacaaaaaatataaaaattagccaggcagatggtgcacgcctgcagtcccaggtactcaggaggctgaggcacgagaattacttgaacccaggaggttgaggctgccagtgagccgagatcacactactgcactccagcccagcaacagggccagaccctgtctaaaaaaaaaagaagaagaacataggcatacctcatgttattcaactttgctgtattgcactttgcagatattatggttttgttttttttttttttttttttttttttttacaaattgaaggtttatttttccattgctagagcacaggcagagtagatttcacataattcttaatgcctatgggattttcagaatgttaaatgagctttgacttcaacttaaagtcaccagctgcattagttccaacaagaatcagcctgtcctttgaagctttgaagtcaggcatttacatctgtttacagcatgatctactgaatattttaatcctgctgttgagacctactgctcagagaaaaagatttctttcaagatgttactgctcactgataacgcacccaattattcaagagctctgatggagatgtataagatgaatgttgtttccatacctgctagaacaactaccattctgtagcccatggatcaaggggtaattttgactttcaagacttattacttaagaaatatatttaataagctatcactgccatagtgattcctttgatgaatctgggcaaaataaattgaaaaacttctgaaaaagaatcgccattctagatgctaataagaacattcgtgattcatgggaggaggtgaaaatatcaacaggagtttggaagaagtgaattccaaccctcatggatgactttgagggctttaagacttcagtggaggaagtaacagcagatgtggtggaaaaagtaagagaaatagaattagaagtggagcctgaacatgtgactgaattgctgcaaactcatgatcaaacttgaacatatgaggagttgcttcttacgggttagcaaagaaagtggtctcttgagatggaagctactcctagtgaagattctgtgagcattgttgaaatgacaacaaaggatttagaatagtacataaacttagttgatgaagcagcagcagagtatgaaaggattgactccaattttgaaagaagttctactctgggtaaaatgctatccaacagcatcacatgctacagagaaatcttttgtcaaaggaagagtcagtcgatgcagcaatcttcattgttgtcttattttaagaaattgtcgcagccaccacaatcttcagctaccaccccccgatcagacagcagccaccaacactgaggcaagaccctctaccagaaagaagattaaaactcactgatgactcagatgattactagcatttttaggagtaaattattttaatgaaggtatgtacacacttaatagactacagaagagtgtaaacctaacttttatatgcactagaaaaaaaatgtgtgttacttgctttattgcgatattcactttgttgtggtggtctggaactgagcctgcaatatctctgaggtgtgcctgcaaaagatctttgttttgaggattcgcagagcaagaaatgccacttggcatcaattaatctcaggaagtgaactaaatgccctgctacaacaggaacagaaaaagctcgccttgaagacaacagcctaaagcaaaaccacaaatcccttttctagcaaacctgctgtgaggaagctgatatcatattttaaagtgcacaatttcccttacaggcaaagacagcaaatcccagttccttcggtggcactgggttcaacgctggacttcagaaatttacatgaaagtacaaaaaaccagccaaacacacaaaaatgttatgaaaaaggaaagttacaaaatggctagaaaattgcattcttttctctgcttgattttcgagacctcatgtcttatcacacgataaggccttttctgtcattatgagcatcccatccaaattaagggcatcctacagtggtctccctgggagatgagaggcttgattaaaaggaggtgaatttctcatccctccacagaccttttatccgagctgcaaatactgactttattgagcatctattatgtaaggcaccatgatggggctaacaagacatttctcagacttcacagtttggctcaagtgttcctcataaagccatcatcctgaacagccagagagactgaagttattttcccttcctgggaacttctagagatgctccttcggcaataataatttccatgtctgttttatccattagatggtgaactatttaggggcagggatctattttgctcttccatgtatttccagaatccagcagaggatgcaatcaaactaactaaaggaactgatgaatcatctctagtccccaaacactcttcaagcagtcaacagagactcagcaaacctttcgtggagatccaaaacgtgtgcagtgagaacccatttacctctgatatcttgcaacaatttgtttttgaacaatcagggttcttgcatcatttttcatttacagggactgcgtatgaattaggacacagagcatttgctataaaaagggcattgtgatgtgaaggacaaccctaaattatgtctctaaccagtcaaggctgcctgaagttcgcctggagccagctgctgtaactaatcagcagggaggactcatgtcagtggtcagacagatgttcttaattaagcaactatttggttctccagtgcaaagtctgaacacttcttagagatgggcccccatcacttcaagctcctctcactgttctgattcttcaaaagagtggttctcaaactgtggcccagaccagccgcatcagcatcacctggaagtttaacagaaatgcaaatttccaatccccaggccagatctgctgaattagactgtgtagggctgtggaccagcaagctatatcttaacaaagccctccaggtgattccgacacctgctaaagtataagaaccaccactataaagttttgcccagatggagaatctatatggcttcagtaaatcctacccaagttagcaattgtcaacaacacacagattataaggctgtagttctattcagcaaagccaggactacagctagacaagagggtgcctagggtgcaaaattgaaggaggcgcctcacattctgggtgcctactctgattctctgtgactctgtggaactcgaggcattgtgtcaacacttgattcttgatggggatttactgactagatgctgcactaatgactctctcttgctgacttctcttcccatgagctaatcagcaaataaatttaaacaagcaaattaaatactagtcctcgcaaagtgcaatacttacaattcagtgttctacccttctttaacaacatggtatctagtcactaagaccttgagcacaatgttcaagaatatcaggccacacgggtctgtctgagcctgtatcagacacagaaggctggattaggccttaggtggtctcctcaaaaggaatcatagttgggtgttcagcaccataaatggttccaactggatctgcctcattcttgggtgccttggctcctgggtgattactatttcctgatacttcctgaggctttgcagagcaaatcctggctcctgccttaacacatccttcaacagggcttccactcttctgataatgatcatcacccccgagacaccactgcccaccaccctctccccatctcccacttgacggccatccctggagccacactgacaaaactctcaggccaggctgtagccaccctggcagaactagggtccttttcaatttctctgcatctatctacttgcattattttccctgctgccacctaagatgttatctagtgttaggcagccagcattctcagaagaaggaaatggttgcctttatgtttgggagacagcctgggagaaccaacacgttcatcagtcctacaggaggttgtacaagatgctcttgacacaagagggcaaggtcatgaccatctgctgagcatgaacttgtccagggacctgtgtggtccacccaagcctcagtaccatgacaccaactacttttttcttctccagtcctgggggaggcctgtcatatgctatcagtttgtgcattaagagatgaatttacttagctaagctgtccctgccttccttctttcttttgcccagtggaaggaattgtgagggtgacttggctcagtccattttgccattttctattactaaaatctttcatgctagcaggctctgatgtgagaagtcctaacaaaatgaccccacgaaaggtttgagtcaaaagagaggtgatgagacttaacaagtagatgagtttatttcacttaatgaccaggagatgcccaagaggataatctgttttcctcaaatcatattttgcctcccattcaggaaactaatgtctaatattttctgggtctcctgacatgaaactctcctcaaaatgttcaatttcttttttctgggtgttgtcaattatccttgccagcccagctgggtgctatctgtgtaaactgtccacctgatacatcctatgtaaatcctaactttcactgaagttttcattgaaagtttatagggttggtaaggcccccaaattaagaactcttgacctagctatttagagacaaagtctgtgctccccaggactttacaaatgaggaaagatgtagctatccttacaaggcaccaccccactaagtagggagaattgggccacgggtgcttgatgattttagaggaaaactaggatgattttagaggaaaactctaggtctcaggactgatgtcaggaattacgtgtgtccttgggaaaactatgtatcccagtcctggtctactattctacagcagaccctgaatggcttagcacacaaacggccttggcagaggctggggttgagtgggccttctatttcacacctctgtgcttatgtagtgtgtgtctcagaaatctcctgatggaggactcccaacccttctctctgctgccaccagtgattcccccaaaacacaagttaggttaccgcctcctcgaaaaccttcaggggttccctaatgcctatgacaagcaaaaccttcatgactgggtgccagaatactcttacattctccactccatctaggccactccaaagacccctggctatagccacacccaggcatttactgtggtctgagcactgtccctatgtcttccatcatcctaattagggaaaacttacctagatttaccagactttacatttctgtacctcaacatactcacctgtaaaatgggggcaagagtaataactacttatagagttgtagttaggactcagtgagttacaggcatccagtctcggtaaacctagacaagtaatattattagttgagcattctcctcatggtatggaactaggttcaataagacctcctcctaaaccaggctcagcctcccaaaccagaggtaatgacagctctttctattctcacagcccatgctagtggaacccccagcttgttcttacccaattctgtgtttttatgtgcttgtcttctcctctgctaaactataagcattttgaaggcagggatctaatctaatctattagactgtgtggaagttctttaagggatctaaagtcatttgggtgctagactttagattccttaaagaacttccatgacaacttgcacacagtaggctctcgctaaatatttgctggatgggagctaatctgagaaaaagattaaaagcaggcagccgaagtgcacagactttttggattccatgtgaggattcagtgtgagaacccaggtgtttactccataccacctacccattggagaaatctcatcaaccaaaaagcatttgtacgtgcaactatgtggaggtggctctggaataaactgaatgtgattgtaaccagggatcctgaatggagatttcaggaatccattaacctgcttcaactgtggtaaaaggggatcaagtgtactttttattttttcctagaaagacttcctagagagttttcattgaaggttcatagggttggtaaggcccccaaattaagaactcttgacttagctatttagagacaaactttgtgcccccctaggactttacaaatgaggaaagacgtggctatccttacaaggcaccaccccactaagtagggagaattgggcaacgggtgcttggtaattttagaggaaaactacgggaggctccttcaataattccacagtaagagaccgggaaggaagggaaataacaggcagagagagccggggacttggaagcctccatggctcacacctcctctgcgggtgtggagccaaatttatccatcattacacgtgtgtcctcagcctggggcccagacactcgccattcagctctatctggacatgagggttgttttctgttgaggtgactcaaaaacatactacctcaggatccagatatacaaaacaaggctgttcacctaatgatcgtgcagagttaagtgacacttaaacactagggtaagcctgatacaagaacaaagggaaggaaaagaccattagtgcagagtccccgttgcatctcctgctggcagatgatttggaaggagccttcacgcaggagtctgttttatttgcagaagccacagtggtaaattacagcccatcctagcccattctgggttctccagttcctcttggagctattcctgtcactgcccataggccactaaaacctgcccgcattcagaatgattgattctgctcaaactgcaagtcacaaactcatgtcgaaaaatccacttcaaataagtcattagcttcctttatggatttttcaggtcatgaggaataggacctgaaagtcccatttactggagagtagaaagcaggtgtcggaagaggcgggggcaactggaaaagccacagggagctgggagagcccttgttttctgccaatcaacaaagggggtttagcaaaaatggacccatgacttcattgccagtgccagatattcaaatgtaaaacaaagggccctgaggtctttctgtaaactggaagtcaagggatatggagagagggctcaggaggggtccatctttgctcccaggtcagatggagaatgtggagcacctgggacatagaaagacgtggtaagggaggagtgtctaagactttctcacttgtcatgggatggcccattccagctgggctgcgaagggagaccatggtgggctggtgggataagacatcccagcgacaggaactgaggccttagcagcagcccaaaggcaaccaacatgagaagcccgagttctgtagcttggcaagtttccactcaccacctgacccacgtttagcaattttgatgtaccatgaaacagacagctccagcccaggatgactgcctccctcagcccctctccagcaacgaatgaaagcaagatccactttgaaaattctcccccatcatgcaaactgacacaggcatgcttttcaaaaacccacagccaatctgttgatcattacttatttacaaaggccttcgggcagaaagtcctgtaaaaaccatacttgatacgatatacactagctttttctgcttgtggaaaaaaagtccccccaaggctacctcaaaccatcactttctattgcacataaaatgtagcgtgtaacactaaagtatttaatatatatggtataatatatctacaggaaaggcatttgtgtagaagtatgttaccctggatttggtaatttgatgttttgctgaaggctacgacttaaaaaagcctccacctcatacagaagacctgtcatcttggtacccaagagccaacagaataaagaagtacccttaagcagcaaaactttgacacagctttgaagcatatgaaaacagtataactcctcagaattattattactcaagatcaaagaaatgagccatactttacatagcaaacagggacagggaatttggctccaaaggtttcagatttttcagacttctctttatttatttatttgcttctctaaatttaggtgaaggaaagtggctgggcttttctctactttaaatgggaataactattagaattagataaggtgattacctaaaggtgagtaaataggaaatgaatgctagcatgacactggcatcataaaaacgaaaagcttggcagttggcacattttattcctcctcataaactgtaaacaagcatgcaaatcagccaaacccaaggaaggctgggtgaagtggaaggcagagaacttttaaggaaacatttaacaggaatagatggtgatatggaaaaggagttgggcagggtgagtcttccacggaaaacctgtgtcctcaaccacatgaagaaagactgcccttgcctattttccagaaaggtggatgtggagggccaggaacatgcaaatgttattgaatatggggagtggaaatcaccactattctatttcaaaaatcaaagccggtggccatgaaaagacaaaactaatgtcaagatggcaggcatttccagagcagaaaccacatagggtgagcagtgcaaatctgaaatcactcctgtttcatttgggtggtagagagtcaggatgtcggaggaaaaaaatgctgggattggcagatgaattgaagacaaaaaggggagataaaagacagataggccaagaagaagaaactgcagaacgctgttgaaatttgacttcacttgctatttaccagaggaagccatagtcaagaaagaagtgagggagaaagagagagaaggaggaagggagggagggagggggaagaagggaaggaaggaaggagggaaggaaggaaggaaggaaggaaggaagggaggaaaggagggaacatgtacatgcatgctgtatttcataattaatattgcttttagcctgagcagaactggattacttttgaactttgctttggcaagtccacagattattagactttttcttatcagtcaaaatcaattaacagaaatttgatttcaatcgacaggataaaaggaaggtaatcttcaggttcatttttgattgtgatgatacatctcacatatggccttaagtacagaaaacagtcctcggagggactccagcagaaagagactgccgcaggcaaactaaccacacgagtttctctgattggttaccgccatcattagtgccactgctgtttaggaactacacacagacaggacatggtgacagctaagactttaaagcctatgtatttttcaaacagcttttcaaactgtttttcatgacagaattttttcagctctatcattaactgctgacaagctgacagaataaatactccagcctttaagaagccatctaacgatctcgctcccctcccccaccccgggcttgctggggaggggagactctgggcctggcagggtgaggagagggcgaggggaggaagagaagggctaagagggaaaccgtgggcaaccagcccctctccttacctcatcagcttaggcgaggtgttgggtgagttccgcatgcctccattccgttgctttttttttggtgatagtgttgacggctgctcatcttcaactggaaatacaggcagctcatgagattatgaacagtttgagggcagactgtgcaatacaggcaaaatatcaaaggacacacactcaaggctcagtcactcactaggaattcatggctgtcttttaggacccaatgacaaagaccaaatgtgttagtcaaagaggccggcttagagaaggtgaaggcaacacctctttacactccagcctttgaacatacactttaaacagactaaaacagtttgtaaacaccctgccataagaaaaaaaaaaaaaaaaaagaaatcatgatttatctgtataccaaaaaaaatacttatcattattcttagagttaattttggttactttgctttgcccagtaatagactgcgttttgttgtaaccaaaatcagaaataaagttgtatttgaaatgtcagcataactgccagcctgctgcttctccagatgaaccaacttagctggttcctaacccctgcataccagagaaagagcgttgaaaagaggcaaggattcaaggccttgacagccaatgtttcaatcagatcggggcacattggtgcatgctggctcaataatccccagcccaactcagctcttatccctccaactgccaggagggagggcttgtggggctgtgccaacggggtcctttttcaacccatgaagacaggagcaccggggctggtgaggttggaggagagccccggaatgaaggaggaggttgccattgaatgaaatctctgatgatgcagcagcggggcagggatggagggcagcacaggggattggaaaccaaaagctgttttccaaatgtctaaaccacacagattgctaagcaatgtgaagcttcacttagaaacaccacagcacactctactgctcttgcccaaagacacccactaataagctttgcagatgtattagcctgcatcatgcttctttttaagagaactgcttgataattagcagatgcaaacccagcctgtcacccaggggcatcagcggcaaaattctagtcctcctctccccacccccacaattcaggctaaagctgtaatatcaagaaggaaaaataagatctttggattcttatagttgactgcaacacagactaggaggaaagcaccctgaaactcagaatgcacagcagttaccttaaagctaagaagagaaatattagcagtgatgacatcaaaagagacttgatatatgttaatggtgtaggagtcttagatgggggagaaagtgccatgtcagctacttggtattatccaggaagacccatattagagcatgcattatatggtacttccctgaaaacgctaaataaatttagtaggttatgatacatgcttccaaagctattttaataatccaactaccctccaaacctgcttcaaagtattacacattttacactctcctattctgctgtcagtttgggcttgtctaaaccctggctgatgcaggaaaagggaatgactgtggtgtaaggtgagagtgagaccagaagagatgaaggcaagaaagcacctgcaaacacccacagccgaccccctgtaccacctgcttcctctgacacccaccagggcccaagctcaggccgagactgtatcagtcatttagagctccaggcagagactatgtggctgggatgatatcgcatcttatcagaaatgagtatccaaagcaaatcacacagagactaaacagcacttaaaagattaaaggaaataaatacaagccacataaatggtattgaaaaaatcacttagagttgatatgcatctctcggcaagcaaacaggcactctgagcttgacctgaattcatcttcctttcacaggataggggaccaggcatctgaggcaataatggggtagaaaggcagcgagggtgtgtgggtgtgtgtgtgtgtgtgtgtgtgtaggtatgctttcgcactttccccatcttagaatgaagtagaaagtcttgcactaactagacgtataagacaaggtcatcttttaatatgggccacttgcaattggtgtattgtgttcagggtgacctagactggttgtgtagcatgctggagcaaataacacgtgtgtgtttgtgtgagtgcatgtgagtcactctagtcggggtgcaagttctgtttttctcatcttaaggttataattcagttagacttcttaaggttataatcccacatccaaaggtttttatctaacctagtctaccacggctagcatttttcaaggtcaccagatgctaccatggttgtgtccagttacacaatgaatctagatgagttaagacctgaacagaagtcatcctccctagcatgcctgtgggattattttgctgagcattggcttccctttttgcattgggcctataacaaataatcctctttggttaagtggccattatctttacaccttgttgctacactgatcttcagatgggagagttgcaagttaatacctgttagccagctcaagggagacacctcattctggtagtaaagttatgcctcttctatgcaaagaaactatttattttcattgcaactcagaaagatcatccatcgtaatcatactgcatttaaagtgggatttgttctccaaaatgaaacttgtgtttaaaggtttcctcctgcactcacagcctaaaaatgcagatctgttccctgaagagatgggggaaaatgtctccagcttaaatatatgaacgctgtgtaatggagaccattacatatggcttaggtccctcaagagaagcagtgataacttctttctcataagtaggatataaaccatatttaattatcagcctttatatggatcctatcaatttctgcataaagaaagcagatctaggaaaacttttagttaagctataaaatataattttcatttcatggcttctgtgactacatgagaggaataaaaatggaattaaaagggagacttaaatttactcactttcatgaaagacaaacgtgttgaagtagtgggccactacctcatgacgatgcaaatttacaagctcttatttaacctacattttggctaattacaatacacctccatctatggcattttcacttgccttcatgctgcggaagccacatgaagatatgatcctttaaagaaacctgacttctttagaacacaaacaagttcaggaatctaacgtggaattttataggagctgaactccatccagtctccaagtactcataaaattcaagggcttgtttttgcacatccctaagtataacacttaatgtgctgttgtaacttcccagcgctcccttgtctaataggcactgaatctaacagttttacagtttgggaagactcagtgctagaaaaatgtcaggcaagtctaatgaggcttcagatcccctggtttgcgctagagtttaatttaaagttacaatgatgttttaacatgtttgcttatacttgactaaagaggattcgttatttcaatgacataacctccagacaatgttctgagaattgatttaagatgtggtggtaattccaacagccttaatgcagagttgaacatctgtaacaacattttactcgacttttcatcagcattctgttttcaagcaaaagcaacgtcttccagaaacactggccagaactctgggcttacttcaaaatgattacatatttcactagatttttaaaaaaagaaatatcttcctttatcagccgcgccagactgcaaacactgtgtcagggtttaccaagcctctttatggtccttggagtgaaatggggcaatgattgcaactcccagccttccctaattcagtctaatgcctgcattagatggacctgatgctcagctctagcctggggcacattccctctgccctgtttccccagtgagatttaaggggatgatgccctttaagatttaaaggtgagtttattggctggagttaaaaaacagttcaaagcaaataaactcagaaacgtaataaaaggcaaacaactcataaacatgagtcaaccgctatctccattatgttattaatcaccacatctggagaaacccacatctgtacacacttagcaggtcattagtaatgtcatattcacactggagtcactcagaataagagtcatgcaaagtggtttgaacacaaaggcatctagctaacagggcttccgactgaagtcttgcacaagctgccagtttgggggtgaggtcgttttaattattattaatcgttttttacggttttcccttttggtattttgctgcccaacaagctaagtgcaagctgaaatccacagtagtgcatcgctcttcttcaactgagctcagcatggtaaagtagaatgttgagggctgcagggtagttattaaaaatgggaatgggtcccagtcttccttcacctggctcggtcacaagccgagaattgggagtctccttcttgaactcaaatggatctttggaatagcgtgatctagctgcaaccttgactgccaaacaataaggagaaaagaaaatggaaattaatccatagtgaaatttcttttagaaaagttccaaacaattttaacattgaatagctttgaatcaaactggaagtttctccctcacagctgaattgccatttttttccctttcttttaccctgatgacttcctgcaattctttttgccgtcttattgtcatctgtatcagtagggataatacttctggaaattcagaagacaatcttcttggtataatttccaaaaatatactgagttccccgtcaccccacaacatgtacagacaccgaaaactcagtttagcagcaggatcagacccattctttcctgaagtctgctaaaacaaattctactgaataatcattatattccgagtcatcaatccttggtgataaacttttgctgtctgtctcgaactgccggcttggtcagcccccttagttgtggtatcagtgcctaacattaaatgccgtgagtttgccactcctcagaaagacagatccacggcatttccttcggccgtcagcgacaccagtgaaaagtgggtgtttcaaatgttgttttactaaaatgaagggtatggagtgatggtaaaattcctggaattttacaacagtcgtgttgcaaaatgtaattcaccatgaacaaaactcccaagctgacctaagctctctctgatatgactgtttaagactttcaccagaaagtttgtgcaagttaactctcaaagtcttacggcatggccacaagagcgcagtctctggattggaggatggaatggtgcctggctgtttctcacacgaaccagacgggtaagagggtgtggttgtttccttaagcgatgatgggaaaacaaccacaaaaataataatacatgccagctgaacaacccatactgtgaatttggtagtatgattcctgtaaaggagcacttgactgctgtttcgggatggatcccgtggtggggaatgccatgtgtccatcgacgaggctgagctattaagcacagctaggatcaggcaagccaggcaatggagccaagttctacgcccagagagtagtgggcagtatcagggtgcaggggagttaaagtgggtgatgtccttggaatgagagtttcttgcctgacaaccttgaatagcacatatcactaagaagtttgataagcactgcagtattcttcataaaaatcaactataaatctattttttgaaagatcgtggctaatattttctttttctgagacaaggggtctttgttgcccaggctggtgtgcagtggtgttatcttagttcactgcaacctctgacatcacggctaacattaatccacagattaggaaaagaagaaagatgctgccccttaaaagcaaccccaacgatcataatatctcaaacatatacacctctctaaaatcaaacaaccacattatcatatacattattctggcaggataatttcacaacttctagctaggaaataggaaacacatttacttggaaaacctaatgggtatcagtttttaaaaaatctatcgttatgcagaataagaatttcaaaaaatgtctaagtgacctgtactgccctaggacaggcatagggagtgcccaccccatggtaggctgccagggcagggaagggaggcttgttggagcttttgcatttctggcttttgtggagctaataggaaaatggggagggagactttaaggaacaataggttatgtagaagttaatcacagggtgtatttctggctctattcactgcctaggaaacctgaattgtgtaagtttgagtccatcaacacagagtaatgaaagaattcagctcctccataggagagagaaaaaaaatactatataaatatatgaacagaatccacatgacatggaatgcagtgttctctacaaaatactgcgggcctaatggatcctctagaatccaattgggtaaattagatgtgcccatgctacccatgccataggccctcaaccccaatctcaaactatgttctgtatgcatcctgagaggaactcagcatgtaccaaagccccccatatctagaatcgcagctcatatatcttcgctgtagacttgacctgttagaatcattgcccaacactccgccctgttcagtattcagtagaaaatccttttggaattttctggttgcctttagcccttttctttttccctggaatagactctctattacctcaagggcaaagaaaagtctcaagcaaagatcactaggtattagtttcttagagatgagacacagagatgaacgatggaattctaagaggaaatgcacaattgaaaagaaaaattcgagaacttccctgaatttttgctatggggtttggagaatgggaaggtactaggagatgggagataatttttactttacatccaactgggagggctggggaatgtatagaagtccaatacaaacagcccctcccaactttcctttccttctctccctactccctactcctgacaccaaaagccaactttcggctttgtggcaaaagttaaacctgactcctttaggttgccctagcacttgcagtccgcgtttgtgagggacaacttttagagtagggatgaaacctgccacatcctgggcaccaacagctgcttctttctcatctttctcaagttcaggggtcagcaaactgtagcctgccacctgtttttgtacatcacatgagctaagagtgtgtttacatttttaagtcattggggaaacaaaatctaagaataataatatttggtaacccactaaaaagatatgaaatttggtggctataaataaaattttatcagaccatagccacagttgttggtttaccagccatccctggctgcttccatctctaacgacaaagttgaggacttgccatagagaccatatgggttgcaaagactaagatattaactcgctgacctttgacagagaaagtttgctgacccctgcagtagtttaatcttctcacatttcccttgctttccagtctccacaaagaacaatgttcttcccaacctgccaagacagccaaataacaaaagaaatacccgtggagcccacctgaagtgcacagatctggggacattgggaggaacagaggtagcttagtgactctactgtccctaccacccaacctgctattagccctgctggtccgctcgtgtttgaggtcatgagtcaggtgagtttcacattttccaactcaagctaagttagattcatccacccagtactttggaaagcaaggcgaaccacatctaccgtgagcaattcctcgaagctgtcagcgtgtgctgccagtccaccctgcgagagccccgtacaagacaacagattaaccattagactagatatgttgaaaatatacagcttcaacctttccccagctagctcagagcgatatatagatgattatttcaaccgtcagctgccgcatagatttaaacctctgcacaataactcctggattcatctgccccttgtcaaacttgcacagctttagttggaggatacatggtgtggcagtttcactgtgaatccagaatgatccagacggctgctgtctctttgttaacaggaagccaaactgatgagtttgtaatgcatttcttatcaaaggtagtttcagaaaagaaaatgtgccccatcagtttggctagaatttcacatacacaagattataggcttaatcagaatatctctgttattttcttgaggaaatagataattccacatccattccattaaatcattttatgccaatgaattatgtatttatgaatttataattatccttgatttttcttccccttttgcagtctacttaataaaatcatcagctggagcttacaaagcaatagtgcttaatagatacaagcatgctaatatattttttaagtgaatgctgatctttctgagctgtgtgtctaaaatcatcattgtgaataaaagaattgtaatttccaacccatacatttaacaaagacaaagtggactgtaatggaatttatggagcctgtaaaggaactctttttctaagacggtttataatcaaatagatttggatttactgtaggtcaaatcaggtcccccgatgtgtatcaagaaaaaaatgcctgtaagataccaaacactgctcctggcaccctggaagggctcacacccatggctacagctgctagtttcctggtgtcctcattgtttccacccctagtgaattcagtacttaaatgtcagctttgaaatcaatatttatactgtcttcacttaaaattatgacattctgttcatcctggattttttaaattttgattattttgaaaatattttattttgatagtttgaaaatattgcatgaaactatcatttatcttgattcctgaggttttgggtctcctcttaaatttggtgcccagggcaaaagcttctctcacctcgcccaatttccagccctgaacaccatttctcaaaggtgtttgaggtactggttctgccaccccacagaactggacaaggcaaatctaacacaagacttatttcttttgatcacttcatgctgtttgcatgagattgttaaggaaggcccttgcaacaaacacttcctcgtggatttacaaattgtcaggcatcccaaggagtggagaaaagatcatgctgcctcaggaatctgagatttgccacctgcccagagtgagaaacagaaaagagagctggggtcaggtctctcgtggactttatttcacatcccacatcaaatcctcctggttaacacaatgttgatttacatttccactttggggtgaaagtttttatttgcttacatattttgacaccaatgttactttctttttctttccccccacccccaaacaggttcaaatagccatgactggcagaagatgtcaatcacatttcatttccattttcactttgctgtttacattctttaaattaatgcttgccccaatgattgtgatatttaaagaccagcctagaatctaattgtgtatatgtgaaactgttttctaaaccataagatgttatataaatacaaaccactattattattaacattattactattggctcatccggaaataccatatcttccattgagccaatggtgtcaagagccccctagaattctaatatatattccagatgggtgcactgataatttctttcaaactcagataaaggtaaaatgcatgggtttttagtgcaagccaggtgcccgacgaagaatattctgccagaacactttagaaatacagtatgcttttaaccttgggaggtaaggaccagtgtggattatgactttacactaaacacagcatttagtatatttcttaagggcataatcaccttctatagatgttcttgaactataaaatctttatctgtatgctatcataatttatcctcggacacatcctgtgcaatattttataatgctagtgtatggtgggcctttctggtcaatgcattggagaacaaggtgtggagtgcaacagaagggctggaagcggcttggggatgctctggcctcaccctcttttgcgtcatagctgcactcatacgcagaccctgacccaggacccaggtcggctgacttctaattcagatcatttgctgccagaattctgcctgtgagtgagaacagcatgaggatatgagcttcttgagtcagtccacctgcccaagtcccagctctgaccctctttagagctctgatctcagaccagttactccatacctcaatgtcctacgatctactgtgatccctactggaccaaggacaccaaatttcggagatgctttgggattatgtgacataaccagggggctgcaggctgacagcctgaggaccaactactgtccccagtgtgctgagcttggcaccaccctgctgatacacaggatttcacatgtgggacaatctttaagtctgaagattgtccatacaaatatggatttctaacttctaattaaaaatcttgtagaggactgagtcttcattccaaaagggtgccattctcctggggcaggagcttatcagctgctcaaatgccccactgctgcctactgtacccccatatatagggcagacaccccatgtttgcatttctggccctggaaccagtgacactcaagtgtaccatccccgaaataaagattttaaggcatgggatatccctccacaaatgcctactcacattgagtgggtagagaggttaagagttaaccacacaggtcttaaagccacattgttgggtctgaacctaggtatttggcaaattatctaacttcagttttctcaccaataaaatgagaattagagtacctatctaataggttgttgtgagaattgactgaaaatgtgaaaagcacttaaaagaattcctggtgagctctttctaaatgctacccatgattattgccttggctttgaagagtcagagcaatgagagttctctgctgctgggtccttctccacaccagtctgccacatttggacatggtgtaattcacatgggtccatactctctctccttccccaagcaattgagccgctaaccaacacttagaatggggtgagcattcccacccccacctgacccctagccttgcatctcattcaactgtcacctttgtcccttgtttcatatggccccaatgaagtgctcaagtcaaataattaggttttgccaaatgtcataaaaacaagaaaagccagaaaacgtttaaacggacctcaattggagaaggctggaaccattcagggcaagaacaaatgaaagacagatggggacagaggaaccccactgtttcctctaaattacaggaaattcacgccgtctgattgtgagggcctcttttctttcccttgaatttctgctgggaggtcatgggattgatcggcgtgtgcagacacatgggagacagaagaaggggcagaggcatggcggggtagagaggcagtgactccttcaccaggctctcccaccatgtcttcctttcacctgactacttgaccacccttgaagggacagcctaggctgcctcctccagggggccttcccagatgattatgacaagatcaattctctcctttctttaaaaaatcccctggcacttctgatctcatgccttgcattattataatttgtgttcaattctaatgtgttctactcccccagctaggcttataagctcctctgttggagttcacatatcactgagtctctcacaatgctgggccctgaaaagttcccaataaatagctccgagcagctacagaggcgatgttgcaaaggggagaagcacagcttagtgatcaggagccccggggttctaggcctgccttggatcaactgtgtggccttggcaagacacttccctttcctggggggatgagcattagttaagtatgagacccttctggctctgatttgtaatgactctgagtttaatgtcgggcatacctttttcttgttcttttctttaaaatctttttaaagatgcacaataagagagaaccacaagcctagccagagaaattagataattgcattaaatacgaatatacgaactcataagttacataaatgcaacagtacaaaagatgttgcatgagaatgtcaagggagggctacatgaaatgtcttagacaataagttaagtcctagagagagaattgttcaggaaaaaaaaaaaaaaagaaaggaagaaaaagaagacgacttgaaacaagaataggatgaatagagaggtcccgtatatccccagatggagcacagggcctggcactcagggggcacttgacccatgatgctgaacagactaaggagtggcagtagagggtgggaagggcatgccaggtggaggacacagtttgaaccaaggcaaggtggttggaaaatactaaactgtataaactgtaagaaagtcaatttggctagagcaggaaaatgtgtttgagggcacagttggaggtataaagggcagagagtgtaagcgtttacattccaaatgatagaatttgcacaatatttagtaataatctgaagcctctgggaaagctatttttcttctgatttaaatactgaagttcaaagaggatagtgggtgggctttgcatcttgcaaaagtctatcagaaactgcctagctcgctcagcccactttcctttccaaggtaagaaacacacattcatgcatggaaataaagcagggaggcccttggcaactgtccagttccattgaagttctcatttttcttttttttctggagagcttattcaacaggaaaataaagttatctaatgcctcagaaaggggtcccgtgaaactcacaaggcctattcctcacagcccagccaggtaaatttaccctgatttcaggatggctatttcttgtcttcaactactccagctgatcccatcccctctacagagaactggaaggaaacccgtcagggtttgacttttacatgaaaactgactgcaatccatattttcaaaaaatcattttcaacaaaaccagtgctttaaaatagattcactgagaagaaaatgtttccccaatcctctcctccttgattttgttgaatcaataacatttcaagatgttctctgtgaaaatcacatgggtgagttaaataagaacatacattacattatctagatcctcaacttgcagcccttagcgcagtatgcctgagaaaagtttaaaaactcaaaagagagaaatcctattcaaagagtaaaatactgcctatgcttccaaagttctttacggcctgataggtagaaatttaataatgaagggctgggaatggtggctcacatttgtaatcccagcactttgggaggctgaggcaggtggatatcttgaggtcagttcaagatcagcctggccaatatggcaaaaccccgtctctaaaaatacaaaaattagctgggcatggtggcatatgcctgtagtcccagctacttggtaggctgaggcaggagaatcacttgaacctgggaggcagaggttgcagtgagctaagatcgcacaactgcactccagcctggatgacacagtgagacactgtttaaaaaaaaaaaaaaaggaagaaaatttaataatgaaaaacataaacaaataagtgagtcatcctgagacatatttcaattctccccttctgtaacctcaataaattcattttctcccacataagctaatgtttgcactaaatattctgtacaaaggaataccgcagaccataaaaaaaacagtaaaaagatatagctgtgtcttttttaaaaaacggttgaaaaattgggtatgtgtggacaaaataatttttaaaaatagttttgcttgcacatttgatttctctcttcatttatgatgccctagttgatgagctgatcaacttttctgtgaaaagtcttcctaaaaaacagaacaaaacttaacagaaactctgatcctgtttgtcaaaatgtagttctggccccgagagaaaggcaatattctttggatgacttggattctaaagcaactcttttattagtattattatttactttttttttttgagacggagtctcgctctgtcacccaggctcccaggctggaatgcagtggtgcaatcttggctcactgcaacctctacctcccagttcaagcaactctagtgtctcagcctccaaagtagctgagattataggcacctgactaatgtttgtatttttagtagagacggggtttcaccgtgttggccaggctggtctcaaactcctaacctcaagtgatctgcccgcctcagcctcccaaagttctggggttacagacgtgagccactgcacccagcctggattctagagtaactcttgatgaaagaacatcatactaaggtgatttttatataaaacattaattcagtatatcaatcagtcactttaataaaaatgcccctcattatcctgaggtgaatagaagcctatgggattaatttgtgtaaatagatattagattaaaatgggaacttgccacataacaataatcagatagcataggcaatccaatctcagtgctgaatccagtattgtgtgtgtagttaccttttaaaaacagtaacatgtatttaacttggacttgcttcaagtaagcactgcatcaggcaagttggatttcaaataaaccttagcaattgaggggcattgtcgtactggaagtatatctcttcaaacaacagcaacaacagttttagatatttattttagagaaataaaggagacaatctgcaagagaaaaggcagaaagtgaggaggaggagagtacctagaatccaggtagagggtttatttctagaaaagcagcgccacctgctggtggacctgcatgtcaggcccttctgcggcttgcaggccatctgtcttgcaatctatgcataaatacacagcagtatttctcagctgctgttatacgtaagaattgtattaccagtaggcagatttctaacacactggttgtagtttaataatcctatattacctgaagtatgggttatataaaaacctagaatgttaattgttgacaaaccaattctaatatgtaaagcactgtaagtcacccagtaaatacacaagtaaatcaaaagggatagctctttttgctctaacaacgtgttattaaaagccacaacttaatcacttacataaaaataatgttcatgaatttcgatgtactaagaaatcaggaaaatgcattataatcttactaacagagcttttccttcacttacaatttagaggaaactattttgcagaaaatatttttccctttctttaaaaaatgtacctaaaccaacatgccatttaggaaatttgctcctataacaaaacctagttacaaacaactaagattacatctataaaatgttatatttttaaaatagcaatagagaagttgtggaaaatatgtcactgatacagtgagcagagaaacactacctgtcatttttcaggaaaagatcacacaaacgcgatagcaaaggaacacaataaaaagcagaaacaggaatgtgataggtgactctgattgcatctgcaaaggaaactgtgaaataaattaacacccaagtacccaagaaaggcacattgtggcttcactggaagtgatcattatgcaacagagaaggttggtgattttgtaagaacagaaataaagtgtagcctgtgaaatctagtggtgataactaatgaccatactacttacaactctgatttgatctctaacataaaaaaataaaataaaaaagtactctaaagaatagatgtatgcaatagggattgtgtttctcacttgaaacaaataaacctcaaatgggatcaaagggccccggtaaatgaaaaatgacagttcctatgttgccctgatttgatctcaagcaaaactaccatgctgataacatagcaggggatgtgaggaaggcagtggagttcttggattgctatgaaaaggaggcgagtgtgtagcccattcagctgatgggaagcccattctaattccaaaaagttattgagatttaatctctaacaacaacaacaacaacaaaataactcatgcggcaaccaaaagggtatcctttaaaaacacacatacacaattttgttatttccaatacattctgtagaatctctttacattcaattcttccatctgtctaagctgggtaaggcacatgtgtgaagagaaccaaatgtcacaatgcttgctttgagaacgaagtgtctccagttatccagacagggagcttgactaggagggtctcaggcataggccatgggcatcccatctcccatctcagctggctaccactcactctggagagacagggtttccaggagcaattctggacagatgcaaagggtgaaggggaatctggtggggttcagggctgtcaagattcgagttgggggcttaccctgcctagatataactcctagtgttagcttgtgtattagtccagtgagataaggtctaggccattggctagggtctgaacaattaaaggtgcacaccctgccttaaatatccaaatttatttgggataaattcaaatcaataaggaaacataggtggatgaacagaagcaatgggtttgccatggcttcctaccccgactcaaatacccaatgacatatggaaggagaaaacatcagcacccccagatccactacagagcccaccatgtgctgtcagcagaaacaacggaacaaatgtgttaccttcagaagaagcagtgatcaatttgagatcaatctattcaagagttgtccagcagtcaaaggaattggctgttggctgttcagaaacaaaggttctgttcaagaaggtataaaggaacaagaaggaagaaaggaagatctctagccttgagacttttttttttttttttgcctctggttcagcttctcatgaaagacctttttccttgagatacatgcttaataaactatggaaacatattgtcaacagagtttacatgttaatcagccatttattgaattcacactgtgtgtcttggttactgtgtgcaatatgctaagaattcaaagaccaattttgacttctacaaaaacctcaacataaaaactgtctaatggggtttacatgaaatgttacaggcttacagaaaagagattcactttttctaatttggtttccgggtgggctagttaagaaggcttcacagagatggcagtacttgagctgtaccttcacagcagaggttggccaactttttccctaaaaggccagatagtaaatattttgagctttctgggccataccctttttgttacaattactcagctttgcagttgtagcctgaaagcagccatggacactgagcaaatgaatgggagtgactatgttacaaggaaactttacttactacaatggatggcaggccagactgggcccatgggacagtgtgctgacccctgctctgaaggatgggtaagttttaatctgctagaagcagagaggaaaagaatcacagtctcaggaaaaggttccagaaatgtgtaaagtaatgagaataagacgcttctagagaattgttagatgatggatgcttatgtggagaacggaactagggaaactggttgaggccaaactgcaaaggctttgaatgccattttaatagcagaaagttggaaattatcctcttaaaaaacaaggaaccatcaaaaggtctctctctttaaaatgggataacatgacaaagtctgtgctttagaatactaaagttggtggtggtttggtggcaagaggaactaattgaaaggttgaagggcaacaatggcagactagctgaagaagaaatgagcatgtgagcttggcagtgccactggcaatggtgagaaaaggttcgaaatgtaatctggaggccaaatcagaggacttggccatcggtaggaggaaagagagagtgttacagggtaaaactcagaatttcaaatgtgcatattgatactcattccactcatccctagacctatccacacatcaggtctgctgaaagaaagggatagtggtaaggcatgggtgaaaaacttgggcccagtcttggccttgctccaagcactcatctaattaattacaaaatcaacaagaaacagagcccagctactcataaagcaaggtaggaaaggtgatgatgtgaagtctcaacaccaactggacctcaaagatatggccagacatggtggtgcacgcctgtagtcttggctacttgggaggctgaggtgagaggattgcttgaacctaaaagttcaaggctgcagtgaactatgatcacaccactgcactccagcctgggtgacagaaggaggtcccatctcaaaaaacaacaataacaacagaaaaagatgagttgagatcaagaccatcatcaaaaaagaaattttgatggaatttgaaaggacaggaatgtcttctttccccatctgttctcctctttttgtgttccaactttccctccctctcccaaaaacacattgaatttgctgacgatctccagacctattttagggatggacaagccataaagaaggggtttcagggggatgaggaatgatgagacctgaagtcacagttttctaatgatcccaggacctaaggattctaacagctgggctaaaatctaagacacacatttattttcatccatcaaatctgtactattccaactaggaagcctcttttgcctggagatggtgtccccgtttggccctatatgcttcctgctacacgatttcattcctggagacctggcaataacaaaacaaggtgtaacaaatatgatgaggaggctctttggggaggtcaacagttagcattcattgtgggagggcagggccatttgtagagacactgcatatgaactggtctgggatagcttcagtagctgacaatgttctgattactaataacccccaaatcactggagcatagataataccaggaccccgggttagggagagggcctttttctgtgctttccttgaggaaaataaaagacaccttggaagaaaacaagctgacaataaagtagaaacctgtaagaatcttctgggctctttcggtgtgtccctgtgcgcccagttcctgccctagaagctgcgaactcacagacagaagactaacactgatatactacgaggtttctacacacataattgttcctcacaggacctaccacgatgttgggtaatagacatcagcattttagaaggatttataacagtaaggattgaagcaaaaaggacttttagcctttctcaatcagaagaaggaagataatcagagtctcagagtttaaaggaaacttagaaatatgaccttccaatttcctcattttacacacaaattttgcaaggcctactggatagtcaagatggaaatcaatgttctggggagatatagctgtctcttggtatttttgttggcttatttctgttgggacaattattccatgacctagaaattaaacaaattgactccatttaacttttatagtctgttatactaagctgttcaactctcagccactatctgtgggcttctctgcctgtagctgatatgacctcttataaggctagcttgatgacagtcagtcatttgaaaaaaaaaaaagcactagttatggttaaagtggcttatcattattatttccatcaatactatgggagatggcaagcttctgatctagcagtccactcatccgctatgtgatcttggtcaagttcatctctgtttctttgttaatttcatatgttaatgaaggatgataaaaataataattcaacatataccaggcaatctttatatatattcactcactgaattcgtgcaaccactctgtgagataggtccttattatctccagtttatagatgaggaagctaaaaaatagtgaagttctggaacttactcaaagtcacatggtagtaggacatgatgtctatgctggggatgcctagatgaaatgagatgatgttggtgccttgagaagcacaaagactcaaacacacataagacattactcttattatagccatgagcatctacttggtgaacatgtcaaagcatgacttcaccaggacttacttccaaagtttccagaaaattcacagatctcacccttgtatctgcctgctctgacgtttcctagaatttcaggctgtaattgccaacaagatctctcagttcactgcacagtgaggggaatggcatcagaatcccctaacatagagaggaggaaatacaggagatgtctgcctgtttcccatcttcatcttaatagaagatgtttgtgaaggagcagtgtttccagcaaccagccccttgcaaatttcacattcatgccctaacttccagaccctgtgacatgacctgagccccttcctccctgtcttcattcctagcatagttgcagcttttattttcacctagcatctctcttctctgcaggtcattgtgcatcccttctcagtaacatctgtttagggctttggttttgaagcatccctgctggatatgttctctcagttggatacgttacaggccatatgtggaaatttactcatctgcactgaagaaatggccagatcagccttgacaaaatgcagagagcatttcagaaccattcaaaggtaagggaatgcttggtgcagcctgagagagctttgagaacaatcaggaaaactcttccttggcttgagcagaacaaacagaataatggctcctaataggtaatagctatgagacattcagcttttggatacctccacgcgggaggaatcatttgggtgctgctgttgcattcaagctgcctacctcgagtcagagtcaaattaccctgaccgccataaaaggcctcgaatgttgctctacatttgggcaggttgatgtgcccacctgcagatgctgacacctctctagctacaacagactcctttcctcacatgagccctgcccaatgcattggttttatgctgccctgactcacaccaaaataatcaggtttgctgaaattaataaaactgaatgtgaatgtcacaagtccttgattttccagagcaaatgctctatatgtggtagtaaccctgccactcctcattggaagcattggtggatttttgcctatgtggttttttctggtactttgtttccagatcttctttcccataatttatccttcacaaagaatatcaattgcacctgccatttgatcattttctagttccttcagtcatgtccttgttctttcttactacatttttccctcttactcttcttgtacatcccagttttttatgtttacatatatatactatatagtaagttgctgcttagaaagttttgggaagcttcatggatctagggcgatctggcttctagcacatcaccaattcctttaagggttgggaagcccttcatttattcattcttttactcatgaaatatttactgaactggaatccttcaggccatttcctattcaagtactcttgccaatataggaagcccagccaaggatgtcagcatgctacatttttgaccttggagggagggaaggcagcccctgggtcctttcttgactgagtgtgatccaacaggctccagcccagaaagctgacattggccaaaatgaagatcattttaatgcaagcagtcagctcccttcccagaagatagcccatgctctatggtgtgcagatgcccatctatgcactgtcgatacagctggtgcagtgccagctctagggctggagtctttctcacttcatttataagtctctcagtgcagtcgatcatccctaatgcagatctgcctcaaaagattccattttctatttgcatagggttttctctgcagctctaggaacatttggtgggactcatcttgcggtattgaaggggctagaatgaaaactttcagatttactagaaaaggctgggggagttttttcttgctgtttcccttgaatatgagagattagctccccctgaggatgaccaaatgagatggtctgagaagaaaggccacttttgttagtcctgctcatctgagctggacatcaaaagaatgtctcctcagaataaaaatctgtgggcatgtgtagcaatctccctccaaagcaggcactatctagctatttacagaaaggcctttgcaattccctctgagatttcaaatgcaagggtctgacaatgctggatttagctctgtccatttagattccctttgggaaaaaggtcagctggggaagcagaacccctgtaagcagatgtggcgatggagggtcccctgactatccaggtaattcaacaagctggtttgggagaaagccccagagagagaaggacaacacacagctggttggcttggtgcattttgccacattgcacttccagaagttggcattctcagcatgcacagcctaccaccatgagggaacccaggactcaagtgcttttccatgcagttttaatgaccccctgaggtcaatggtgtacacaaatgccacaatcacggatgctgacataagtaaggacacagacaaaggtcttatgcacaaagcagtaaaaccgaaaagaaaattgtgcatgatacttagaaatgccacatgacttctttaggactctgtgtggcagtacttcacaggaaatgtgttttgtatttccactcgagaaggttaagtgtttgaaaactacagtggattttcagtgaatgggatgtgaagcactttattattttccccccatcgatgtaaggagacatgctgacttcctgagaaaggaggagaaaagtctccttgccatatacagggatttaaagaataattcccatgagctctaactgaagctaccacctgcagctggaagcaagagcctcagcgctggccagctgtccccactggtggctcccacttgctttgtgtctgctgctcagcctgagccaatacttcacaccagcaggtgagagctgcctgcctgtcaccttcaacacactcaagatgtaagatatatttgaactggggaagatgatgaggaataaggaagaaataatggttaggaaaaggaaacagaagcagtagatccccaaggccagtggtagtggatgcagccgagtgggtctcctagtcctgggtcaggggtcaggaaatcttcctccaataagaaggaaactctagcaaacccagctaggaatcacaatggctgccaggtcagctggggagaattaggctcatggaattcagctgctccagagccactaattaaactgtcttttaaagactgtaacttcttggatttgcatctgggcaatgtgcttcacctgcagggtcctgcagactatagatcaagtcttccttctgaaggcttctcagaacagctggggcccgcccacaacaggctcccctctgtttgtctcctccccgagaggggggcttccagctcccctctagtcagtcccttcctcccctgcagccacagcagccctcccaaaacaaagcctctgttaggtcacttccctgatcaaacaccaatatgatagtgtcgcactgtctaaagactttctatcatattacagactaagaacaaaacccttggcctggcccctgccaggaatggggccccattttacccttcaggggggtcaattccctgcatgctaagtaagtcttaaactctagccaaattgggtggccagctgctgtgcaggaggcccccccaggactctctacattatctcgaggtttcattaccagaatcctcacttttttctcctcccttggagattaagtgacttatccatcatattcaactgcaagagtaactgagcaactcaaccgactccacactctgtggagccacacggcctgtgttgaaatcccagctccaccagtcactggctatgagacccttggcaagtcatgagactgtgacatgaggctatgagacccttggccagactcactggctatgagacccttgtgccttagttgccttatctgtaaatggggcacattgcagatgtctcaggttatagttgcctcaactgcaaacagcagttaccacataataagggttaaattaattaatatttgtggtaatagggggagtagtgcctgtaatgcagcaaatgctatataagtgttaaatttaacaacagcaacaacacatacacacatcctccctgtgtactcagagttgcttgcacacagtaagagtagagactacactaattctagtcgtaacatgaatccaagttaaccaactagccatttcttagtaatgctgtgtcaacaagtctcactcccttggtgatgcagtatacacagaatatagatctctttggggagtgaccccatgctcagataagactaaaacatgatgctagcctcaaaagagaaacataatttttcagcaaatgttggtagtatgcctccctctgtctctcctcaccaatgagcatgacctgcttatgattactaggtccactccattctggtttccatttttggctgctctgtgcttgcagcttctaggcttcactgggagtcaaagatcccaaatgttaagatcgttttgaagagcatgctggcaaatgtcctaaatgtgctgggccagatgacaagcatccatctccgatgaaggaagtatccaactgaaatgatgggcaccatatgagaaggagaatcccaaggcatgatggaaaccacaggtgctgcagacccactgtccgtttctgtctggatggggaaggaaggcaggatgcagtgaagcctgtgccactgccccacaagcctctctcgagtgacttcacaccattattggtctgatactaatttgagacaatacccaatcacatcacaacaaattagccacagacacgtgatagcaatcaactcagggggcgatcctgaatgcgggctgggggattctccagctccgtgagccgcacgctcccacagatgtttctaaaagcgtcttcccagaggcccatttagagagaaattaaatgcaacttcgacttaattaacgttttaaatgataatgaatacaatgtagattcataggaggcatttacattgtgttgtaaaattgataaaaatttaataactctttgttaataagttatgtctccccagacccataaagcctaaggcgctgcaaactccacactgggtctaatcgaggctcctggtgcaggtggaggaaagaggcagagacggacttgacatttgctccaagcctgctctaattcaaacctctgcttgttcatcagtactttatttcatacagtaaaggtcaggatttgggctcaaggcagagccttgacaagaaagctcaagtggaaggcgggctggccctggcatctgtcgcctgagatagtggaggaggatggaagatgaggagctaactggccacatctgccctccaccatggaggtaagaggaagcattcactgcctggtggtagaagctgtcaggatgagtatcctgagaaccggccactgtcctgaaataaaaaagcaaacataatttctatgtcaccttgcataagggcctcttctgggcttacatgaggcatgccaacatcttttctagtttgtccttaaagagccgagtcatttattacagcatggtgtccctgggaagaaaggtgtcccatgatggggtatacacaaaggaccctgtcagcttccctcattctgacctttctccttcttgtttcccaatcctgtttcaaagaatttcttttgagaagttggctgccttttgcctactgttcccgtctcctttcatctacctgcagtacatcttcatagtgtattcatcttcaggaattcaaccatactctttttttggaaggtggtgaaagcacaacaaggtccccaaatacaagccagtgactttacctgacactcaactgaaacaaccagctatttattctggagaagaacccagtgtgttgggagctcttgacagatgagcgatgtaaaggatccttctcaaaggcaattttgcccaagcatgatttctgccttacaatgctgatttaagaagctgcccactgcacagagtgagctaaggcccacagtaaggcatatttccagtcaacctatggctcagcgtggctatcacaaaatcaagcaagaggcagtggcttctgtagcctcacctgctaccaataagagtgtcttaagaagccccttccaggcccatcactaggtcttagtcacaggggatgacccagtggctgcctaggccgatctgccactctgtttttacttcctgcaatgaagtacaaagggtcaaatcaagacgcatgggccagggtaactaaagagccaggggacaacccaaaggctctggtagtgtttggtgtgcacatgtgtgatggatattgacacagagagagagagagagcgcactcacatcagcacggcaagcatgggaagatgggagaaaatggagactcagacgaacaggctttaaaactaatacatgaaaaactatgatcacatcgattcgtgcttattatccttggctctcctttttctgtctttttctcactggtagtggtggtggaaagaggggagtaattgattttagggcccagaagtaaaataagcaaatagaatttaggtttggggaatttgaggaagtcacctaaaactgcacataaaaggaatgagataattataggctgttgatttttaaatgtagcttattaaattaactctcctttaacaggcgttggagactgtcaggatagggtgtgtcctattatagacattttcctagagctgtttccaccccctgcccttgtatctgattttatgtacttcaaaatgccattagttcacttaagtgactttagttctattgacaatgttaattctctgtctgcacaaaccaaaggctactcaggataagctgatttttgtttattatctgacaagactcgatattacactaaactgattttggtacgtctcccttcaacctaatcatattggacttctctcagcttaaccatcggagttgaatgccttcttgtattatatttatacccaaaataaaagtcatgtgtaatttaaaattagctacagtagtttgcaaaaggctgcatgtaattgtgcaggtttaaacaattagtaaattgaaaggttggtgtgagcaatcacacatgtactttagctaaagctggttccaagtgcaagtctaaaggtctgcttctcttctaccacaggattaatttgtttgtgccagagttactgatgctttgtgactagaatcatgtcaggcaggtctcagcaggtctgaatcagtatggccctacgttgccactgcatcataattttaattgtccctttctattacatttagcaatcagatagcaggcaagactgaaataacaagaataaacttctaaagagagagaaaggtccattttacaaaattatagtgggaagaaatcgtactgattggaatctacttctatatttatgtgcatgtgtatgttgctagacattcattttttacatttaatagtactagaacacagctacttgtgaaaaagccgaggcccataccatcctgatgtcttttgagagagctgggactcttgcccaggaccatctgaagtggaaacaaaaccaagatgatcataaaatgacactctatgcactgattctagcctaccatattgaacatttcagtcttgccagaaataaaatccttttgtgatgaatccttatcggtcacaatttgccttacttttctgacaccttttattttgatttttgtctttcctaaactagtccttcccctctgaagttcttttggtcaacacagtctggccttccatctcctcctgagttcaacagaagacaactatcataatagcacatgactcaaccgatccacagtaatgggccacacctccatagaggggtgcaccgagcaggcagcccctgttgttagaaggcaggttttcagaactgtgtgagcacttttaatatattaccattcctctgggaaccagctacttctcttcccacttcacaaaacacataatgggactttgtgtttcaatttaacatcccttgaaaacggaaatttttccccttataagaaaaaaaatagagtaaagagggaaacgaaaggaaagagagaaatgaattaggcagtctccaaagcacactggctcaactgggaaactgcgaccaaagcaagctccataatagtataatgacctttaatgagtgtcttgggaaacaatacagccctagcataaaagacaaagggcaaaactcatcatggctctgctgacactaattcaaaatgattttcagaacaactaaagaatgtaagagaagtaatctgatccgcccatctgacctcactttgattcaagggcccttctcctgccatttctaattgtcaaaccctctacatttcacatctgttcatatttaatgaaaagcccactctcaccactgctcttgagtcaacttgctctgtcaaatgggcaccacccaactccaccaccagcgagggatgcctggggattgctattggagcactgccagtggaatttcacatagagacagacatttttataattggagaagaagggcttatgcaggcccaaaaaggggctcaaattggaatggatttttctaacttattattaatggtcaaaggtgagtggtctcacacagggatggatgaaatctgcttttgtttgatggagtgatgacggcaggacgactgatgaaacggagaaggcaaatcgccccctgagctgtcaataccagttaaggcttcaacacgcagcccaaagctccacgtgttccctggtgggggctgattttggaggcaagggagggacaacatgccactcacagaatgtttcttagagaatgggacaatcccaccccaaggttttcttctccctggtctccatcaatggttggattaaattgcacagctgagaaatccctctaattaagatttctcttggatataatggaaattacacacactgggcaccatggggtctacatgggggacacagagtgtgctgtgattggtattgttggccagtgccaagacatgaccaaggggccctagctcagagccagagtggctcctttcttttctccactgagtctaggctaaggttttagagcctcatgattatttgagaacagaagttgtgcattaggcagaagagtaacccgggggcttgtggttactttcaccaccatcagtcaaagagatgtgaccaattcatgccacctcaggccctcctctgctcttcctccccagcacctatctttgaacttggtgtcttgctgcacatcgtagacagacaagttctctgtgcagctgtgccctagcttatctctgtaatggcatgcaaactacagataactcttcaggggaaaataaagtgataaggattcatatggtagcatctaaggattgtaacagaaatctttccaagattttaggcccatatggcagtccacactccctctcaatgcaacctccattaggtattactttgaagtgaatcctgtcccttggcactgctctggagcagcaggaaatcgtgaatcagagagaatgactctctggtcctagatcaaagttttccaaatgcctctaatatggctcgatgcacaaatcatgctttgcacttgaactttgggcccaaacataagcacctggcatggcacacagtgaagtcccggttccctgagccctagaggcctcatggatcccggctacacagccgcactctgctgggaccagcctcaacaccagcacaggggagtcaagccagttcattttccatgggaataaatgcttaagagctcagtgatcttcttcctcctgtcgtcagtgtacacctacccctgctaggaaagtgtagctcaaccagctctgagcacttggaaggtgagaggacagggagcaagaggttagcaatatatgtgttggctgctttaaagaggaagggaggaagtgcagaaacgagaaccatctcctaccttctatgctaccaaaacatgaaaacaaagttatagttatacttcaagtaaagtcctccagtggaaccacagccttttctgcacttggaccaagacccacagtcccagggtctcaaactggagctttcaggaacttcacttatgaaccgtatcaggaaaacagcaaagtccatggggaagcaaggataagggaggtctcaggaaactggcacatctcagccttgccagctaccagctgcatagccttgacaggttctttaacatctctgagcttgtggatgacaaagaagactgacatcagaggcctgtgctatggactcagggatatcacagaggtttctgacttaaattttttgttggcatttggaatcacaattgctgcaagataccttagttaaacaggggctatactattggaaaaataaaagatattaatggaacagtccttcaaaatagtcatcattctgagaaaaagctctgtaatccactagcccagtgcaggctgacagacatagaaaactcgtttccagaacaaaagacaaaatctggcactggaggaatgaggcacaggttagagagacatagtaaaaagaaaatatatatatatatatatatatatatatatatatatatatatatccatctgcatcaaaactctgttgtattttggaaactatctaagaaactatctaagctcactaaaagcaattcaatgctagagctggcttgttctcgctacaccctttccttcctccctttgatacaattcaatttacagccatttcaaaaatattaacatgtacacttctgcatatctctgtattaatacagtaggtgatatgctgtcactttaatttccatttatatttatttaaaggagagagaggaaagatatcaccagactgtaatatcacagtcctgcatgctgttacgagaagcgtaagttaagaaaatcagaagggaggccttcctaggcacgtacacagagacataggcagctggggcaacatgtcagcacacaggagttcacactgggaagaagacatcagcccgactgactcagaaccacagggcacagcacaagacagggatgataccacagacagcacaaacatggaactacgtgtgttgaggttaaacttacaggcacggaaactggtggagcaatcattaacagagacagaagaaagtgggaaggctctctcaagggtgtccacgttaccacgcacacggcctgacatgcatgagcagtcacgctcagaacgtccgcaatcaaaacaacatgcccgtctcattctcttgtagatggacatcttggctataaccgtgtggttggatgggaggagaggaagagcggcaattaatggcaaggtcacacacagcaaggcagctggaagggagctgaagggatttaacacaggtcttagttcactttaacagtcttgacccagaaaaaaatgcagagtgattgttggtaacagtttggttgtacatcaaaaaagcagcgaaaatataaattgcctttatcgtctcccaaggctgttgcacatgatttttctcccctaggtaaagcggtgaccacaggaaaagggcatggctgaatacactcgggttctcaaatgggaagaagagcaaattatcgacagcaaaaaacgtaaccaacacttttcccctgatatgattaatacaggaggacaaaatatacacactgccaatcaatgaaattagctgcttatttggtataataaatggtttttgcaagatgcaaaaatatctaatatgtaggctttctaatttccatccatttctgggcattaggcagaggctgggacaagctttcatcaaattagatgtgaaacgattacgtgttaatacagtatctaaggatgcctttgctgaacttcccgagagtgagtttatatgatggctacaggaatttaaatttactcttgacagaacaaatatccaaatctgtccatataagaaatgcagctactcaagactaacgctgcagatttgacattaaaggcagttcacaaataagaaatcaccaaaagcatatgagatgttgctctattggaatgcatttagctactcatgggtgtattttctgcttaaagctgagaggatctgaaaatcgcatctgcctttctctccccaccaaatagaaattcaggaagcaatcaggctattggttaatcatattatttcttttttccttatacagaaaatattcgccaaaatcgattaaaactgacaaaacatgaaatagaagaataggttccacgtgaaatatcttaatgcaatttgcatgcagcattgatagctcttctaaagctggtatggtaggttctgcactgcctggggatccaaactgagtggtaacctataaaagttgttggaagtcagcatcgtagtttccaatgcccttcacctttgcctttcaagccaatttatatttcagtacaagagaaggtttttgtacctcattttgatgctacaacaggcaaacatgtttgcttatcacttatcatgaactggcctgcttctctcacgaggtgggagaagaattcacatttattctaagcattactgccaaatggtaaacctaaactgaggaggtgttattccctgcacccacaccttccattttgaaagtcatttcccccactctttctttttctttgtagagaatggttgcactcttattttaaaatatggcttgtggttttgccctctttgaatgttacagtcaccaggaagaggggtttaaatctctcaaatgggtcaagtcctgttctaagacctttatgacttgccatacagtatatttgtcaagcaagggtaacgttatgattgtgaagaacaggcactgggggagatgaatgagagatctcttcagcagcaactccattcttgtaaacttggctcacatttttagtgacgtgttcttttagtgtcctagctagtctgttgttcagatcatcatgcagccccagccctgttcaatggtggtatatcattcctttgagctttagcttttaccaaaaaaaaataaaaaataaaaaagttccactatagcatttgaatcagaggaatttagaaggcatggtgtgaatgcccagacatcccaaacaaacagcaacggctgaagtcaagaaagggaaaaaagtcttcaattaaagacatgaacataaatttatcttaaatgcatccggatctggcatacaatctgcagacattcccttgttttctctttcttatttcttttactggaaatattgatttgttatttacacagaagagggaaacaaggatgatttttttgcttcaccgtagataaatcattttgaaaaacaatttttttaatcaaatgctgtagcagaagagaagcccatcaaactctggaatgctatgcttctcattagcaacggtccctggttttcatttccatactgccattttgggtttatgtacaataatagaatctgacacatttgtggagaaagaaagttcttataaatataccgtctttaaggataaggggagggatgatggggatgaaataacttttgaaactatttgttcagaggcaaacagatcagaatgggtgatgtaaacctcctccttgatatgagttcaggaggaaacacagtgacaaaccagtggctctcagggactgtttgcaactgttattgttagccgttctggcgaccatgcattgttctaaaatttcttattgttagcatgcaggaacaggctgaaactggtaatcgaagcagcaaaaaaccatgtgctataagaagattaactgttaattataagcagtcacattccaaagcagcatatgcataaaaaagaaaacatgctattacttgtcattccttcccaatcatttttacactcacaccaaatgcaaaatagaaatctcaaaagacaaacaagtgccaccacacacacacacacacacacacacacacacacacacacaaaatcagcaagaacgatcaatgagaggctcaaagacaagacagaaacagttaaaaactattgagccccacatgttgacaaaccttcatgaatcagaatgtctagatcaaggtgccaccaactgggaaggtggctctttttcgctactgctggcatagtccatttccattgactccctgtcaggtatcttcacctagagacttctgggtccactttcttaaaaggtaagacctcccatctggtggagcgattcatcaggcttgaaggatatgagtactggccaggaagagctctcctctgggccattatacaaatcatgaacaaactctttaactaaaagctgatgaggagttgtctccctggtggtagatgttccagaagaattgaacactctctgtgtaaaattatactcttaagttgtaaaattaaattatatcaaagttaagtcatggacctcctaatttggaaattaccacccctcatctctctcaactctctctggcttcctaacccttcaattttgttacagtgaatcatggatattcagaaccactggtgttttgtttccatttctcagtgactgtttccttttctagagctgatttaggttagaaggttaattttagatatgaagagttccactttaaattcccaaggttaggtctcaaagtgcaactttgaaaatttcaggatttatttcaaacagaagtaagtttcttatctactccctggccacacaaagcatcctctctcctttggtgtttgctaattttctttcttacgtagtcacccattgttcccttcccaaatcccaattctcagacaaggttttccccaggatgtcaatggtaatacaaagtagatctatgaggacatctagtggatcaatgtggaagagcagctagttcatgggcagttggaactagcctttctccaaaaggagcagaaagaggaccctgctgtctctgagaattgaaatatatgcagtgtcatttcaattcaatggcttctcatgatccacagcagatgattaggggtaggggcagtgaaagggtgagaggtcctaggagatgagcctagggtctgcagccacagctggcacaggaggactatttcagtggcagctgactgcgtctcctttttaaagccctgctgcagcttcctgagactgggagcagacaagagtgtgtctctggcaagtgtgaacaccaaagctacttgtcattccatcttagggctcttgaaacttcatgctcaattaactgccccgataggccaacttaactctaggaaagcagaaatacaaggctctagggactcagtttaccctctggttcacatcataaggttcttgttattggaccagggccatggattctatgaggttatgtggttgctaagaatttgaccctgagtctcaccttcctccgaagacctaggtcctggcagtttcacaatttgagaaaaagcttttatgtgcttttcttcaccacagtgaagtggatattcaaccaacatttccatcataacttcatagtactatttacagagacaaaatagaagtatttccctaatggacatcatcaaaactatttgtttactcttgagtgtttaaaacaaaaaggcttctcagaagtgttcttggacaacttttcctctattctcaaaggccatgatcatgagaccagaaacctgttggaaagtggctggtgaagatgcagctcagttactgctctttccttgagtcaaatggataatcagctgtcaaactcaggttctctgctggctggcctttctgagccaagcctggaatggaaggaagaattggattccatcctatcctcagcaccatctgccacctgcatcagcaaccaaattgtcagccaatttccaatgcagaatcttaatttccagggtggattggaagaggcaggaaaaagcagtactggactgaggggcccaggtggagttttccaactgctggggaaaatgttttagatttcaaatggagcaaattcaagggaagactgggatggaagaaaaaaaacatctgccattcaatcaatagatacttttcaggtcacagcctcacttttaaaatcagtcaaatgaaggagggattatttccaagcaagaaacatggagctactcttcatgggctctgcagcaactaacgttactaataaaaatatccacggaagaaaaagtccaccaggatttaaggtgaggcctttgatgtggcactgggaatcagagaatattctttcaagtcctataaatgagaaatgatgtcttcacttagcaaaattcctcccattaccttctggagtaagaagaaaggtcttccaggtggttttccaaaaacagaggagaaagaaaaagctagttaatgtcagcagcacagagcacactgagctagttgattctgcccctaatgactgtattgtggctgaggaaggcagaagtatttggcactagagttgttggttgattgacaccacattttctctccaattctgaaggaccattcaatttagtatgcagctctgcaggtatgaaagtgggccatgccctcaagccatgtttaaagggttctgtcgatgaagaaagccacagagtcgattttggcaagactgtgcattgaattgaagaaggtcatcattgtgttttgtttttaaagtgagcaatctataccctccaaacactgatgactaaccaaaatcagatgatcaacttgcctcttttgctgcaaaggaatgaggggactgaatttgaaacatcttctccaaattccagagccattggactgaactgttccacagattgggtctccttttcagtagagccttacaaacatgaataaagacccaaagctcaatgctggccttaaaagctcctcctcaatggccacatcttgttgagtaaaagggcatcctattccttgagtaagttagaggttcagacacttgtattgacttgttcagacttatacattgctcattgctgaaatggaatgttctcctccagtcagcttttctgccttaaacaggtaaagggatcttccaagatgtctgactaacattcataaagcaactgggtgtgtcctactgagtactgactaaaagaaaaactttgttgtaaagcaagggaacttcatagactgcagataataattaccactgtgcaaatacttgtctccagtaagacaattgagatacttacagtcccaaagttgagtaaccaattaattatctagcaagcacttctcatacagagaagcatgtactgcaataaatacatcactctatggaatatctctactcttatatgtaaaaatatgaatttttacatataagaatgtacatatactctgatacatcatggtacatattgtgtgtgtgtatatatatatatatatatatatgtatcacaacatgggaatatatatgtggcatatgtgtttcctttaggagaggaatccaagctcaataacaaaggagaccaagtataatttatcaaaggcaagcatgacaattaccccagctgatgaagcatctggagttatagtggtaattacttcagcctaatcagtgtcccttaaaagtcctgagacaaggccttcaagagaaacacactgttgtcaaggtcttattttcaaatagaaaaataagacagtgcccgaagctggccagagcccggggactggggtggatggatggagagcaggctccctggggactctctggctccaggctactctgtagactgcattgggggatgaaggagttggggcatgatgtcactgctacatgcaacataaataccaaaagtaaaagggaaactaaaactgtacagaaaattaaaagagtatctcttctagagaaagacagggggaactggactccgggctgctgggaacccgttttactcacaatatatcactaccagtgtgcagttaaaatagagtaggggccgtattccaaggcagcaaagagaaaaaaaataaatcaaagatatgtcaatgatttgaagtcaaagaaaattccttcaaacacatcaaactagacattacttgtccactaggagtccacactttggcaaacttttagagtctgggggaagaaatgtaaatcattagacaaggtttgttatatagaaaaagaaaatgagtaaatagtagaccctgagaacttgctcctcggccagacagctgaatttgactcttttccttgatagagagctatgaagaaatggaaagaaatgcaaacgttaaactatactatcacaggatttccagaaatggaatgtccgcacctgatatttctccggatgagatgacgtgaaatgttgaaggttactgaatgaaagtgaatgaggagctaggggtggaagtgaaaggggaaggctgggttggggaaggagggttaggaagctatgggtaagggccagtgactgtcatgagctctgccctcatgggatctaccattccagggtgaattattaatacctggactaacacgtttggacagatgagtatgtgggtcagctgtcttctccaacttagagagggaaccaagcaatgtctgttcgaaggcatgggggtccccccagtgtgttactaataatcctagtttcttctaattaaagtttctttgcaactaaaacatcttctccaatttcctcacttgcctgacctacatggggaggtttatttttaataattcattttattctaaccaccccctcacctcacacacacatctgcatcctgccctctgttctatggccttttaattagtaggagcaatattcagacaattctgattgttacatagccaaaggcctttgtgagatgaagaagctgaggttgggggaggaggcacagggatgtacagagaaggaagcgaggcccttgttacactggcttggctttgtagaggcaggccttttgcagcaattggtgcagtgcataatgggagattatatacctcactagctccaccaactttaaaggaaatgaagagaagaaaattatttcaaacaattatgggcctctctctccaggatgaagctaaagcctgctgctgtttacctgtctggaaccaaggtggaaaaataccctagaggccaaatccttatttcttatttctagggacaatttagtctgctgtgttccactatggcgtcctatgagggacattccaatgtcagagcaagagtcagagaagttctcacttcatccttccacttccactccttcctcccgagaatgctctccatccagacaccagggacatcttttaaactaagaactaatgatgacatttcctcacttaaaatcttccaaaggcttcctaatataggactaaaacccacacttcttaccacgtcccctgtctccgtctctaatctcatctcatactaccctttccccagtgccactggcctttcttccatccttcaaacaccacaaacttattcctgcctcctgaccttgacctttgctcgtctccctatctggattgggtcttggcctcaacatcacccctgactgaggccttcctgaccttccaagctataaagtagcaccactgcaggattcctcaaccctcaggcagtctcttctctcttcttagcactggctatctctgaatttatttatttacatcatcatggtttgtctccattcaccagagtaaaggattcaggagggcagggactttaccttgttgaccactccatccctgaaaccaaaaatagcagctcatccaaagaagatactcaaaaatatgtgaacggctaatcaatatgtgaatcacagtcttgctatttccttgatactctgtgggatgagggtctggcaaatatcctgtcaggggttattggcctcacctttcctccctttcccaacccctcactacaagcgtttctttacagaagtgttcacctcttgtatttgttgttctctcttatttccctcaaccctcagactgctgtgctccttctgattgaaatgattcaggagatgtctggtcaactcatccgtgctgctgtgtccacaaccaactaagcatggctgggatggactgcctggtgaagaaggtctttggattcatggggtctgtgggggttgaatggggagtgaggttcattctaggccttgttctctcttagatgctcttctcggtaggttgtcagaatcggggaattcttgtcccaagaaattagaggctcttgttttgagatatcaataaatactcatctcgataagagtctgggggaaggggaccagctgtattaagtcagtggaaacagggggaggaaacccatggtcctaagctgccccaccctgaggggatttctgcagaaacttctctagaccaagagtgcaccccaagggaattttccccatgggttgaggaacttctttaccctccagcagagtgatatttatagatgactggttctacattttctgtaccccactctaggagtacaatgaaaaaggtccttccttcagtggcatactttaggaatggtgctcttctgtctggcttctgcttgtgaacaaggattttatggggtactctttcataattgttcttactcatcagacccaagactgcccacattgcctttcccttctgcaaaaaaatgttagagcacccagagaatcaatagaggccttcaggtgtgcccaaatccctgtatgttggctgtgtgactgtcagcaatctcatcctctcaaacttggaagcttagtttcctctttttgtaaaatgggattaataacacccctgccaattacatggggttagggtgagaatcaaagcaatgattataaggagcttttaaaagactaactcaccataggaaggatggcatcattttttgtttgtttttcaagggttgagaacaatttctattaggcaatacagcataattactgcaaaaggcacaaccttctcaaagcaaagaccacttaagtcatggtatctcaggagctcacaattccacgttctggactcactatatctttctcaagaggccccagtggcaaactgctttagaagggacttgagacagaatatgccagaaacaactgagcccagtctagtctaccccaaagagcgatgatgcttgaggtcgacctttggacgatggcaactgaagccctttggcagtggaaagttcttttcttgggggcagtctgaaggtatcacagttgccaactctggcctgtggtattaaaactagcaggaattccaaatggaaagagtcaactcccattttggagaccaagtcctcagatttagtttctctctcaaccctatatactcagggacccccaatccactggaaatcacgatacaaaaacactttgtgctctgtggctttagttctcctccttattatacatcatacttgtctctgttagactggacacatctactgaggcacctctagagtaaagaagcagggactaggcacaggtttcattcctaggtgttgatggtggtgatttttcatcctctgctctaacaaagcaaggacaggtatttatttcatatttctttaaactgctgggtgaaacataaacatactcaagaaaactctcgatgtttagtgtttctctaataagaaaagggaaggaaaaggaatttggggaataggaatgagaaagggaggggacagggagagaaacactacttacgccgtttgcagccacatttttttattcttttgggatctgtgatgtcatcatgacaggccttgcagtaaaaaaatgccctggagaaagagaatggaaaaactgacacgtttcataatccacccaaatgaaatgagtaccacatttcctccacggtggtgccaaattaatgaaacacgccagcattaatttcctttaatcttttgaaaggtttagacatttgcagacggaaatgtttgttgcaagaccatttatttcaaacacaggattctgtgatttgagttagtgctccttttcataaacttccatttacaaagaaactgggaaaaaagttgctgatgtgacacactgtgtctgctcattcgtctttcatttttgagaacagcctttgatgctactcgtggggacatgtgggcaatgagccctgggcccttggtggggaagttaaatacaacaccaaaattcccacagtctggtcaaatatatatttgagggggcagaagtatgtcgtttctcagtcaaataaaaatatcaagcttgtcactctgaaagcaccttttctgggcagccaaagggagacagagttgaggaggtctgcagagagggaaaaacgaaagccacgagtcagtgggttcctctgtcaaaccccctctggagtttcacagcttattttactccaaagctgactggaccaattcccatgctatccagccctgagaacatgcactaaatgatggttttcttctcactatggagcaaagctcagctgaccactggaagggggtgagtagagcttattgaagcaataggtaggtagaaggagaatgagatgaagcactcaaaaagaaaatcccctaatctgacttgaatgtccataggtgattccacagtgcattagctgtgtcaaagatattctggataagaaaaataagatcattcaagcactatttgaaatcacagtgcctagaacagcacaagaggcctgtgccctttcagtactggggaggtgataaaattcactggaacaaccctacaaccttctggatccaagaactaacaaaatccctggcttgttgcctttaccactcccaacaggaaactgaatgccagctatgaacatggccttttcttgaccagggctgcagaaataaacacaattcttgaccatttgattcttaggttcctttttatgttttcacaggacttgatttataattggcactcattggaaaccaatgttaagacttttggatccacacgaggtcttggagatcctgcagcctaaatctctgggactcagtgtcctcatctgtaaactgaggaggttgtcgtggactgcccagtcattccatgctgggattcagccagccccaggacttctgaatccaagtccaatgcttgctctatcctagcaaattctccactctttctttaaatgccagctgtcatctatgtctcaaaaaaattaaaaaaaaaataaaaagaaatcctagctgactgttgaccctgagtggcaatgtggctaagaacccaatcaatctgccttggcacaggaagaacaggaaagtagaaagcatccaagttggggaaagtaactctgcgtccacttcctttggccattttccctccccctttgttgctcttaacacataatgataataacggtaacaatcatatagctaacatctatagagaacagactacatgtcaggtgtggttctaagtattttataagcattaaacatatttgatcctcaaacaaccctttgaaggaggtatgattattatttctattttacagataaggaaactgaagcacagagaagttaagtgacctgcccaaggccacacagctaaaagtaccaaagctgagattgaattcacatagcctggcaccagagcccaaggtctatactaaagagatgatgacatgataataagcctgaatagacttgtgaaaagataaagtttgattacttcatgaactaaagttggattcttttttaatttaatttttatttttaattgacaaataataattgtattatatgtgtggtatgcaacacattgaaatacatatacaatgtggaatagttgaatcaagctaattaacatatacattatacagataaagaaactgaagcacaccttttgtggtacgaacacttaaaatctactgtcttggctgggtgtggcggctgacgcctgtaatccaacactttgggaggctgatgtggatagatcacgaggccaggagtttgagaccagcctggccaacatggtgaaaccctgtctctactaaaaataaaaaaattagccagtcatggtggcatgcacctgtaatcccagctccttgggaggctgaggcaggagaatcgcttgaatccaggaggtggaggttgcagtgagccgagattgtgccactgcactccagcctgggagcctgggcaatagagcaagacattgtctcaaaaaaaaaaaaaaaaaaatctgtctttgcaattttctggtatataattcatttttaactatagtcaccacattgaacaatagatttcttgaacttattccacctgtctaactgaaatttcatgttttagatggacatctccccaatccctcccaaccccagcccctgttaaccaccattccactttctgcttctatgagtttaacttttgtaggttccacatgtaaataagaacatgcgatgtttgcctggcttatttcactaagcataatgtcctccaaggctaggcaattaaggttaataagtgaaatgaggcaagggtcgggggtgtccatggtgatctggagcaggcagagtatctaagctcagctgacctctgccaagtggcatttctttgcaagaatcattctcttccccacccatctttgcctctgtcatgctcacctcgcaaagcccctcccttactgcacacctgcacctgagcaacggagtttcgctgggaaagaaaacatgctgacctcactttaaacccacaaccatggatttcaggggccttttccactctttgggatctaccccattctcctgttgcttgctttctcacactccaaaacagctctctctcctctcctctccacttgctccagctcaccgtacccctcccacaagcagccttcagctggtgatcttgcttcacccatcatcagaccagctttgtgtcctgcaaggctggcctgtatggtctccttgtcctctggtttcctggcctgcgtgtccagtggaaggagtcagcaggagactagggtgaggggggatgaggtcaccaccttgaccccccgggtgccctcctgtacaggtctatgaaatggcacacgacagcctctctctccagctcctgatagccctccttccccttgaccccacagatctagggtgaaggtggcttcccctttcttgctagctctgcagtgcttggccatcccttgttggttttcctttactatttgcccataactttacagtctcttcataaaactctcctcctttttcccatttaagtttgtcatctgtttcttgccaggacaagaaacagcacccacatttacatattcatctccaattcacacttatccccagaactccagactctaagatccaaccgccttatgatatcactgtgtgtatgtttagtacacatctcctacctaacatagcccagatagaatgcttaacttcctactacccaaaacttgctccttctctagtatccctcatcttggttaagatcaacacaatctaagccctgactctagccttcatccttcattcctcttttttcctcacttctgcccaattcattggggggttctgcacactctcccaaatacagtctgaatgggaacccacctctctccacctccactcaggggtcagtccaagctgccatcatctctcacctaaactatgcaataggcgctgagtctctcacctcttctcctgccccattcctctcattctctacaatgcaggaagaatgaccttttcaaaatatacatcagatcagcttaaagccatcaatgacttccattttataacagatccaacctttctataaagtgctttaggagccagcctctgcctctctctaacctcatctcataccactctccccaaatctattccctagccgcactttccttcttggggtccctatccacaatgaacttcttcccagcccatctcttcttcctatctgatccctgcctgatggattatttcccttcatctcaatctctgctcaaataccaacccctctgagaagctttcacttatacccaacccaaatcagtgacccagttgcattaattcttttaccactaattattttttaaaaaactgtaattctttcctgcctagaatatgagccccacgagagttgggacttctccccattgttcatttttcaccactgtttccctggtgccttgtatagagccttctaaatgtaaacgacttatacacatttgatgggcgaatgaatgagtgagtttgagactgcttcccggtattgttgggtctgccaatttttcaggagaaatgagtaataaggatttttatataaaagctcgtaacttttttcaccttggcaactcatttgtattttaaaattgtgactcaaaaggatcatatgtgcaagccaaactgagtcactgagccaccgttttgtgactcctatattaaagtctatgttccaacgttattttaaaaggaaaatatttggtggcaaggaggaaagagcaagtacccaaatgcccatcctcaagtgaccttcttaagactgcagtgggatggtttcactcctcatttactaaaacactgcatctgaaggtttctacaagctagaattcattaacttcttttgttgcttttttgcagtggagggtgcaaactcgatacgagatcatcataatctacttttccatttttacaaagcttgtttagtttcattcaaatctccaatgtcctttctgtggttttttgcagtcttcatctatttgagatcccctaactgacagcatttgctttgacacatcacatgccatggaaaattacagcctggtgttgtagctgattgtgtcagcatgtatttgtgaataccataaagcactgaaatgagacatattgcactccctaatataggaggtaatttgttttttggacggcctgatatttgtgacattcattagtgagagatgcaataggaaatagaattacacaaatgggagtttcatgttatatttgctatctgggaggtatacgtgatatatggttctcctgtgctccccagcctcctgtacttggtgctgagatgctgtttcaagcttttgtgtctcacagtctggacaagggcacaagcttcttctccaggagacctgattggagcacagggagagggaaggttcagtcccattaatcctaatttcccttctcaggtgtacccagttctcaggatactcttgaacaaccgggagattctgtgaactgagtagggaggtatttttcccccacaactcaatcatggcaatctttccccaatttgcagaaataaatttaagttattagagcactcagtttaagaattctttttccttccaacagcccatgttttctttttcccaaaagcttctgtagccagtatggcttagtttgctagagtggatggggaggaagaggaccctaagtatccacggtcacatgtcatcgttctgtgctcagcgtatcaggcttaacctaggcaaataattaagagtgcaagctccaacttcctggctttattcctcactagcagtatggctttgggcaagttagttagccaagttgtgcctcagtttcctcatatgtaaagtgggaaagagtaatgctacctatctcatggggttgcgtgagagtttaacaagttttagatacagagaacctagtacctagaatagtgctggggtgtaataaaccctcctctgtaagaatgtggtagtattattaaatttggtagaaagagagtggattttagaaaaggaaagaccagttccactctgggctccaccacttacttatgtgcctcatggccttggacaaatcacttatctcgattttacagatgaggaaaccaaagctctgagtgtttgagaagacttaccttccagggttattttgaagagcagcaataaagaatgtagcacacctagaacaggcctggctttgactaggaactcattcaatgaagacaataggcttatataactaatgatagaccttcacaattaataatgtacttaaaatattttatgcaatattactgttgagctgaatgacctgtctgaacatttgcatcacattttctgctagtaaatttctccaagttcataagatagaatcaaatacaataatattccatgttgtgctgcaaagggccctgtgaattcctaggctgcttaaacaggtttaaggatacgaataaaaatgtcatgaaacatgtaggccagtgaaatcctgtgctgcacttacagtggcttaacaattgaagctgacaacttcagccacttacctaggaggccacaaatagaaatagagccagtttcatattccatctgaaattaatcccaaccttttgaaattctatttggcagggagagtagtagaaaactgataattctcaagtaaatttcccagataatattaagtaaagagcactagataaggagccagttgtcttgttatgttgttctgaatcatcaggaatcaggatgacctcgagcagtcattcagctctctgagcccccattttctccctcacaaaataaatgagcaggtaactaggcttcctagttctaaaattttattattctcattcaaagatgtggaattcactacatgaactggagtccgtggaagtttttcttacaccagttgatggccatagacatgttaaggagttttggggttatggaagcctgcctacttccgtgggtcaaggtgtctacagccgggccagaaagaaagccagttgaaaataaactcttaccttttaacttctttggcatcacttgcgatgaaaaatcctaaagtaccttcttggatcttaagatggtttccaggattaattaatatactgctcagtgaacaaaaacaaacagagaagatacatttgtgaggtcatgttctgaataaaaccttgaaggctacaccatactgttgtgtttatagggggcccactagtctaaagctttccccaaagattttgtccagagtccaatgtccactgccccatacatttagttggataatgccatcattaagcactactgcttacttcccaggctggcatgctcccagttgaggaaatcaaagcaaatcaaggtattagggcctgggtttatataatggagcagtctagctgccatcatgggcacatgatttgaagcaaagtccatcagaataaattccttttgaaactgctattggtggtcaacacggaagcattattggcctgatgaagctattgctacaacaattttccattaaatgacagagcattaatgggacccctatagatatacataaacatcatgtacacacaccacatattaccgcagggaatggtacaagacacccgtaaccaatgcggaagcaagctgaacgtcttcatgacattgataaggacatggaaattgattccatgtacagcctttataggaagaattggatttacccaaacagtttttttttttaagtcagcagttggatatacttaacaattccagtctgctgtttataaaaacgtacagggtgtttgaataagatgtgtgtctagcatgtcctaattgaggcaaattgagaaaacaaatgcaaacctccccttaaaaaaacttgccctgcagagaagtgggaacctaaatatacattgtcctatttcaaagtggcataaatagattagcggaccaagttgtgtttggactgacagaagagataaatgtatcctaatctaataaatggatgaaacaaacaagtttaattttctgcagatcaaaagcagaatacaagattgtctgatgcagagactgagaaaagacttcaggcttaatggatactgaattcagggattctgaataaaacaacagatacaacagaggtattccttgttctgaaaagatgttgcttaataaggtaatagatatttggaatcagtctaaaggaagttctcagctgccccaaacaatcaaaatatagaggatggtaattaacacataatcttttttcctactgataaaccattccagagaagtgttgtggtcatgaagtgatacgtctgtagtcatacaggaaggacccaggtgaacctttgttcacctggttgggagacctccgagcagatcattattgcaaaataattttttgtggtcacaagaacatctaccattacttataacaatacctgacaggaggaaactgtacttgtgtcatgactattattaacactcaataataccaaaaggctatgaagatttaactgttctgccctacaaccacaggcagcagtgagattcctcccaaatcagacagcagcagtccacactaatagcacggcctgcactgagcagcggctctccataagcacctcctaatgacccctccgccaactcttcacatgggtataacaagccctctgacttcatgcaatcacgagggtgaagtgttagagctcatacagtttagatgaatttatctttcaaagccaattcagtatgatgttttagaaaggcaggattataaattttgcacatttttttaacctcctttcctgcaaggcagtttttacatgccctggctctgcaatcagaatttgggtccaaattccaacactaccacttaatagctgtttgactttgggccagttactaaatatccctagaactcaactttcttacctacaagaggtggataatggtaacaataatctttagagaattaagagagatgatgtatagaaggctcaatgcatgtgggttattgttcctttttttaattcttgcaaaaaaaaatccaaagtgtatttcattttcaacaaagttatcacagattttctctagctgaccccatggaatataatacagtcttcttatcaaaataccttgcccattaatgagatgaaattatagggtaaagaactgtacgctacagaataatgtataaggacatacacaaaaaattccatgcactggctttgcaaatgcaggtaagcctcacacttctcatctgtaaaatgggtcctggctttgcaaatgcaggtaagcctcacacttctcatctgtaaaatgggtgaataatcgctagcttacaatgcctctaagagagttaaagtatgtactatgtgctacatgactgacacatagaaggtcttaaattcttagttgctactctcagtgagctaggtgattataaaactgagaggtaaaaaaatcctcacagcaccatcaccctccactttgtccctgctgctaataaatgacccaggaggtgccctattggcattgaaagacttttccactgactgcaaggaaatccaaagcattttatccctgcacaatatctggtgatgggctaatttagactgacttttgtctgcacagtgaagtatcctgtgttccttaaatctatggctgattgtgtaaggaatcgaaagcatctctaattacctcacagatcatgtggattccaggatgccctcttattccctgtgaacaggggtgagggggtttaaatcatccccatgtgaggtgtaaggcagaaccatttgcagatactaagctaaggctaaggcagccttctgggtgggaatctaaagaatggatccagtccttgaaataatgaaagaaagaaatctagatacataaagatgctcttggcgctgaagcaccagaaactacattactggtttttgtttttgtttttaatattttcgacattaagtcttctatacacattccaaatctagaaagtttaaataaaatgctaatccccgtcttcttcaaaatataaaaagacaaggattctggatagtgataaccttctcccccttttgcctactatctttagaattcgttattgaccttctaataggaacacataaatttttccaaggatctctgatctctttaggagagtatccaatgttaagtttgttttgttctactgactgccaaaagtctctctctctgtgcgccactctgaatcagttctctagctccaactttatataattcactagtttatcagagataaacttcaacatgtgtcatgtgaagaatcaggaaaatctctaagagaaaaagcccatatatccattaacagaattccaacaaggacatgttggcagaggtggactttccctcatttcaaggaacatataaattatcctttcttctttgaccttactggtttcaacagaaaacatccagtgacagctggaagcacggggctggtgtggtcccttgctgtctctgtttcttttgctctcagactagttttaagtctcgacttattctttgtttactcacctcctacatggagcaaatacgtattttctgtaaggaacccacagttgagtagaggggtacaaaacatgatcacattctatttacctttgagtttcctggagtagcaggcttagagccttgcacgcaacaggcacatttcaactatttgttgaatgaataaaaaaaataagtttttaaagcctcagttccataagttttcctttttttcacaaataagtggaaaggaggtcacagttttctttcaaagaacaagctacaattctcatcagtcaggccgattaaaggagtgaccacacctctgctagggctaggggattggccaatgatctagcaatctctcagatgtgttaagtatgaatatgtaaatatcccaatatgtaaacagcctgccacttgcaaagttggggcaattgatttcaacattgaaagcaaaacttcaaagagaaatatgggttcctagacataaaacacatctacgtgcaattggctagcggggctcagtcccgcagggaaatgcctctatcaggtccctccatgagaggagcaccgcgtctcaagttgtatcacatttcattgggtatctctcgctaaacactggtcaggttggaagactgcagcttgatggaggaaagtaatgcattcctttctccaccacttgtgcataactgggggacatctagttttgtcttcaatcattgtaaactttacttgtttcctgtttctgaagacaacctatgattcgtaattcaagtgaaacagatattgtttaaggaaacttctatccattatgggtaaatatgatacatatatatttctctcctctccctttcatttttggtaggtgtaatgtaccattcctcaggcaatttttaaaaaatagcatgacttatatgagaacatactttgtgcttgataacgtagtaattatatttgtgtctagcaagctaatgggacttcattaactaaagcaagcaaataagaaccatttagggtttccattcatgctatgcccagatgaatcatgccattgagaagaggcttctttgatcacacaagttcatatacaatgactctcagttggaactttgtttgaaccaatccgtgtcccctctcagagagtatgactgcatttgtagtttacaggctatgtgcaggcacagttcagagaaaccccacatctcaaatcttatcacctttctggaacttttcattttttctgggctttcaaatacatgctgctgctggagtcccacacaactagacacacacacttttactttaggataccattggagacacagttgtgtatttcatatgtcaatatacttaagcccagttcacttacacacagacagcatgataaagattgctcccagttggtcagactcaaatgactgccactgtggtccaccagagatactggtgaggacttactcagcctgcatccatctcagtaactttagaaatggcattttcaaatatatttcgtacatacaaaaaaatattagccatatgggatggggaacagagaggtgatctagaaaggataatgctggatatttggttctgggagcaagccaaatcattttctggtatacttaggacaagtcatgcctacatcacaacatgccttcaccacaagataaaaggactcaaaggccaaaagccaacagcagaggtgcaaccactgtggacctttaagatgcaaagtgttgcagtaacttcttgcagttggatcatatcaataataccaaactgacaggaagccacctctatttatacacatgtactcaaaaaaacaacagaagaatcagattttggaaaaagatacagacaaatacacacgcacagacacacacacacacacaattacaaacacaaacacatgacagtgattacaatcacagagaaaagtaacttgaaaagatgaacaagtaggcatctcaacagtatgttttcaacaatattgtcttagataacacattattgaaaagctatcctggaactattaacccaaaagtttttttttaaatgccattgatgatgatttagtcatgcttcatgcaatgtaaaacagcagcaaaacagggtgaaatcacatggtgaaaattgagaaacttcatattaagaaatatgcccaaacacactaggaaaaaaaagccatgagtctgtctcaataaacagtactaactctgtaaatcaagtgtgataatctggcaatttaatagcagtgttctaagactatactgagcactgcccaagaaataaaatattcaaaatgttatcaccaaaataaatgtaaggaaaaatagaagtgtaagggcttggtctctgttttgtggataaaaggacaggaattctgctctatagacaagaaactcgacacagggaggaggaggtcactgggaatgtggaagtggtatgtagacaaaatggcactagagtgcaatggacatcaagacacgtcaggacaatacagaaacagacacaaagggctggagagaagcatcctcctgttcaactttaatagtatttgttcccattattggtgccatgactgaaaacaggagtgtgcctttcctttcttaggtttcctgcaaagaagttagtgcgtcatccaaaagaaccaacaaatcaaacaggaacagaaataggctacttccaatttatgtactctagttggagaggggtgtgtgtgtatatatatatatatatatatatatatatatatatatatacacacacacatatataatatagatacaccagacaagggaatgagattatatatacatatatataatctctctcttcttgaattcttggcaaatggttagtcctgtggttaggagtgaagatagagggtggaggttggaagaaaagttaacgaagagtgcataccgctttcggcttctgcaaaacgacaagaaaagaatttaaaatcaaacaatttgataataaatcgactgacaccagaaggaaagaaggaataaaacctttgtttcaaatcacttgaaggatgcatgtgaaaacaaggttttttggcaaagcatgaaaacagtatcatggggtgaaaccaacaacaaaggcagttaaacacaggttaaagaaggtgggaaggagaaacaggtcctttgaattttcacacccagtcagttagaaaatgtgagagggaaagaagtgggacatgtttaaataaagaaaaacattaaaattattatctcagggaagattttaaaaaatgtgtgttttcacgtggatattgtgtttgataagtcctgtgttttctcagaggcatgatccacattccctcaaacacacctttttccacaagaaccaatgtgcttccacactgagaccaagccacatttgagaattaaagctggcaactgcacaaagaaagcccaaacaaagccaaacaagtcctttttgcccttttctgaagaaaaaaaaaatatatatatatatatatatactaaaaactatatctacaaatatggctttgttgaaaacatctcagaattgtgactcaattgaagggcctatccaagaaaagtttcatcttcagggagtgctctgagttagttttcttagaatagtgacattgagttcacaatgaaccattaacagcctttcgctctttttctctccttggaaccaaaaggcaacaagtgaaagacaactgctcaaggttcagggtgcaatctcctgcagtcagattattccagaatggtcgaaaaacactatgcagcatcagcatcacccacatcatgacatttttttttgaaagatgcacaaaagtaaatagagaacactgagttacacaaagatttgcgatttcgcaacacggggaatatcatttgcaaaaatccaggatacatacagttcccctacacaggtacaagtgagtattggcaaaaacatgggtaaacagtaaccccagaaaattccacctcatctgctgaacaactaataatcaggactgtcagtttttgcaaacaatattcttcactttgccaacatgaaaaagaaaatatttatctatctacatatttgttaactgctacagccatgttctacatatggccaccaaatctaccatttttttcttccttttggttgatttgggttttcaaaatagcttaacatttgatcagattgactttgtgagcaatctgatctggtagttaaggtaacagaaaacattggattgatctgtttacaatccagtgttttcttttcttttgttttgtcttgtcatagacacagactatacacttgaaagtctggctgtattgggttattcacccagataaggaaaactccttaaatgatgataaaaggaaacgtctagtcttcccctgtactctgctcagttattaaggtgtttgttggaggggatctgcactctacatttgggcatctgcaggatcaaaaatatgaactatagaggaatagactgtgggtgtcatttcagagaacaaaagcttgagcatttctcaatgagctctctttcttccaaaactattgacaagaactggggagcaaaaaaatcatctctattttatctgtaaggtgtacagtactccatcagcaaaatttcttgttagcacgatgcttcccacctccagtgtgaactcacatattgactgggatgttatctatttcaaccagacccagtccctcatcagtctgatttgcacataattaagtgtaaaataaataaataaagagagctcctgcctctgagctccactctcctggctcatttacatgaagctgatattctgccacctggattttggttgcaccgggagaagcacatatggtacacaataggctgcttgtaatttggctatcaagagagttggtgtctcccctcacagctctaccccaaggctgctgtaaaggaggccagagtccacctgcttttttgctcacagcagtaaaaaggggttttaagttctggtttaatacttagaaggtgaaaagtccaggtcggcatgatcaggtggagatattttgaggactcatccctcttccctggagaaacactctctgaatgcccagcagggctttgggtgccaggctggtctggcatagaagctgcagtgtctgatggggcatgcctcgaaatgtgctctagggtcagagaggttttacatctggttccatgcagataaataatgcacaagaaagcagaagtgaaccgaccgttctcagaacgcactctcaccatcaaaagtgtcagctggctgctgggtcaccgcaaacttaccggctctctcggttggcagacttgtactcaatggctatcattaggagcttgagcttcacaaaacacagcctgcaatgagatggagaagcctcccaatcagttcttctgaatgaccagagccacataacacacactattacgatctttcggtctcctaatgcagtcattaccgaggggatcctcattccaccggcactgtgccaaagggagggggtggaagcaacacctccccatcttccctattaaacctgatttcttgcaagtgataaggtgctggatgctcaaagtgcaaattgcactcaggtctggctgtctagacacagagcccaagcaggaatttgtgcctggggatttactctgggccagattcattagttactcggtcgggtagtaaaatgttaactacagggggagggaaagatttggaccagctggacctgttatttggattccgtttcggtcttttgtacaaatggctcatattgttgttccgagcagacccctgtgtgcttgcaatgatggtaataatacttggcctctgtgtaagtgcccagcacatgacgatggcattgtcactcctggctccatccaagctgtctcacctcatctgcttggtgctctcgactgcagagcagactgctttgaggctggcttgttcctgtttccatcccttcccttgtgcgttccccactctcgatcccttcttctctcttcccaacccatcctcacaggccacgtcaactctaatcttgcaagcagtgggtcttctccagctactgctaccctgtgattttctattctcaaaactctcccagcaccttgtctgtaaccaaatcactgagcctttagtcaattttacactggctgtggtcgctccctattgtttcatgtgtctgaactttgtctccttaaccagagcaacttccttaagagtcctggacttgtttggaattctccatagtgcatagtgaatagacccaccgatacagagaagctaaacaaacaaatggtttccacttactgggtttcaagtctaagaaaataacaaaaggtgcagtaaaatgtttatgcttaaagattttcagagtaagtgttatttatatggagtagaaaaatagaaaacaacctaaatgtccaataataaggccataaagtacagtgcaatatggtactagcattctaaatggcttttcaaagaatatttcaagatataagatcaataaataatatcatataaaaagacatgaacatgtaaatagaacaaatatataaaaatacatgaatatgtaaatggcacaatacagttagatgaacctatacacttacatacttacagaataaaagctcacataaacaaaataattacatacatgatgtatgacaagtgtctacaattagcattaccattttgaataatagaatattgattaactgatagactgaacaatgagttgatgcttatttatttagctccagcattgtaagggggataagatactgggtcacagtgtggggaaggcttccttgtgggtcaatttaatcccctcaatatccctaagaggaagctattaccccaattattcagacttctattgatagctccattttacacgtgatgaaaccaaggatcagaaagtccatgtaacatgcctaaggtctctagctaatacctggcaggataccctacatcttgatctccagtgaagcctattttgtattgggagagacagacaataagaaaatatacaagtgaataaacaataaattcctagatgatgacaagttctatgttgaaaataaaacaacctaagaatataaagagtaactcagaaggggtatatcatctgtgatggttcaggaggaccattctgaggatgcagggagcacaacagcatgatgagaagatatggggaaagagctttctaggaagtagaaacagcaagcacagaggccctgaggcagggaagagctctgagtgtttgaggatcagcaataaattcagtaagactgcagctgagtgagcaaagtcaagcgtgacagtgattaggtcaggaaatgaggggggagcaagatcatgaggtctttgctttccagagcaaggagtctacagcttattataagtggaattgggggattttagttggtttaaaagagaaaagtgacataatcagatgtgctggatagggggatgtgttgctttcaaggaaagtgctgctgaaggcctcatgctctccagggagtgaaaccaattgctcattcctacatgtgaggttgtggtccacagcactgccttcagcagacagtcagatgtcaaaggaccacttctatccaggcatatctgggatctcctggtgatttgcaggttttctgattcctgccagcagaatctaatgacctgggctttgtgctgattatgcagcttgctgaaacaccaacacacatatccaactacagctggaaaatgccatccttaatttatgtcccaaagagcactgctaacatgcaccctttatgggactgttacttctggagcttaaattgtttttttaaaaaataagatagcttatgcaatgtttattgaaccaaattaccaaattaagtaaccactttctaatgtaaatagtagctaaatacaaaaacatcagggagaaggctgatcttaaacttagtatggatcgtgcaaaggttaatttgctaatatcctatgagcaatgaccagtccactttgggactctggtagttcatgggatcaaagatcttcattgcttttataaacctaatcccgctggtaagaagggaagtaacagttcgtagtaatggtgaattatgtcttcctagctactacagtaccatctaccaactggatataaaaagaaaagagtttcctctacaagaaagtcctaaggtctatgtggccttgtattcattccttaaccttataggggatggacccgcagatctgagtcctcttccagttttaaatccataacttcaaaacattcaaatccatacccaagctgattctacaatgccttatagaagccccttttaaaaagtcctttgacccaaaacaagctgtggcccactggccaaaggaaaggagagggatagaatgatgtgaacagagagaacataggcaagccgtgccacaacacagattttcagactcaagcccttcaagattggctgatcttgcccttcctatgcagataacaaactgagcccaaacagaggagagcaactaggtcaaggtcaattgacttttatgtaaaaagccaaaagtggaaatcgagtctttgacgcaatgtgctgcacagatgcttctcatcagaagagaggaaatgaagtggcagtcacaagcccaacaggcagacacattctgtttggtaagtacagtgttttttaaaaaactgtaaatagatgccaacaagtgaattcacatagaaactggcttttcagctttccttgcaaaatcagatagggccacattggcaccacattccacatgctaaaagggagtgcagctgtgaagcacttatccctctggatgggatgtttgttctccaatgtgccacagttcccaccactctctattgtctcagatggcctcactcttcattctttcttgctaactgcctgaaccctataggtatctaagtttttaatccctactataataggtatcctctagatattgcaaaatacaaatcaagtataatacaccatgatttacactggaagcaagagctatggctccctctgtgagtgttcaaatcacacgtttctgttagatcctgccacagagagttggccaatgtcacaatcctgggcttaaggactgcatcctgttgcagagatgcagcctctgttggaggtgtccattggggaagagcagagcaaggtgaatgaacaggggagctggtgtggtaatcacttgtttgcttatctctcccctctagactgagtttttcctgtacaggatgcatgctttgcctcactggcattttgcaaagttcaaagagtaagccttcagtaaagtctggataaataaatgcatgtatgaatggggagtagaatctcatgactggctggagggatggagaaaagataaagtggcaaactaggaaagtctatgcagagaaagcttggaagtgagtatagaatcatgaaacaagctgcttcttagcttgtcttatttgttagaagcagacagatgggaaaggaaggatacagaaggaaataaaagtagtgatatgctctgggaatctaatttttgccttcaatccacaatgccaagatgcaagtccaattctaagatacaacaatttgtccttgggaccttctagagaccctcttatacccttatgtaccccttacactcccaagaatatatatactttcagtatacccagaactgatgttctctggttaaacatttacttgcatcactcaacaccattttttggtaaagaagaatgagcattagccatctaatccttattctaattctgcctttactcaacttacagtgtttcaacatatacagaattggtgtgaaatcaggaagcagggtgaggtgaggtaaggggaaaaaaggaagtaagaaagccttcacaatgtgataaatgggataaaatcagccataagctagcaataatttaattattggtttctaaaataaaatgccccagtatgtccaacgcaggaagttgttgctggttgcaaaaataattacaggggaatagaaatgacttcttttttcaagaaaaaaaatgccacttgtcacaaaaaggtcttaagccagcaatctgcaataaaactgttataataacaagttagattgctttcttgataattattaggtaaaggtctaccaaatttgacaacgacattatacaaagcccaaccccccttttttttttttactgccaacatcatctgttaactacagtagtttcaacccagatgttcctgaacaaaggctcttaagaattagagtccaactgtttctgcctacccagagggaaatacattgttcctgccattaaatcagccccctttactggaaacattacttgctggtgttaattaaacatggaaacctgtcatagagtttgcaccttcaggaagaaaatacaaagaggaggtttggggctgttgaagaggactcaccccacaagtcaggtgagggaggatgaaagaagcaactgtcatcattccccctgaacccaaccccacccaaagcaccagcccctcttcagctatccagagggcccctgggaatgtcaggttggcacatgcaattgaagtagatacggatacaaacactgcacattgggaaacaaggtcttctggatcgaggggctggaatggaaaagattcacattcaggagctttaatttaaaatgacagccgctagaaatcgaaatatccaggtaaagaaactttgaaacatccggatttccaagactcagcaccaagaaaagagaagtgatttaaaatgttcatggaaatgttaagactctttttctctatgaagctttgataggagtggagtgggaaggtttcagaatatccccaccctctctcccactctcttattctctccttctctctctctctttcacacacacacacaaacacactcacacacacacaatctccactagcacacctaagacactagaatttataaatacattacttgatacagacaattaacttttgcctaaagtgtgaacaactgcatttttagagagccttgctattattattaatgagaaacataatatgaaagaaaaaaccatgtgtttgctacaagaacccagtgttgagtcaaagcccaagcgtccaccccatttccaacaggactccttccctgacccttctgtagagaattctggacccaccactgcctcagtagcctgttattgaggatttcaatagactttagggtcaacggtttattcactagctcatagaaggtcacctcttgggtctctgtagtagaaataaccaccaatactgtattcacatctctattcatatatgttcaaccctaattacaatactccccaatcaagtggatgaatagagccagttctgtgaggggaaaatattttttaaaaaatgagatctgccaggtgcggtggctcacgcctgtaatcccagcactttgggaggccaaggtgggtggatcgcctgagctcaggagttcaagaccacccagggcaacatggtgaaaccccgtatctactaaaaatacaaaaaaattaaccggttgtggtggcacacgtctctagtcccagctacttgggaggctgaggcaggagaatctcttgagccccagaggacaaggttgccgtgagctaagatcacaccactgcactcgagcttgggctacagagtgagactccatctcaaaaaaaaaaaaaaaaaaagagagagatctgagcctctccataaattcacttaaaatgctcatttttgcagccaggctaaagaaatctatcatataacaattgggtctgcctggtttctgctccatgttcaaatttggatgtctttctccaaaaactaatgatttcacagaactgaagttaaactagctacagttttcactgggcaagaggcccagctttcgccgggcggtcttaaattttaaatttccccaagcggcttctttttaaagatctgtctgtgcaaaataacacaggttgagagcatgattttctgaatttaggaggggagcactgaatgcagggaggtagaggagggaaaagagaatccccctgcactcttaaaccagcacagtagcatccatacttgcccctgggcttggggacagaactcctgcccttcagcacagctgaggaagatctgattggagttccccaagttccccaggcattaaatactccacatcaaacctgaattttaactgctccatcagctgcagagggacagagagagacacataccatattttaaatacatcttttgtcctaatcccctctgagctgtaaaacctgatacaattaagcttttatattttgcaaatgatgaatgactgactaataggttcccggtgagattcagaacctagaacacagtgttcttgaggcagcccaactgctgaacccatggtttcctgcagctcctccttgtccagcccctcccctcccctctgccctccctgggggtaggggagtgcaccctcgctttcgcaagtgctcaccaaaaacactgttatcagtttcccccaaaaaaatcacaagtcaaaataaatctgatgcatctctttgtctcatctaaagaggaaagcaatttgctgtaactggaaaatctcggagacctaggtgttgagagagctccctatggtaccaggtggcgcagcctccagattccctaccacttagaatgtcctcttccttctttatcccccatctgaatcaaaactcccgacaagacacagctcaaatgtcatctcttccaggaagaacccccatgtccccccagcctacagggagatgtccctataactctcagcatctctattccagctgtgtgcatctaccacagcacttatcagtgggtgtctagatctctctgacgatgggtactatttcccttagccagacagtaaactctggaggcagccaccctagggaaactgaatattttacttggcatttgttggcatttgtaagtattgctattaatcttttcatgcacatatatttgatcaaatctagtagcagtttcctctagaagtggcaccaagcttggcacaatggtgcacatatcccaattcattaaatatctgattaatcggtgattaaccgataagagaatttcctaaaggttaaaagtaaatataacttggatacacatatagctcgcaatgtgtttctttctttctaagtgcttctattatattcaatgagaaagataaaggtagaaggaaaaggagaggagggagaggggaaaagacattaacccgtactgacagataagtcatagcactcctatttcagagaaggagattggagtaagcatctgtgatggttaatattgagtgtcaacttgattggactgaaggatacaaagtattgttcctgggtgtatctgtgagggtgttaccaaaggagattaacatttgagtctgtggactgggagaagtagatccaccctcactctggatgggcacaatctaatcagcggccagcatggctaggataatgcaggcagaagaaagtggaaggactagacttgtgaagtcttccagccttcatctttctcctgcgctggatgcttcctgcccttgaacatcacactccaagttcctcagcttttggactcttggacttacaccagtgatttgccaggggctcttgggcctttggccacagactgaaggctacactgagaatctcttggcttgaaattgatagagatagctttcggggtggcaggaccttctgcccccactgcctcttttgctctccttcctgttctcttgggaaacaatctcaaatttcacccctacatcctgctcccatatcttttcatagaatgactcccctagcttctgagaaaactccaagctctcccaatcccaccctgcaagggagcattttgccagcctagagaaaaagcacatttatttctttccatgctttaagatgttattggctgcatattgttttagcgcagcgcataattacagaaactgctctgaaaatctgtatattttatctgtgctttatgatacccagaatattccccaattctttttcttcttcgtgaaccagcttaaaatatattttggcatcctttatgtcattttgaaattgaatagccaattcttactgtaatgaaaatacttatgtgccagcccagtgatatacaacactacactctaattacggctgtgctttaattaacctgaattgaagagtgttatcattaaactgctggtaactttgagttatggcttttctttaatttaaagtagaaaacacagataattaagcctccagataatcaaatgcttgaggagagcttcaatgttttgggatgttcctaaatctcattaaatgtccttcttttattgatcatttctacctctgctgtatcattgtattaaacgaataatagcactaagttgtacacattctcactcacatcagaagtggaatatatatatattccagaaactttactgagcaaatactaaattatctgacaacaatttgtctccttcttgggacatgttctaaatacaaaaatcaatcaaagggaatattcacagagccactagtgccagctcttgagctggctgaaggccagtgaagttccacaccacccagtgggtcagggttggcaaactcacacaaccacagggccaggcctgggatttatgtgcaaatctggcctggtttaagatatcagggaggagtaactacatgactatactaacccctttgctacatcaaactggagccagttagcattctgaggaaatgcaggtcttgcattgtcacattagattttctaaagaatccagaaatctagtttttacgtgacatactactatttggaaatatcagcaactagttgatatctacgtgagtcaaacatacctagtgactatcccagttagagcctgtagggggagcagtcctgacccttcaagttacccataagaggaacggactcagttcccaagagcagagtaagagaagggtggaaaagcaagaagggcctgggggttggggagggagcactcttgttagatacaaacaccagttaggccagggaaaccctacagccaaggaagggggcttgacggagcccctgctgacaccctcaccaacataagactcccgcaggcgctggcagctctgctatgtgctcagaccaccaccacattagacagccaaggcttcaattgcctttttataaaactagcttctgttaaaaagcctgctttcccccggggctttgtatcctaggcagaccaagctccagggagggggagatcccctgggacagcctcagtgttccaggacccaatgcctctgaatgcttaactcctctcagtggcaggaagagaaatagctctcaaagaaaggcacacatgggagtcacaatagggcatccattttcagaaaataactccttccgaatcaattacctattcacttttccagtccatttagcattaaaactttcgcttagagacagggtgagaaatttcagtaaacagccaaaccattttggattgcttagggtctgggcccagggactgacagagtgcacctgctgtgttcagtgacaggaggctccaggtaaacacgaagccaccaagcgctccgcctccctccctcctgcatacagaaagaaaaccgtgatacagaggaggccaagggcacccaggactgtcccctcctttgtggtaaagcctgatcagttttgtttcgatgtcttcagacctctcttttggtttgtatgtaggcaggaagtgcaagcaaatggcttttcttcctcagcccagtgagctcccagatacccctgtttcttcccagtgagaagaatccttgtcaaatcctttgctaaggtgtcaggagaataggcttaatgtttcaccaacctcagggagtttgtgttttcagagggcacaaagaccccgttcatcttaaactcaacatctgagattttttattattattattttagagatacaatcactgctatccaggctggaatgcagttgcgtaatcaacctcctgggcagcctcaacctcctgggctcaagcaatccttctaccccagcctctagagtagctaggaccatacgtgtgtgccaccacactcggctaattttccttattttttgtagagataaagtctcactgtgttgcccaggctagtcttgaatgcctagcctcaagtgatcctctcacctcagcttctaaaagtggtgggattgcaaacatgaggattctaagtgaggaatctgaggcactgtcatgcctcacggcagacacctggagctcttgaggtcatcccccataggtgaccatctattctacctgcagtggccatggcgggtggctttgatccatcctgctgagccagtggaaagagaagctaagacttgttattattataacatggcagttgtctatgtgggggctcaaggcctccttctgtatatttggttccacatttcctcagcaaagggtgaaaacactttgaatggctttatttcagtagcttctctgttgtctctatgatcagacttgatgggaagacagattaaaattcctttcattgaggggctggcaagatttgttttgccctcttagaatcagacaggcaggggtttatgccactcttcataaatgtgtctacatcacagaaggcatgcaggataactgtagttcataagttagcataaatgatgaattcaagtccaagactctcaggcctgtcaagaaaagtggggccagtggaaattccccaggcagaggccatgtaatgacccaccctcctattcatcacatggggccgagcacacgggataccctcggcaattgtcaagtgctccaactgtacccagcagaggtgggaggcttccttgcaaggggcacattcaatatccctgaaagccaaagagcatccagttaaaggtcacttactcacaaacagtagggaaggacagacccacgaaggcactggagagatattctgtgtacatttcatttgagactccttccaagtagtatttctgccatgtgtcttcctcaatctaaaggaaaggaacacatgcggagagtttaaaatatgacggtgggctgtaaaagggaaacctgagttacactcttaggcaaacaaatgaatgcactggttagataatggtgaccttttcagcaatcaggaacacggcctctgcacccatataaagccttcaataaccctaaactcataaagtgtgtgccctctaaaacacttttttaacctgtgtgatttctttcctttttcttttttctttttctttttttttttttttttttttttgagacagggtcttactgttgcctgggctggagtgcagtgggtcatagctcactgaagccttggacacctgcactgaagcaatcctcctgcctcagcctctggagtagctgggactataggtgtgcatcaccacacctggcaatttttttttttttaagagacagagtcttgctatgttgcccaggcttgtcttgaactcccggcctcaagtgatcctcctgctgctgcctctcaaagtcctgggattacaggtgtgagccaccgtgcacagtctttaatctgtatgacttctaatggtgcggagacatgggcactcacccacattagtgggcaaggaaattgatacaactgttttgaagagcaattttgcaattattatcaaaatttgtaaaagtacacagtcttttacactacaattccatttgaagtattcatagcaaagaaacaggaaaacagaggtaaaaaaatatacaagaacatcctttctattcatgaaaaatgggaaataaccgtaaatggcacacatacaatggaatactaagaagcaattaaaaattataatgaaaatgtatacctgttcatacagaaattctgtaaaaaggcacattataaaatagtgtacataatctgatcctatttttttagatggcctatagttatctgaatgtttgtaaagccataaaaagaatttaggaagctttatatcaaaacactaacagttgttacctctgagtggtagaatgatactttttttcctctatagattcctgtattgtctgaaggcttttataataagcatgtatatattataatgaaacagtatatttctactttgcacaaaatgacagatttttctgaccccccaaggaatatcacaaaaggtaaaatgttagtttcagagatgtcttgctccaaatttcaaaaggagtatcacaaaagtaaaatgtagtttcagagaggtcttgctccaaatttcattaaaatatgcattttttctaagtagtcaagtttagctggttttcccagcaaccctcttcatgctaggcatctctgaaaggatttcacaatgtagtgaatcttcttttttgtttttttgagacagtcttgctctgtcacccaggctggagtacagtggtgggatctcagctcactgcaatctctgccccctgggttcaagagattctattgcctcagcctcctgagtagctggaattgcaggtgtgcaccaccatgcctggctaattctttttttttttttttttttttttttttttttgagacggagtctcgctctgtcgcccaggctggagtgcagtggcgcgatctcggctcactgcaagctccgcctcccaggttcacgccattctcctgcctcagcctcccgagtagctgggactacaggcgcccgctaccacgcccggctaattttttgtatttttagtagagacggggtttcaccgtgttagccaggatggtctcgatctcctgacctcgtgatccgcccgcctcggcctcccaaagtgctgggattacaggcgtgagccaccgcgcccggccctaattcttgtatttttggtagagacagggtttcaccatgttggccagactgatctcaaactcctgacctcaagtgatctgcctgcctcggcctcccaaaatgctcccaaaatacaggcatgagccactgctaccggcttacaatggagtcagtctttagaaactggtgaattacaaggagaacgttgagccgctatgggagcttagggatctcacaggcctccctgagggaaggagggcaagctgtgtgtctttggctgcagcctctcaggcttcccttccagtgggggcatgggtaagaggaagatgagaggaagccaccccgccaacaggaagtggctctttagaacggcttgtgcttatcttgtattaaaaggcatcttgctggcagccagtcagtcagttcactgggagaaatgcaacatgtggaccagaaggagagctaggaacagtgggcaagggcacacctaccatctacttggtgacactccagcatacaaaagccagaaaaaatttagaaataaactgaaggctccctggctctgtgctctttgtctgcttttagctcagtctgggcaattagattatgtaggttaacctcattagtttgagctgcttccagcctactcccacaggttagacattagctaggcagtgctgctgggtatgagcagtttatctacaaattggccttccccagagtggggtctttaaaaaaaaaagtcactcaaccaattctattgctaaatggtatgattttaaaaattaactgcaatgtgtttagctaagcctgaactttttaatttctccaaaccataagatctcaataatttttttcgaataaaagatatgcttgacttataagcaaaggtcactaactctaactaatttgaagaaagcctaatctgccttagtaaaaaaatgttggaatatagaatatttgggaaacagtattaacataatttgttttattaatgaataggatactatatgaggtatcactaattacaaatccccatactagagccttatgggcaaatagtattcctgaagtaaaataattcagcctattcttttcatatgtgttcttttataatgtgttgtttatggtctaatttaaatacaacaactgattatcaaaaataatgaaaatacaaacctttattattgatcattggtggtattcctcaattaatatggttttaacaaggttcttttagttttggtcagaattttcatgcctttatgtcctaatgaagctattctttataccaaattttattgtaggtgaatcactaaactttttaaataagaaggaacacattttttgtaggataacaatattattcatgtttgttttgaatttagcaaaaattgttttattgagtcattcattcagcaaatattgactgcatatatttttaatcttaggatctgttctagcttctgattaaatcaaaactggtatttacttccccatatttttctctttgctagagaaagcaccagatgtatctgactatgatatacctgaccacatatatctgacttttactgatttttccatatcttttttcctgcaagtttgcctctgtggctaatcaaaatgcttgaggactgaaagtcgtataactggaaaaaagtacagaatgttctagaaaacaaaatgcctcttccacatccttgtgtagacctgcggatagtctctacacactagacctagtagcatcgaatcaactgaataaatgctggagcatttaaatccgttgccattgccatctgtttaagatttccacatctttaacactatttccatatggatagtcaatatgtttttgaggtttctggtaaaggaatttcactttaaaaagagtctaaaattgctaattgaattacactgtcatattctcaagcaatgtatgtagttggtgggaatgtaaagtggcacagccactgtggaaaacagtatggtggttcctcaaaaaattaaacatagaattaccattggattcataattccacttctaggcatatatccaaaggaactggaagaaggatctcaaagagatatttgtacactcatgctcacagcagcattagtcataatatctaagaggtggaagcaccccaagtgtccatggacagatgactagataaacaaagtgtggtaatttacaatggaatattattcagtcttaaaaaagaagaaaactctgacacatgctacaacatggatgacccttgaaggcattacgctaattgaaataacccaatcaaaaaaggacaaccgtgttatgattccacttatatgaggtacctagagtcctcaaatgcatagaaacagaaagtaggaaggtggctgccaggggttgcagggagagggaatgaggagtcatcgtttaactgagacagtgtccgttttgcaagataaaaagagttccggaagtggatggtagtgatggtcacacagtcatgtgaatgttccactgaactacatgcttaaaaatgattaagatagtaaattttgtatgtgtattttatcacaattaaaaagatttttaaaacccttatgtataacataagagcaggagaatcagtaattataattaatactgagaccatttaatccttaagtcatgccagaacaaggacacgaataggccaatcacatcagacaagtcaggagtgagaacccagagtcattacatcatagtgcatcacaaactcagcaacagaacttcagtctttatacctacccaagggctgaaattatcaccttctatcaaggtaacttttctaagtctcgagtgtggtatctttgacttactttggaaaagcaaaaacaaaagtgtacatttctcatacaatgcattcttaggacagaaaaaaaaaacagtgtaaaatacattgaatttaaatccttagccacacctgtatcccagcactttggaagctgaggcaggaagtttgaggctagatatttgagaccagcctgggcaacacagcaagaccctgtctctacaaaaaattaaaaaatttgccaagtgtggtagcacacccctgtagtgccagctactcaggaggctgaggcaggaggatagcttgagcacaggagttcaaggctgcagtgagctatgactgcgccactgcactccagcatgggcaacagagagagatcctgtctctaaaataaataaataaaaccttgtgtttaatactaagaaaatgaaagtgaacaaagaaatctggaccaggtaaagggagttattgtcattatgaattccccttttatagatgataaaactgaggcacagagaggttaagaaacctgctgacagtcacaaagtgaatccgtggtacaaacaggattcagagttcacactcttaaccacccaccacaaagatagaggtgtagggaggttgtggtgttaggatttcggggaatggggaggatttgctgtgtacaagtaccaaagagggaaatatcaaaaccgaagcccatcaaggactcaaaagcccaaactctgtagcctatgactttacgagacgtctagcaaggagtaataatccattttggctctagctgaaagggcggttcaagcctcctctcagagcataaaagtatggtttctattatacaaaatggaaacttcctagcctacaacttctttcctaaaatagtacatgctgttccccacatttgtgttgtcaatgtatttttaactgtaatgtgaagacacacttctcagcagaaaaaaatgaaggaatgggaccaaaatgacttagggaaaggtgccagaattaatttgccagccattcagcaatcagtcaaaggcagagcatttcctgaggcagcaatttatcctttggctgtcacatcaaaccccagctgttttagaagagcgcctagcaaagatgagcagatgatgctctgtgggtccttattcatcaaatacacacgggatcatcagtgagaacaggggactgagccaatgaactagcttgcctacacctctcatttactgtcttatttatctactcttcattatctaatttttcatccagtctagttgaacctcccaagcaaatggtttcacaccaatccacgggcagacagctcccccatcaaatgtaccttccaactggaaacctcagccttggctccacgggaagtcacaccttcctgatcccaggttctgtgtgtgtcactaatggtgggttggtaatgatgccttttattttttatgcttcctctgattagagtgaaactgtgtttctctaatgctaacagcccagtgaatgtgaaaaattcaactctcctggctgggagtatgttacagccatcatgatttctgttcccagtaaaaagtctgaataactgtgttgattacagccaaataatcttgcaaaagtccacctctacccgtgaagtcatgtaaataattccaaagattgtcatatactagtccttatttaattgaaaacaggcaaattcttttaatccaaatatacattatattatgcacatcaaaaataaagcactaaaaggaaattataaaaaccaatgaccattatgttaatagctgcaataagaagagatgagtcgtaacatatacacactaacactgcccaaaacaggtagtagaaggttagtgtattcacaagaacttactacatttactatttttaaaaagtctatctgaattttcagtaaatattcttcctataaaggatccacagttttaaatcttagaagtgcttaataagaattagagacatttgaatgaatatttatatatatcaattatgcaatacattgtcactgtcctttataataagattgtctgaaacagaatgcagtcatatgaactgactggcatatcttagatgccattaaaacgtatttatcatgaccccacaccccccaagaaaaccccacaaaatgtgtcaagtccttgcctacaatactaaacatgaaatcagaattgatgggctctaagttgatgaatgtttgggctggttactaaaatggatggggggtcatttgtatccattcctcaacagcatgctctgtcaaggggaaaagtttaattgaatcttgcgttttctcatttcttgctgaaaagtacgatgttaaggccagcaaggtattaagaagacttcatcatgggacttgtcagattctctcctcctctatttccctctatgttccaatgtcaacaaacttgccccagtttttatcaaagggcatgtggttatctccttctctaccccttcttagcctcttcgttcttcagtataattgcaaatcctaaaagcaattcatagaataaacaaaatgaaatgtttgagtcttgttagctgaggtccaaatggtgccagcacagagaatgcctcactgcacagctttctggggtggagttaactagtgatcaagttgaagccaaaggaagaaagcagaagagaatagtgatttgcaccttttcagaatgtatttcttctctgtgccaaactgcatctcagcgctgaacttcttggatgtggactcagttcagctgcctttctgaaagttgcttggatttcagggactccataacaatttggcattccacaattatggcctctttcagagagcattttccagaatgtgtgactaggacaaaaagatctcagatttttccaaaggcttcaggacaatgtcaattaaaacaattttggggggatttgatggaatgccagaaaactggttgcttcagccatgaacaaataaataaacaactccaaatattaatttcggaatggacttgagccaaatctcttactcccagaccagtgggctgcagactatcaaatgagatttcttccatcaggcattatgaaaaagaatcaacccacacgaggtgttcagagggcgattaaaagactacaccacatgtaaaagtaccagaatacatggtattttccctcactccattatcccaaccaggtttatttctggaaagacagagtgccagaggaactgaaggtaaaggaagggtaaacagcaagagtgatatgagaactttttaaaataataattgagaaattattttttaaagtgttacatatgtggcaggaaactggtctttttttttttttttttaacacatagaaggttttgccaccctatcctcaattttctctccaatatagaaaaggtgtttacacttaagagccttttttaaagattggcctattcactctctgttcagagaggaatttggttttgcaaccttgctaatagtaaagaacatatttacatgtccttcaaataataaggattcttaaaaataccactgaaaataattcttatttgggtaaattgagcaggaagtaaatgttttcagtcagacgtctgccaaaccaaccccagaatagttcagcttcgtatgcagggttttcaggacagcccttcttaccccatctgaggtgagggaccagggtttagcttttatttctaatatccattcttttgcaaaatctaataaaaatgaattacaggccaggcactggctcacgcctgtaatcccagcaatttgagaggccaaggcaggaggatcgtttgagcccaggagtactagacctgtctggacaacatgatgagacaataaataaataaataaataaataagaattacaaaaaaatgaaaagacaaatccaatgcaaggtacaaatccaaaatttttatcatagattcacaatccatataaaattaatccatccaattgctttgaaagtttctaagcacttactctcatcttctgtacttaactcgtcacggatgagtatcaaacagctcacagtccccatctatggaccatggaccacacttggaattgtgctggtccacaacatggcaccactctgtcttaaaaatctgacttcccataatttcccctgcttcagaaaagcagaattgttctcaactaatacttcacagaaagaacttgacaaaacttaatagcaggtgttatctgaaacaaaggagaatggggaggggattctgtggtggcccctactagaatgtgggaaatgttgaaggcacagatttttacctgaatctccactgcctggaactgtgcgtggtacatagtcatagctcaataatagtttctgaatgaatgaaataaacttgggaagcacagaatttaacaaagccaacttgttttatttaattttattattttactttcagcacaatactccttagagtatttaacatgttaagaggaattgtaaatctccaagaggagaacatgacttttttgtttttttgagatggagtctcgctctgtcacccaggctggagtgcagtggtgcaatcttggctcactgcaagctccccctcgcgggttcatgccattctcccacctcagcctcctgactagctgggactacaagcgcctgccaccacgcccggttaattttgtttttgtatttttagtagagatggggtttcactgtgttagccaagatggtctcgatctcctgacctggagatccacccgcctcggcctcccaaagtgctgagattacagacgtgagccaccgcgcccggccagaacgtgatatttagtcacagaatcctttatttcaaggagcagcttaagaagatgggaaatgctaatctaaaaacttcctctcctgacttcccaccctgaaatctctgtttcccttgacgcttctatcacaaatatgtctctctatgacctttttcagttgtcaaaatccagtgcttcctgtaactttcaagtcataaactacctcctctctgaggcctttcctcatttcaccaatgtgctgtgctgtccctgccttaatgggaatagtaactgcacacatctctcaggaggccatgtgggctgaatgagatgatcagtacagaatgtctagaacagtacctggtacttagtaagtgctccatgtgtggtgattagcattaagtaccatcacagcatttgacttctctgacatctgaagagaactacaatgaggtggaattccatttccgtatcgactgtaagctccttaaaggaagagctgtcttactcagctctgtatcttctagaaggagcagcacagtactttgcaaataagaggtgctgggttaatatctgctgagttgaactaagcaagataaaactggagagagaggcctaaagaaacaagaacaatttttctaggcatctgatcataagtaagcatgaataacttcaataacttcatagcgtttagtgttggggcatgaaataaatcaattctgcttctgagcatggaaaaaatttctgcactgttaggatctaccagggagtatgtataactgggtcatttttacacttcccaaaaaacttcttactatgagcaatattttctgggaaatttttcattacagaacatcttgggcttcttagcaactgacttacggttttctaaattctaaatccgataacttggaggcttgaatttgaaagacaaaactctcaagaactgatatattgccaccaatctaactggagttattcctactagctagaagtcctgcctgcattcctctgggagaggaagccccgtccctccccatctcatgcctattctatcttccccatgtgactcagccctccttgtcttctccttgtcttcattttttggattccaaagtaaagtcaaacaacaattcaacaggaagtagactgagcccagggaaggtgatatttggcaagttcattattcctaaattctaaaattgaggccaaaacaacttgatcttttctaaaaaaaaaaaataaaaaaacaaaaaaacaaaaaaaaaactgggagaagaggaagggagttagaaagaacatttgaatccacataggaatggggagcttgcttttgataacacaaaaaactagagagttgcctgtgcctttgaaggatctttactattttagacagtttggtgagaatcccaccagccactgctgttagcaaatgacaaggtctcaccagtggatgtgtctgagggcttacttagtaaaagtcctttgaaatatggagtccagtgctatctatactttgatatgcacgtatgtcacccaagtgtcttggcaaaatccagtttctcatgccttagtcctgaggtggggtcaagtctatgagtctgcatttctaacaagctcgcagatgacactgatgcttcccctatagggcccacattttgagtagcaaggagctgttcccaaagacggtgaagaataaggggcaagtattctccatgatgccttgaggacaagagattcagaagaatcgattacagcctaaaggatttgaaccagagatgaaaaagaatgctttccatgaagtattgctagatattggagccagttacagagaaagcttttagacaattaagcacaagatgggtatccaagtgtttgggctgttgtgataattagcctaaacaatatttcaggggtccagatttatctacttagtctctctccattgattcagtgaccccagtaatagctgaatctccattggaatgtgggttgtgtagatacagaagcaatatcatgactatattgaattcaattaaaaataaagtttcagaaaatggccctgatttgcatccctaatttctattcaactttcccattttaggacacagtattgagtgtgaggacgaaaacgctcgccaacccagtcctgttttagtgacagcagattctgggtacttatgtctcctatcgccatacaatatggcctaataaagtcgcgccaaagagactagatttcatttcagagcaaagggttcagtcgtaaactttagctttctggctgaacagagccattccagccgcaagcataaattctgctagttttaggtatcagagtgattgggaagccaaatgggttatttgtgagcctggtagcaaaggcagaagcgccagctttattgtgtattcattgttatctggacaatctcttgtcagttagagaatattttcacaggaagttagaagcgatttcagaaattcccctctgcagtttctcagagtggatgttaggcctcatcaaaaagacatttggttcagagattgaaagtgggcagcctataaattgctgaggtatttagctgggcttagcagttttcctttgaggaggaaaccatgatcctgagtgctcactgagtacagcagggaagtgcctaagttcacgcagcctctggcttcaaaaaatcccagccttatcatgtgctcctgagccaaggagcataacctctccaagccttaattcccttcacctgcaaaatgagagcaacactagtacctacctcctagggaggcagctgaaatgaggtggtgcatgtaaagtgcttagcagggtgcctggcaaatagctaacatttgtggagtactttctatgcaacagatgagcatgtgttctaaccatactaagagatggcatttattgagtttgtaccttgtagacagtctatacatgtcagctgtcattataagtaatgagtgatagtgatagtgatgatgctgatgatgctgatgatagacaagatagctctactgctcagacaaaggaactatgccaattagatgtggggcctgtgattcatggcttcctattgcttagctgctgctagaaaaggctggaacatcagtgatcatacagtggttctctgaattgaagagaaacattaagcagcctgagtttgtccccaaaagacagcaatattctctggaggtcctctctgccacccatggactttcctaacggccagtaagttaactctgggtagatatgatgataagggagaagttgatattttgaggggacatgatggtctcccaaaatagaaaatggatcatgtgtgggtagcaccattaacatgatgcaggatcacccagcctggctttctgaaaggagccctgggcaaacaggaccctgatgaccagaatgacacttgcccacatctctcagttagtactccccacacactattcgtacctgtcgttctccttcctatcaaatggctttgctactcacttccagccttgcctccacgactgattttgaatggatacctagcatatccttggtccacaggatgagtgtgcaaaaaaaaaaaaagggtacttattcaaaatattctttttaaaaatacttgtccagcttgtatttggaggacagacagagcagtagatggggtgatagagagaggaatgatccctggtcagagtcttcagctactgaccctagtaattcaatcttgagcccaattttgcatactcagcaaaagaaaagttttgcagtcaagcagacccatgctttttagaaagcaagttataaaatatctgtcattacttgaacatgccatttgggaggaggagactcatccctcctagccgaaaaaccgtatcaaagtattcccccaaataccttattaaagtattcaaagtaatctcaaactttctgcctcctgagaagagttctgggaagcacacttttctatttcttgttgcatttctagaatgttttaccactcattgtagttcagcatccccagaaaactgacaggcaggccatcaccctgcagttggtataagatggaaagagggagaggacttgctatgatcctgtttgggcaaagagacccctccctgtccccatgctcacctgtcccatgagcaagttcaagtcaataatacatgtctatccactgaggtaactcattgcagcacacagctgttctccttgcagtcaacaccagtgcagagctctccctgggcaaagctgcacttgctggatgggttttcattaacatatgggaaagaatagtcagcaaatcttcactgttgcagaggactgggaaaaaccagacagatgcacctagttctcacctatccatgcagacaaaatcatctagccttagggagtggagggtgaattgccagagacgctgaaggggttgggaaaaccagtgtcatttaggttgatgaacaatgctgctgccctaaaaaatgtattcagtcagaaaattctgctgactccgtatctcaccacaaagagctccagggaccttccccgacatcagtcatttacaaaagtgttggcaacacaaaattgtaagcactgtaggtagggatgcctttatgccaccttagagggtggttttatatcaggattattcctctatcttctcccatcagtgatccagttctgacccagtctcaaatctcatcacaaatagaaagccaaacagcacctacctccatctcttaagaaagttgaaggagagaatttatagactgaggggtaggtgctttcatatacggataatctttcaaaaataccataagctcttccattttttttacagcaggtaaatagggagctaagagaggttcagtagccttccccaggtcttacagcaaatcgcgtcctaatcagagtcttataatccttgccctgtcccatcctgctgcccactgcacagccgcacaacccccctcacacttcacaaaccagggataacaggaagggtgagggctgtggtagcaattttggataatatagtggtccatgggtacttatagcagggaaatactatctgagatcttcagatgatcaaaattgaatcctagttagactggaatacccaatcccattctgaaggggaatcaaatattcctctttcagttgttcttgcctctctagcctatttaaggagaaagagaaaaaaaatactcaaccacagatagaaatgtccttctcattgccaaattttagccaaaacaagaaatcaacagaagcttcttaagaaactatacctatttgtcccagtctagaaaaaggagaaaggatagaatccatcaccctaaaaagcaatgccacaggtatgggggccaggaataaacagacttccacagccagactgacaacaaagagcttctgcacaccagcatcagtgggcacagagatatatgttacttctcagtgggcagagataccctatctacttacagggtatggaaaaaagagaggaagtgatgactcttattcatagatattaattagttacatccacttcccatcctccagtgtatacagagtacagccatcaagacaggacccctgtatttctccgaacatgaaaccctaatcactgggactgcatcactcgttaccatgaaatacatgtggcagttaatgataaaaaccacaaaaattacactcagttcaaacgttttattgcatgccattcttcaagatggcagatggctgcctaaattgatctcagtgtcatgttacaggtgcccctaagtttctctaaatcagccaaatgagtttgaagttgaaacggccacctcacattgttctaccaggagacgcacaggatgccactgtaatgcagtttgctgaattatagtattcataggctctgattaaaaaaaaaataggtgaactacctgaaacttgccccacagagaatgattattgaatatgctaaaaagccatgatgctgatgaccctgacttaaaggcaatattctccccattctggctgtacagggcaaacatagcatatggcggctaaagagatatctgagttactggttctgggtaagatggagttatcacagttcatcctgtctttcccactgaatgatgttctaagacctggacagaatgcatggagcagctatttgaagacattgagaataaacaatggcaggtagattgaagaagacccgaattagaaataccaccaaatcagcagtgaatttaccattgttctcttctggtatcctctagcctgacctcgaggcagccagaacctggaagggatcatcaagatgtggacaaaaaacctccaggagaagcctcatagtagaactaactaatgcgaggtaactcttagaaaaaatggaggaaatcactgtttttccctccctccctccctccatccattccttcctccctctcttccttcctctctttcttctttcctttcttcctttctttttctctcctcctgtgccccaacaccaagccatctagtagtggcagtagcagtggtgacaatgcaagccagaaaaagattaaaggagataggagaattttcctctctgcccaaaaaacctatggtcctgagagaatgaaaaccaaaccctattgctttttgtctctctctgcccttctaccagttggccccagatgtgaacacaatcacagaaagtatacagaaagccagataactaaagcctcagcagcccttccatcaaaagatcaaaaaggaagaccccagggaacctgaaaatattgcagagatcacatagaaagaggacatggggaagtagtcactaaattgtttataaactctggggctcacgctaagctgtgcatggatgaaactgaccctacacagcacatttagattctaagaactaaactacaatatagaccaccacccagtctgagggcaatattggacagatccaaatagcactgccaacgctttgaaaactcaactaacattgaagtcacaacccatagaagccccataagaacctgtagcctaaaatcaagccgatcaggccgggcgcagtgcctcgtgtctgtaattccagtatttgggaagccaaggcgagtggatcacctgaagccaagagttcaagaccagcctggccaacatggcaaaaccctgtttctactaaaaatacaaaaattagccaggcgtggtggtgggcacctgtaatcccagctacttgggaggctgaggcaggaaaattgcttgaacccagaaggcagaagttgtagtgagctgagattgcaccactgcactccagcttgggtgacagagtgagactccatctcaaataataataataataacaataataataataaagtaaaataaaataaagcaggtcattaccttccaaaataaaattatcaacattcttacaaaatttaaacaagaatcagagtttcataataaaaaaattaaaatatccaagacacaataaaaaattacttgccataagagtaaccaggaaaatctcaacttgcatggaaaaagacaatcagcagatgccaatgcctagatgacacagatgttggaataatctgacaaaaaccttaaagcaactactatttcccgataactaagaaagaacacatttgtaaagaagtaaaagacgggatgcataatttaaaaatcaaaattttaaaaatcaaatggaaatactacaattaaaaaatacaataactaaaacattcactgaatgggctcaacagcagagcaaagatgatggagggaagagtcaatgaacttgaagctaggtcaatataaattgtgcaatttgaacaacagagagaaaaaagtattgaaaagtttcacacagagcctcagggtcctctgatacatcagaaaaagatttagcatttgcatcataggaatcctagaaggaaagcagaaataatatggtgcaggaaaaaaaaatttttttgaggaaacaataagtgaaaacttctttaacttccccagagacaaacctagcagttgaagaatctcaatgaactccaacaggataaacccaaaagaataatgcctagacacattgtaagcaaacaacagaaaactaaagacaaagagaaaatctagaaggcaatcggagaaaaatgactcattacttataggtaaccacaattcaaatgactatggatttctcatcagaaacaatggaggcaagaagaaagtagaacaacacttttaaaatgttgaaccctgaattctatatccaccaaaatgtccctaagtaatgaaagtgaaataaagatattttcagatgacagaaaacagtgtttgttgccagagcatggctctgaaggaactgctaacataagttggacaaacagaacaggaatgatactaaaaggaaggaaacaaagagaaaacaacaacattaataaatattagaataatataatagactatacttctcttgaattctttaaaatagataaaagcaaaaattataacattgtctgatatagtttgcaacagctgtaatacataatacaactataacataaaatggggagggtaaagaaacctatagtttggtaagggttctacatttcacttaaagaggcaaatcatggaatccaagtagacttaaaaagttaagtatgtacattacaaacccatgagcaatcaattttttaaaaactatataaagaagtataagaaataccacagaccaaaaaaaattctgaaaatgttcaaaatgattcaaaagaagaaagaagagagttcaaagtttttgaaaaattagtctaattttcaaaactgaaacaggaaacaaacagaaagcaaataaaatattaggcctaaatccaaacatataaataataatattatagataaattgtctaatgcaaccaattaagaaagagagattcaaagaatcgatttttaaaaaatcacccgactataaactgtctataagaagatcacttaagttttaaagataggtttggttcaaacaaaaaagaggagaaaagatatacttttttccatgaaaacaccaatcaaaaaagaaagcttgagtggctatattaatatcagataaagtagacttcagaacaaagaaaattacaaggatatagggataatatataatgataaaaaggtcaattcaccaagaaaacgtaacaatctaaagtatatgcacttaacagactttcaaacacacacaaagcaaaacctgacggaactaaagtagacaaatccacagttataattggagacttcagcatccttctcgtagtaagatgcagaactagcagacaggaaatcagcaagggtatagaagaaatgaacaacaccattagccgactagtaataattgacatttatagaacactctgcccaacaatagcagaatatacattctttttaagctcacctggaacattcaccaagacagattacattctgggccataaaatgcaccttaacaaatttaaaagaattgaaatcatgccaagtaggttcttaaccataatggaatcagactacaaatcaataatagaaagataagaggaatatcttcaaatacttggaaattaggcaacacacttctaaataattcatggatcaaagaagtttcatgtgaaattagaaaatattgttaactgaacaaaaatgaaaacacaacatatcaaaatttgtggaatgcagctaaagcagggaccaggaagaaatatatagcacaaaatgtttacaccaaaaaagaagagtctcaaatccaaaatctaagcttcatcttaagaagaaactagagaagaggagcaaagtaaatctaaagcaagcagaaaggaaacaaacaaacaaaaaatacaggaaataataaaaccaaagccgattatttaacaaagatcagcaaactttatatctagtaagagtgacaaataagagagaagacacaaataacaaaatcaagaatgaaagagtggttatcactgcccacattaaaaggacaataatgggatactatgaataactctacatacataaattgaaaaactcagataaattagaccaatttttcaaaaactttgaattgtcacaactcacccaagattaactatttaacctgaatagtcctataaccattgaagacattgaatttgtatttaaaaactttcagaaaagaaaaaaatctaggcccaaacctagtagtatttcactgccaaatactactaaatatttaaagaaaaaaaaatcaccaattctacacaatttctcccagaaaacagaaggaagggaaagatttccaactcattttataaagccaacattacctgacactaaaatcaaagacagtctaagaaacgtacaaactaatatacaccaaaaaacaaacacacacaaattcttcataaaaatattaacaaaccaaatccaccaacatgtataagaaataatcacactaactagggtctctcccaggaatgtatggtggctggttcaatattgtataatcattcaatgtaatttaccatattaacagtctaaagaagaaaaactacatgatcctatacattgatgcaggaaagcatttagcaaaattcaacctccattcatgattgaaaaaaataaaactctcaccaaaatagaaatgggaaggaactccctcaacctcaaaagaaaggtatctacaaaacatctatagttcatatcatacttaatggtgaaagaaatgaatgttttcccttgaagacaggtgacaaagaaaagatgtctactcccactccctctattcaatattctgcaagaagtgctagccggtacaatatgattgccaggtacaaggtcaatacagaaacataatgtatatttctacataccaccaatgaacaattggaacccaatttttttaagatgtcatttataatagctccaaaaatgtaaaacttacatataaatctaacaaaacatgtacagaatcttgatgctgaaaactataaaacactgggtaaaacaagttaaagatgacctaaataaatgaagagaccaaattgatggactggaagatacgacatagtaaagatgtcagtgctcccccaaattggtctataggtttaatacaattccaatcaaaacacaggaggaattttttttaggtataggcaagctgattttaaagtatatatggaaagacaaggacactagaatagccaaagcaattttgaaaaagaatacatttggaggactcaaactttgtaatgcccattttaagcaacagaagattgttcctagaccttgaagctcaatggagtttgccatattggaatctgaagttgtttggttccggtacctcctttcatccttccatattctcccttttggaatggcactgtctatagccattatcctatggctgtcctgccattgcatttggggtgcagagtacttgttttctagtttcacagatccaaaaatggagaagaattttgtcccaggattgatcacacccaaagtctcacccataactgattagatgatgacattgggacatgtgagttgctgatcttcagctctgattttggacttgaattgttttgcagggttgagacttttggggatgggggaatgaggtgaatgtattttgcatgtgggatgaatgtagatttttgcagaagtgattaacgatcttgtgataggaaggttatctaagtgggctctaaatgtaatctctattgtctttttagaggaggtttggctaaagaagaagaaataggagatgtgacaatggaagcacaatgttggagtgatgcgatgacagggacaagagccaaggaatgtggtcagcctccagaagctagaaaatgcaaggaaacagattctcctctagagcccccagaaggaaccagccccgccaccatgttgactctaactccactgaaactcagtttccaagttttggcctccagaaaaggaaggaaaaaaacttgtgatatttacagcaactaggtttgtagtaatttattgcagtagccataggaaactaatacatagagtttcatttatcttgggtagatatctaggagtggtatttctgagtcatatggtaactcaatgtttaaccttttaagaaaaactccaaatatttcaacttaaaaacttctttccaggaaagaaagtttaagttaagaaaatgaaaacacaagctacagattaggggcaaatatttacaaattgtatatccaacgagatccaaaatatataaagaattcttaaacagtaaaaaacaaattcaaagaaacaactcaattaaaatggacccagcacttcaccaaaaagcatatacagatgacaaataaccactgggaaggtgttcaacatcagtagggaaatacacgtgaaaaccacaatgagataccacactgcccacctactagactgtttaaaataaaaagtattgacaatgccaagtgatgataaggatgcggagctacagaaactcctgcattgcttgctgatgggaatgataaatggtacagtccttctggaaaacactttggcagtttcttttaaagttaaatataaacttaccctataatccagcaatcctaattcgagatacttaccctagagaaattaaaacttatatccacacaaacttccatgtaaatgtttatatcgactgtattcatgatcgccccaactggaggaaaactaaatggtgtccaatggatgaatggataaacaaactggtacctgcatataagatgtcatactattcatcaacagaaaggatggaatactgatacatgcaacaacctggatggatgtcaagggaactatgctaaatgaaaaaagccaatctcaaaaggttacatgctccatgatgcctttacatgacagacttgaaaagacaaaactgtaatgacagagaatagatcagtggttgccagggcctaggagtgacaggagggtgtgactgtacagcatgagggaatttgggggtatggaaactatcctgtatcctgattgtggtggtggttgcatgactacacatacacaaaatcaactttactgtatgttaatttaaaaaataaaatgaaaaacacttctggaaaactataatcatttccaaatcttactggaatcatgtaccttcagcattttcctataatgcaaatggattactctgctaataaccttgaggacttatcaatccaaagccccaacacctccactcgaattgcttgagttacttgaatatttttgttatgatcagaaggtgtctgtaaacattaggattaactatatttttttctccaagatacttttctttcttcatcttattagcactacctaacccgtccggatctcactcccctttacagacacatttcacacatgggaagtctatcatactgcactgtaacctactgcttccttctttcaaatggttgagactaaactttatagctttcttacatgtccctcaacaaaccagtcatcatctcccttctgtactcagttgcgtcccttggcttgagcaatacatcctcccactacaaggcattatggtctagacaagacagcacttgcctgggtcttttccagactaagctaccaccaagggaatggggcagacatatgtatctcctaccttggaaaagagcttaatttttatagtttttcatggttgaggggaaacctaggataagctcattttacaaatgttgcaaagtggtttctattcttagaagctattgatttgaatataaaacaaagcagtgtttacattcaagacatttctcttggagaagcaatgtgtaacagtggggaaagcgctgagctgagaagccaatgatgttgtagcgttctggccctagctctaccattccccaaccagccatgcaaccagaagtcatcttccgatttcctcctcccaaagagctatggtgatgggtcctgtggcttactattctacaactgaagaaaggtcagagacattaggttctttgcatttggcatgttttccatatgtatctggtttccttgtgtatctggtcaaataaagaatttaagtgaaaatgtatatctcagccaggcacggtggctcatgctgtaatcccagcactttgggaggctgaggtgggcacatcacttgaggtcaggagtttgagaccagcctgggcaacatggtgaaaccccgtctctactaaaaatacaaaaattagccgggtgtggtggctcgtgcctgcagtcccagctacttgggagactgaggcagcagaatcacttgaacctgggggctgcagcggctgggttgctgggggagaggtgggcggaggttgcagtgagccgagactgcaccaccgcactccagcctgggtgagacagcgaaatctccgtctcaaaaaaaaaaggtatatcacgtaaactgaaaagtgctgtgcaaacgtaaagtattactataattccaaagttcttaacagaatacccacggtatcaaatcaatggtgcttccttgttttgcacccctagatgtgtagaatagttgcctcaaagttccaaattcctcatcattgttctggacacagattcacacttaaaatcaccttagggcaacgacaaccaatagacttaaggaaatctgatattttattccttatggcttacataggactttgcgattttcatgtaacaatcactaacagtggatggcactcaaaaaaccaaagtcaaaaatttggaagagtggggaggcagagtagacccagtctgtggatacccaggtggactcaggaatgcatgcaattaattaaaggccaattatctctgaaagagctcagactgatgcttggccagaggcttgttcaataagatggctcttatttcacatcagtgactatatcctgccagccgagaagggccagggtgagtgtcagcttctactggattttcgcattaagtcctgaccattgccgcttctcgggccccatcctcgctgggcaccggactctgtgtatatgttatgtaatctttctgtgctgcctttctctttgttcagtccatgccaagacccatataaaagaatccatatgtgattacagctataaaaccaagaggaaaatattagatgaaaatataacattttggggtttctaagtttgctttacctttaatgctaggcagacagtttacacaaatcattttgctgcaaagtaaagaataatgagttaaatgtgttccctgtcaccatcaatcatgtacatttgcttttgattcaccaaacatataagacacatgaaatgactttctaatcatgttgggggaaggagggagaagggaagaagatggggaaaggagtttcaacttcttttattttattcagaagatccgttgacattttctggcaatctatcttctaacatgctgtatgggcttctttttgctaataatgtttgccttgagaatttgtaaaggtctgagaacgctttaattcaatgttctagaaattaccagggccataggggaaatgaatccctgttaatagctcatggattacttctctctttattagaaatagttttcacagaagttactctactttcaggtgggcattagtgggcttggtcagactgagtggcactgcgggaggcagcatcctgcatggaagcctctgatctaatgggatctaagtagggtgaaaagcgggtacacagtgacgttgacccaaataggatactggggtttagcaaattcatttcaattcatgggtgtttattttgatttgtgaacttaaacaacacactgactggattttctggcagttgaagagctttataaccaaatctaaccagcctctgcacaatccttgtcaaggattaaagagctttgcatttcatgtttctacattgaatcaaagctctttaatttggcaagggaatcatatacagtagcaaagaaagaagttttctgcaccaaaatcacaccaaattacaagtccccgctggtcctggtcccacccagctgtctgtaatacaggctggtcaggctaggctgaggccaaccgatgcattcatttactccacaaacacgtattgagtagctattatgagtcaggcgctgttctaggcactgaggattcagcaagtagccccatcttcacagtgctcaccttgtcccagggaaaagaggcaataaacaccaaagagtgccacgggaaaaaacaaagccaagagagtaaataaggatgtggatgtatggtgtgtggagggggagggggtgcagattcctaaaatgcaattctgttttttccacatggaaacttcatcccccaatgaagctgagaagaacagctgtatacttcctagagaatatgaagtgggacatctactctctctagagaccctcacaagccccagagaacttgtatgagcttagttactttcttcctgattttcctgtatttgccagggaagttgttgaatcataaagtatccctttataagaaatataccatattcatagattggagaactcagtattgtggagatgtcaattctcccaagagaatccagaaacagacccgatcatgtagtatcacctgacttatttaaaaaaaaacagggggttctgggatatttgtaatgtactctttgttaatctaggtcctggttacatgagcactgagggtataagtatttaacaggttgtacatttattacatgcacacttttattatatttcaataaaaaattcatttttaatcccttttaaaaatgcagttctaatgccttagaggaaagactcaactgagaaattaatattaagcaaagacaacaagagttggacagaggggagccaagcagctgctcagggaaggaatatccagccagagggaacaagaagtaaaaatccctagaccagcccaagggagtgtggctaacataagaagcaggagaacactcaggacttaagccaatgaggttccagggacctgactgcttaggacctgcaggccattgtagggactttattcagatgagatgggaccccatggagagacttatgcagaagagtgacaggatctgattcatgcttgagaaggttgttctggatgctttgttgaagatagattggaggtggggtggtaagggcagagcagacagaccagttaggaggctggtgtaatattctaggagagacatgatggtggtttggagctagtagtaggagtgcaggtggtgagaagtgctccgattctgggaatattttgaaacttgaaccaagaggatttcctgctgtattgaatgtggtgtttgagggcaaataaataaatttttaaaaatgagtcaagggtgactccagagtttttagtttcagccatgggaaggatggcattgccaatagtaaaatgagcaaagaacaggtttgtggacaaagaaaaggaattcgattgtggaatggtaagtctgagaggagatggggtattcaaatgtaggtgttgagcagcagttgaatcggtgacgccgggttcaggggagaggttcttcatggaaatataaatatggaagtcatctatgtatctaaaagcaatgagaataattgagattatcaaggaagtgagtataattgtattgggagctgctctccactggtgaggaatatgtgcagaagtctgctgtcataatgccatctgtggttagggtgacattgtccatgggtaatagagtaagcaacatcttgcatctccctatctaatttccaccatgtgggtttactttgccagacaaactctctactctggtaccactagttgttctttcctaagtagagagccacctcaatcccagccttatcagttgcagccctggccccatttcagagctcttgtcaactccaaccctgccacgcaaggttgagttctgcttctggtatgcctccttcaacctggttagcagagcttacacccaccagacaataagaattgcttgctgtgatgattaatgttaacttgactgggtcacagtgtacccagatatttggctaaacattattctgggtgtgtctttgagggtggagggtgtttctgcatgagattaacatttgaatttgtggagtgagtaaagcagattgctcccccaacaaccctcaacccaacccatgtgggtgggcttcatctaacccactgaaggcctgaatagaataaaaaggaggagtaagggagaatttcctccctctgcctgatggtcagtcttaagctgggacatcagtctcctcctgccttcagatctagacttataccattgactttgctggttctcagattttcagactcagacagagactataccatcttctttcctgggtctccagtttatagagcttgggatttcccagccactataaccctgtgggccaattctttataatcaacatctctctctctctctctcacgcatgtgtgtgcacacacacacacagagacaccattgctctgtttctgtagagaaccctaatatacttactttgtcccagaagcacctacctaagtcatccccagcccttcagctccacttggtttagactccaattagtttcacctcctcaaaacagcagtgtgtgtcaatcccttcttgggagcctagttcattccttaccctgactcagcccagcctagggtaactgttatgatgcagtggcctctgcttttgcagagctgggcagacagaaaggtaaagaagatgcacagaatggagctatgcaaacatgtgcccatacatccaagtcagaacagaagctttctgaagcttaccagagcttcctagacctaaggatgctgatgggattagcgcactgtctggaacatggtaggtccccagggcatctctattgcatcaatagttcacatagaatgaactatagaaagctaagatttgtgctaagatgatggcactagctaaagttttcccttatcgtttctcacatttcctttcagtatactcaagggcaaacctggaaccagtttgcttgggtttgaacacctgagtttgtgaattccaaatcacacatccgcatgcaggttgttgaaattctcttaacccatagtgcctgccactgtaaaaggaggataataatagtgacaagtttgggtatggtcattgtgagaattaaatgtgatattgcagctaaagcacttaatacgggatttagcacatgggaatcagtattttttagctattattaaaagtccttgatttacatttttagctgctaaaccagactaattctatacatacatatgtacaagcacacatatacacataaacataacccagactaaaaatatttaaatgattcccttggctatggttagtgctaggacaaaaactttgtgtgtccagccatatccacttcagccaagatacaatctgaatagcatgcttctgatttctctagtgcattctcattcagaaacagaaaacatgacagagaagcgtgtattgttatcgatattaagtaacatttcacccgcaaattccaaatcttgcggcatagggaaaaaaaaacaacactagaaatacataacatattttcttcattctcaaaactgatttattcaacaaagaaataatcatggagagcatactgtgttccaggttttgtgtgtgtgtgtgtgtgtgtgtgtgtgtgtgtgtataaaatgatagattaacagacttcaaatagttggcaattctgagaactatttaaatgtgctacattggaagtcccaatgtacattgaaaaacaattttaagagttaatcaccctctaaacacacacacacacacacacacacacacacacacacacacacacacacaatttgtcatgtgcaaagacagctaatcctagtaagaatgatagcacaattcatgaagatggcaggccatgccccaacttgaaacctcatacgctgaagagaagctaagtatgcatagtaagactcaaaaacaaaaacaaaaacaaatcaatggatcttaaattacatccaagtgaggaagccaagtagagagtaagtgtggccacttattcagggctgaggcaatagcagataggctaagtaagttcattgcctgggtctttacagaagacagcagggagagtctcactagaacctgacaggctaggagtaggagatcagacagtggcaaatgaacagcatgttccagggctggctgatgatgtgaatgcagataagtcacaggcaccaggatgttcgtgcgaactccttaaaggaactcaagggttcaaataagatcctattgcacaaaatgcttaacctgtccttaacagcagctgctgagctggaggatccctggattgccagcttgagtctctttcctaaaggtattagatataaaattagcataagatttgttaaatcctagcactgcagaagctgtagagggcatgccttgaagtttaaatggagtaaattaaggacaaatagccagaaaaaaaatatttagcagtagttagcaaagttaagaaattcattacccccaaagatatgggggtatataaaatataaaaaagattcctaaaaagtttagatcaattcagagatatatccacataggagtgaggttttcagggacaaagacttagggtcctaaggttggtatctttgagagtggcattgatggagagataaagaagcattgctccatatttcttggtacctccaggctgggcctcttttgtaattcctgtatgccagtagtccctctttctttttctttcttttttggagacggggtcttctttctctgttgcccaggctggagtgcaatggcatgatcttggctcactgcgacctccgcctcctgggttcaagcaattccccggcttcagcttcttgagtagctgggactacaggcatgcgccaccaggcccagctaatttttgtatttttagtagaaaagggatttcaccatgttggccaggctggtctcgaactcctgacctcaggtgatccacctgccttggcctcccaaagtgcttatattacaggtgtgggccaacacacctggccagtaatccctctttcttttattaaacatatcacccccactttcagtcttggcattttggtctcatgcatgataaaatgcccagtggaagtggctcacacctatataatcccagcactttgggaggctgaggcaggaggattgcttgaacccaggagtttgagaccaacctagacaacacagggagactggtctctacaaaaaattaaaataaaattaaaaagcccagtggatagtcactgtgcttctgcctgtgccacatctttgctgttacagtcttgtttctcttattttaacaggggttctgccgcaccaaaaaacagacacgaccggcctaggggaagggagagggtgagctaacactttaccttggcttccagaaatgctaattgttcccaaaggatcaagtgctgccaaagcctcaccccttctttgtccatcctaataggcctgcttgtccccatggaaatattgatgaattctccgtcataggatacggaggtcattggagaaggaagcaatttctgtaaacaataatccatttgtaggtttacttttccacctaccccccacccccaacaaaagtaagtgagggctttgtgatccctggaatgggagataatacataaaacatgccaaggagggtgccattatggtgttcaccatgacctaaaggagacgaagatctgggatttggaggtaagtacacaaagatagcaatgtagaatggggagcatgtgaataaggcatctctattttagctgagaaaaatatatgaggggaaggcttgtgatttccaggtcatgtaccttagccaattccaacacaaagaccatctcagtgtcaaaaggtcatattcagagagctacttccaaacaggcgggaattggccttatacagaaataatgtggtaacataacccccagaggaaaatgtgttttcagttacaccagggccaggcccagcctttcccacaagctcttcctaaataggaacttggcaatgggattagctgagctggagcggacatccttggctttagaggtgaggcccatcagggtctggaggaaggttgggcagaggttttccctgctgctaatagcactgaagaatcagcatcacatccattttattaatttccttgacagacagctctagttaccatgcaggcaccacaaaatcaaaacatacgcatgtcaaggggccccatctgtggtggggccctgccaaagcccatgttacatcaacacgaggaagcagagcacagctccacacaccatgtgcttggtcccatgggccatgccctggaagaaaaccaccagagcttgattgaaagagccagagaagttctcgtggtgacagtcctttatcctgagtctgggcttttcatgttgaacataagatccctgggagacacgtggctacatctggcttcagggtctcgtctctaaacacagctacacagacctccctgccacctccattcagttccacccatgcaggatgagagcagcctggattaaagaagatacctaaaggaatgcaacatctttatttgtaagctggatctgagctcagagttctgctgagctgagacctttggctgcataatgagcataggaggattttttaaatcaaggtatcccttgctatcagtgttgctaaagtgattgaaggagctccaaagcaatttgttcctttatgtggagcaatgttaactatcagttggctacataatgccgatttggcaggtacgaaggataaggacttagaaaaactcctgctctaaataatatcactcataggtgcccaaggtgagcaccaatgcatctgtatcctcatgcttcccacccatccctcttattgcaacctaggccatttcctcaaaaccatcaaggaacttggcagtcaattaggtagccacatgacagcaaaaggcaggaggtctcatacctttgattgcagagcttccagcctcctttatggacctcgtgctgactcatgaactttctaaggatgtaatttcccaccttgccagctattaattctgctccttacatagtaagaggcaagatgtaagcccagatccagagctaactgcctcccatgccataacagaaaggctcaagctagacccgttttacacacgggtttgtcaccttgactgcctaatctaagaacagtctaaggatgaggactggagtgactgttatcccaggctccagaagcccccttgctagtggctgggcgatcaatgcaaggctctggaaacacaatcctaacctggcccaccctgggaggacagagtcggttttttttctctccttgcctgcactggtgcagcaggtatggccaccttggggactctggagtgtctgtccagccagctctgacaaggacatgaacacatccagaccgcctgtctctcggtgcaaagggcactgctgccgaggactcagtacattgtttcgctctccattcaaacaaccgcggcatgtcagtcctgctggcctccttgattgtgcagaaataaataaatgaattatgctgttggggtttgggcttcagcacaaacacatggtctgcatttatccacacagtgagaggtccaccagccacttgatataaaagagcaaaatgataattcttttctttaggcgctctgttgccatatggaatgtatataaatcatatttttgttttaacagcggaggctttgttgatagataaacatgtggtttatctaaaaaaagaggggattgtgctttgaacaatcatttaatggccgtggatgtgccaaataaaaataaaaacataattttgaaagaagttggcttcatgcccaaatccgtaacaaggaatttctccttaacccaagtggttagagcccgtcgatctgttttgagtttaagctgtgctctctactcaaccccacgacaaatggaatcccgagctaatgtgctctaataagacgagacgttacctttatgaatgacctcatggagaagaggttggcaagcatggtggagaggccttgagccaggcagctctgggctatgaagcccaacttcaactctgcgaggcagattgcgtcatcaccttctttccaattccagctcgggatgtttagcagatgggcctggggaaagaaaagcaggtatgagaccttgctctgttaaatgttcaattgtttaacatttcttctgggaaatgcagcattgcccaaccactcagggccatccagtcttgcccttcttttcccttgctgcggtctgatgtttgctgttttatgcaactcttctgctcatcacacttcagtctctctggactgttgcttctgcacccaccaagcccaagtcctcccctgggtttgtcatttagccaaatagagcccagagggaatttcctcttgtgacagacccaacagcctgggttactaggatgtctagctaaatcattaagttgagtcctctaatagaccgtaggagtgccaaatgcctgtatattttcagtttcttttttacctgcctttccaatactccagatcagtgactcccaggcatcaggagcgggcatcagaatcacctgtacagtttctgaaaacacagattgctggccccccaccagcatttctgattcagtagatctggggtaaggctggagaatttggcatttctcacaagttggaggtgacgctgacgctgttgatctaggggccacactttgagaaccactggcctaaaacatcaggtaaatcacagtgtcgacgtttccaatctcttgcaaatggactggtcctattcaacccttatgtcaggccctgagacaagaacccagaggcatgctcatccaattatttttaagtggcatgaagcagagagtcatagaaaatacattggatgaaagaatcaaagttcaaaaggttctccagagttggaaaaatcggcaaaagaccaaactaaaaagatttacaaggctttcatgtcaagtacagcatttaggctaaaaaaaatcaactatataaattcaaaatgagaagacctagcttggcagcaggcaggagagaaataaaagaaaacaaaacacacaaagctaaatttaagtgtgtgggtaactaaaacctcaaattttaggctagccatgtgacattacagagaaagccagtgtttactttttagaagtgctccccagatcaagggaaatgaacatttcattctgttgtgaattggtcagactagttccagagtacttgatccagttttcagtcagatttaaagagggaaaatgatcaactgaataacttccagagaaaagtgacaaagacaagaggaggtagcgtctggaaaagatcttttgaggaacagttaagacagccagtaatatttggcctgaagaaggctctcgtcctcacagagacaggatggttacatctgaatacttcaggtgctgctgtgtacaagattaggtttgtcctgctttgttctagaagccagaattaagactgactggtatatattccaagaaagcagatttttgtcttgttttataaatgaacttcctaaggatgtaatttgtctaccaaacggagaaggttaccttaaaaaatgaaaggtctttgtccctaagactcagtaagtatttctccaagttactatggaaagaacttttgctctgcactaggaggttgaatcagagagcccttctaagtctctgctagtgccaagattctatggctttgaagttattatttctctgcacatctcagcaaacacaaggagcaccaagggagcattcccttcactttcagaacaatatacaatagttgaactagaaggatggaagactccattgtgaaaacaaagagcaagtccaagggttccacactctgctttcaaaaatactattcttatgaaattccttcttgcaaaatccgcttctgtgacaatcttgtgcatcctaagccaaaagtgggtactccagggagagatgacagtgccctccctgatgagagcatggttaaatagtctcatggaggggccacagcaagtggtaattgctgtcaaactatcaaaggaccttccccacactgcagactcaattccaacaactagccctaccctttattccttcctctccctactctccagtggcttcagatggccactttcccttttacttcctgggcatcgtagagaacacattggtataactggagaaatactcacttgcagtaatatcatctgagaacctgagaggaatgaggagaaattcagtttaagtaatgaacaagtcaagcattgtgtgtgaaaggagatttttttggtccaagccctaaagagacagctctgaaccttcatggcaccttcaaacaaacaagcaaaacctttcagagaaagtctctcctatccgcatgtgctatctaaggtataaggctgaggcatttcatccttgggtcccccatggccctgtctggtttgagttctgtaggcatattttgagctttctttctcactgtccaccttgacacttggccatgtgattatatagaaaagttgagtttgttccttatctcagggttctgtgccctctttttttggatattatattttctccaacgcagggaaggagtgagggtgacctgctgaatgcttggagggaaatctctgtgcatgaaacaaagagaagagactgacccaggaacataaatcctttgtttctggaaacttcgtccttttccatttgaagtaaattgagtctgatgaaaaatgccagtgttagtgcccagaagtctggaggcaaatcctctctccctaacttggagaatataaagagcaggtctggcagacctggctgcccttcatttctgctacttcaccacccctccctcctctcatggagaaggaactggaaatacgctgtcctggaaaaccaggagagatggatttcagtcctagttccatctctcactacatacaattttgggaagccactatgaggaacaaagaaggccatgaaagaggaaacgatttaatacaattgcccaagtgtcagggtggacagtggaaaaaaaaagctcaaagaacttgcctctatctgcactgggctcatgggacttggcttccagagataaaggcctctttcactagagtctttgggaaaaataaaaaatccactgagaggtaaatcatcaggagtgatacttttccaagaagttataaaccaatctttccttgaagagctttgagccatttacactcaaatcagaagatgcagggccagcatttaaaagatggccagcatgaaagcgtttctctccaagaattctagtgatattaaaagatacactttggagagcatcagcccttctataatgcctactctcgggaaccacagtttggttcaatgggctgtggctccatttaaagagtcggtggcagtaagctcttctgtctccccgctcgctggctgcagagtggtggccatgatttgtgcccagcagagctgcgctgtctatacagagcttagatgccctgctctgaagttaccctgggatgctaaaatgcacagatggtccaacgagtactaaagaagataatggatgtcaaagctcttttaaaaccataaaatatgacacacatgtctacaattatgatgatgacaaactcagggccagttttacatggagagaaagtaggcagcttccctacatccctctaggccctagaatattactattactggatcataggggattgaaatgcttcatatttcaagcccgttgtccaattatgaaatcagctatctcttggaatatgttcatagtgacatgactttacaggcacataccaggtcctttcctgaaagcaaattgtaatgcatggagatctctaagcatctaggatgagtgcagcaaaaagtgccaagaaaggcagaaaaaaaatgttgaaagggaagaggaagaaaatgtattgaaagagtaggaaacatctcaggaaacacagcaaaactgtgaagcaaggtgaagaatgtccatttgcaattctacaaggaatgaaagacaaacaatgatgagtggacgttttcttctttctctagaagagagatatgaaagaacaacaacaacaaaatgccctgtgtcaaagtcactctattccctgtgtcctgactaatcatccaaggatctgtaagtgattctgcccaaccccaaaactcgaatagtttgggatggttctaaacaaaatgtgttttaagcaaataatcatgaattggttgatatcttcctcactgtttctgaataattacaacacagaggtttgccaaacacattcaggttgctatgatcatgtgattactgaccagggactgtctggatcccaggccggctgagctgctttgagttggacaataaccacagctaaaatcctccttaatttcttgaagatgctgcatcagcactcattggaaagagaaaaaaaaggaactgacaaccccttctaaacatacaacattaattttcctattcaatctaaattcagccaaaaatctaaacaacagcttaaagcactcccacactaaatgaaatttcagatcacaaatgaaagaaggagagctcgttgctgcaggagctgtcactagtcacagccttgctaataaaattcacctccacctacaagggctgccatcaaaaacttctccagcttgacacccgtacattaccaatatcctcactttatctcttcagtgtccttgggttttccagagacaaacaggcgaatgtgaccttgggtgcccaccaccaaatccgttggctggagaacaacacgttctgcaagggagccacctgccgagggctgggcagtggctggcagcagtcagccgttctggatggtgggccagtcactgacagcaggctccactcagtgacagcctctgatgggcctccacacagcaaaatgggccagcacttgccagcaattaagaaataacggcatggcactggtgcatttggcagaatggggtttttctctgcatcacctgactgcctatttcatagggaatatggcccataagagggggtacgctgttactcataacccagcagcgagttattctgtacagacaggacacctggctccaggtactgggcagcctccggtttctaggtttcattaaggacataactggtactgcatcaaatggagaaaggtgccaccttccctcccctaaagctgtttttttggaagtttattgactggctgagagaaggagcactgcctttgaatgagacactggactctggtttactgagaagtaatcacagggaaacagcatagactctgacttttgtcttctttctaatcaatcccccactgtaagctataacacaaggaaaattcctttctctttaatctctggatagcttactattttcctgattcaactctgcaaattctcatctcgactctgggaatgtgtcccacattacactcttacagagcgcattatgcactcactagttcacctggtctcagatagagaaatcctatcactcacttgcctggagcattctacaccttaactgctaaatccccgaggacacaaaatagggcttctccttcactgatattcctgtgggtgtcagggagagtgctaatcacacagtatgtattcaataaatatttactgaataagtaaatgactgcagcacatacaaataaaagttgttgtaacttaagtatggatgggatccaagagtaaatcaatagttctgaacctcgggttccaatagacacttcccgaatgaatgaatcagtacatgaaggagcatccttccagtgaccaaatgcaaacacgttgtttggactaaagaaatgggccagaggcgtggtggctcatgcctgtaatcccagcactttgggaggccgaggcgggcagatcacctgaggttgggagttcgagaccatcctgaccaacatgcagaaaccccatctctactaaaagtacaaaatcagcctggcatggtggcgcatgcctgtaatcccagctactcaagaggcagaggcaggagaattgcttgaacttgggaggtggaggttgtggggagtcaagatcatgccattgcactccagcctgggcaacaagagcaagactccatcccaaaaaaaaagaaagaaagaaagaaatgtcccaggaagatttttaacaatcacacctctttacccaggtctttgagttgcgcacatgtgggcatgtgagagtgtgtgtgtgtgtgtgtgtgtgtgtgtgtgtgtgagcctgtataatgaggaagaagaggctggacctgtggatgggtcttcagacctggagcgggctctcgcactcctaccttgttgtgatactgcagcatttgagtgatgattcttatcttcggatggtagttctttatggagattactctgaaaaagaaagaaccaatgctgagacaggtctgccttatgcatggtgtctgacaaaaagatcaattttactgtctccaaatggggtacccatgggactgaggtaggaggcaggacttgattccagaggcagggctcagataccagacaaaattgaagactagctgaaacagggatggggcagaagcaacttttcactggacaagcccagcagtgtgccctgtcagtttaccattgccatggcaacacccaggaggttccctataacctctaggccctagaacattactattactagatcataggggattgaaatgcttcatatttcaagcccgttgtccaattatgaaatcaactatctcttggaatatgttcatagtgacataactttacaggcacataccaggtcctttcctgaaagcaagttgtaatgcatggatgaattccagtcccagttccatctctcactacatacaatttggggaagccaccatgaggaacaaagaaggccatgaaagaggaaaccctttaatatgattgcctaagtgtctgggtggacagtgagaaagaaagctcaaagaacttgcttctatctgcactgggctcatgggacttgcctttctatggcaatgacccggtgacccagaagttactaccccttccctagaaatttttgcataagctgccccttaatctgcatgcaattaaaagtaggtataaatacgacagcctgcccagagctgctactctatggtgtagccccgctgtgcaggagcagtcacagagctgtaatactactgcttcaataaagctgtttccttctgccctaccatcagcttgcctttgaattcttttctgggggaagctaaaaaccttcatgggctaagccccattttggggctcacctatcctgcatcaggaccagcagccagggctatcctgaggggttgcagacactgggccaggttaaacagtattcccaccaccatatctcttgctagtgtgaaaacaaaatcacaaaacagccacagtctgtgtcctgggcatgaaaaatttgagggccccttggaatgcattggagatgggatgtatgcatgtgcgtactggggagtagggggcctggagcaggggctgccagcttattgcctacgtagacatcgaaagcgagcccaaatcatggggcctccagaggtttgcaatctcccacaccctagggactagcccagaaacaatctgctgagtccaattctccaagttaacaacttgagacaacaatgacaaatcaaacaagcaggatgacaaatggttctaattgtgacacatgcttggccactatcacaaaaaatgatttctaagcagggcttttaggatgagatcaaggactcagccttccatagctaatagagaaaatgatgacttaaacgctggttaaaaataagtgccaaggcattgcgggggtcatgatctggtggaaaattgtctcctacctgccctcagtccaaactcaatgttaagcatggcctgcacccaccccaggcctcacgtgtcctccccacatcaattatggtgctaaagggaggggcagagcgcagatgaatggaaacacgtgggttccagtcacagctattgtactaatgaactgcgcgacctttaggaaaaccctgggctctctgttcctgtttcctcatctggacactgggagcaacagtacctgctttatttacttcacaggcttggtatgagcagcaaatgggagaccagatgtgaaaatgctttgaaatcattaaaagttctctccacgtgtaagttatggtttttgtcattaccaagtctgtcagaagtgacattgtacatttccttctgtgacaaggaaggctaaagaatggaattccacagaaaggcccacctcctaagcctaatcagaaatgcaagtgcatttattatgaccacccccacaaacttcccacccagcagcgctccccacttcaccccttttagtgcagaaatggagagaaggcagccagggagcagctttatctgaaaagctgcaacgtacgaatttaggaaatggatcacgctaaagcctctcccagcacaaattcaccctgcgtttttgcacttgaaggatttcattttatttttgaaaaagtgttgcgttggcccacgcttataactcaaggactttgagcctctgtcagccctgccttgcagttcacagcttcagccagttttctgcattagctcatttcaaatggatctttgacattttaatttcaaaggaggcagattggtctcattaaactgaggaggaaggaggattatacaaataagagaaagacaaagcccatttttaaccctgaacttcccacttctttttgcagccaaggcctcagttctggctctacttaattacatttctgatactacctttgaccagtaatttctttttttcttttctttttttttttttttttttttttttttttttttttaagacggagcctcgctggctctgttgcccaggctgtagtgcagtggcgcgatcttggctcactgcaacctccgcctcctgggttcaagcgattcccctgcctcaacctcctgagtaactgggattacaggcacacaccaccacacccagctaagttttgtatttttagtagatacggggtttcaccatgttggtcaggctggtcttgaactcctgacctcgtgatctgcccaccttggcctcccaaagttctgggattacaggtgtaagccactgagccccgcccttgaccagtaatttctatgcctccttgtcctgccagtcaccctagtacctatgtgtcttcatattaaccctaccacagttagggtttaaataaaatactacaattaagagaaacacccatttcaaaactattactcaggtagccccaaacatctctgtggagtcaaaacattaagcttcatcttcttttggttttccatttggaattttgaagacagtgaagccaggttccttaaagggttacatttttttttttaaatcatttccaatgacagaaaaaggtgtcaaaagttgaaaatccttcctacttcaaagaaaggaacaagtgacacacccaaccctgatcctggtgtagccactgtgcagctgtaactgattcgggaatgagcccaggtgtgaagccagaatctgttccaccctctctctgcagcctggcaagcccaaagcttagaagagttcacgcatccacttccttaaaatgacctcactaagcatattgccaaagaaaactgagtggcaagagaagatggtgccagatgttgcctgccagacacaaggaccagatgcttaagggaggactggctcctctgaaatgcactggaggaattcccccacctcactgatggggaagctccggtcacttggggccactgatggaaagcaaagacaaaggcaatgcaaacattgtcaggatgtaaaggtaacttcttgaccttcaacctcaggtaagttcccaggaggcagtaaaccaagccaccggtagagggggaaccttcggcccgaaagatggctgttcacagttaggtaaaagttcctgggaatgcagtgggacggaaatcccactgaatttagctcaactctccagaagcttccctttatcatttcctctcagccctcttaactcttctgcaatttatgctacagaaaagacaaattccaaagggcctctaactacctggagcaaaataccttgactttttagtcatttcattgtcacacaatgtgactactgggtttatgcaaggaacaaaaactgaacaattgctttttttctgaattaagaaaagaataaggtgctggtgttggggccaatattagcagttgacaggcctaacccttgtgcacaaaaagcactgcacagtgtttcccagtatgacctcccctagatgttctgtaaaaaaaaaaaaaaaaaaaaaagggagggcagggcagggcagggcagggccacagcggcacactcctgtaatccagagttttgggatgcccaggtgggaggatcacttgaggttaggagttcgttgagatcagcctgggcaacatagcaagaccctgtccctactaaaaaaaaaaatctaaaaattggccatgtgtggtggcacattcctatagcctcggctacttgggaggctgaggtgagaggatcgtttgggctcaggagttcaaggttatagtgagctatgattgagtccctgcactccagcctgggcgatagtgcgagactctgtctctatgaaaaaaaacgggggggggttgggggaggtgggagaggagcagaggcttatagtcaaataggtttggaaagtgttctatagtacgttatctcagagatgcatattagtattaaaagcactgaaaagcctttcaagaaagaacattaattttgggaaactggatgaaacagcctaactggtcactaaattcccctttggggtgataggaatcaatatgccgtagacacacttggaaagccctagtaagggttttctcagcctcgacaccattaacattctgggccagacaattctctgttttgggggctgacctgtgcattgcagggtcgttcgcagtgtccctgggctctacctatcagatgccagcagcacggtcccctagttgtgacaaccaaaaacatctccagacattgcaaaatgtcccctgggggcatctgcctttagttaagatatctcaggcccatttcctttagggaacatggtactttaattcaggccagcacccatctcaatctatttcctagttctgtctcaaggaatctcaaacccaaggccagctgtaagccctagagctgccacctgctgagggtgagcttccggttggtgacaccctgtgtgccactgccccaacccacacagacagcctcggctcccccaggcctatgcagctggtgagttgtacagtggcttgtggggcaaaaaggcctcatagagatagtcctctgcagaagatccaaaagggccgtgaacagccacagactgccaagcccagggccttccgcagcgccccaagagttacctcatgatattcgaggcatcctccgcatccgggtcagcgcagtacttgttggcaaggatcaggcatgcatctgctgactctatctaagacaccgaaaggaaaattcacagaacacaaacatataaatagccatgctcgagtgtagtctctctctgttgacagcttcttggggaagctttgcaaagaaaaaaaaaaaacaatcctgagagcctgagagattatagtttttgtcaaaagtgtaggttccaagttcttgttatggtataaacatttcatcttgttgctgttggagggtacaacatgtaccttggtaattatacttttcatttggcatcgttgcttacttgtaggatttccagatttctttaaataacaattaattaagcctttcagtctcctccccacctcctttctcaaccatctgcaccatcatcctaattcttcctatcaggagttggaggtgggtgggttaaatcccttctctccagttagcaaggtaactgagtattggggattcagaaatgtacactctgaagtccttcatctgacctttttcacatcttcattttctataggctgggaagagatcagagctctaaatcagataacatcaccatattgcttagtatccgattagtattcagatattcagaagacaacaaatctatgtatgaaataatgtgttacagttgaactcaaaatatacctactgacttatccaaacacgagcccacaggggtttattccttagaggggaccatgagtttgatgtgctaatgattgcttgcatttaaattaggtccacgaacaataacaattgtccctacgttctcataagattttacataagcaataacttgagttatgtctggataatatcaagattaactggactctatgagcataagaattcttatgctggctcaggtctgcaatctgtcctacttggtatgttatacttaatagatcattcctggattttgagggaggccataatatcctccgtggtatgtcacaaatcatctctgatttctttaataatataaagaaagaatttatccaaatccttttggattattcatcttggccaattatattatttacaaaattatgcggtgaccacagttagcatttagacttcagtgaattcattatattaatgtacaccccctggcatgcaaatattgaacatgcttacaaaatctatattacataggtaaagtagcagatgccattttgccttgtacctttcccttctaagcctcaggtgtgctttatgagaagattctaaattaccagtttctggaaaaaaagattcgcccattatcaatgatatcagataactgcatgtttagttttacaccctgcgtcttagatggggaaaaaagaaagctcaaatgttttatcgcttagtaaaattttattttatattttagcctaatgtttctttcagatgtaaataatagaagtcagagctatattgagtccaacttaagtgttcaatataggaattacttgattattatgttgtataaagctactgggtccatataactggtctacttccttgatgagtagctgattttgaggaatccagcaaagcaagtttcatgttatgaccagtccaagtgtgggatggttataggtagtgttgcatatgccagcagaaggaggtcctgggaccagtggaagggtgacctcaaggttgctggtatgtgattgatctcattaggtgtttaggagatgactcgtggccaacctaggaggtgtgtcccctcagcacagagtcaggactccccccagacccacaccaagatggaataaaagcagaagtcacctcttcctccttaccttgactcttgcaagatcatgtggattgaggacggaaccctgataaaattccacctgagtaaaatgtcgtttgaacagagcttcaagctccaggttgggggagatgctacacagggagagaagaaatcgctattaatttaatggactcgggggtttcagcctccatgggctccttcctctctaatttccacagggagccctggggagaggctgtgacctacagtcacccttttgcttgccataaataaaagactcacactcaagagaagtaaaaccccagcccaactgaaaaccaaaccagtaccatggtaaaagaaagaggttcatgggctttaggaaggccaagacctcaggacaaatgtcttctcttcggtatgaatggaattcctatcttataaatatggaagctgggctgcgccactagtgggatggttcattttatgcggactgtgccagagggtgcccagatccagtgtgatttctgggtgtgtctgggagagtctctggatgagaatggcatttgaatcagtgaattcagtagactaccctcctttgtgggagtgggcatcatccagtcctttgagggtctgaagagaacaataaaacagaggacagaggcgtttgtcccttttgcttctttcctgccggcttgaactgggcatctcttgtcattctcctatccttggactggggttgacattggctctatgactctctggccctcagactcaaacaccaccagctttcctgggtctccagcttgctggtggcaggcagtgggacttcccagcctctgtaatcaaatgagccaattcttcctaataaatctctctagagatagatagatagatagatgtatcaatatatagataccgatatatatctgtattagatatattgatatatatatttcctattgactctgtttcactggagagccctgactaatacaatcaaggattagccgaaggttcccctgggagaggcatcctgctgttccctccatcatgaaccttatctctgcttctgtgtctcatggacttctcatcccccaaggcctggatcaaaaagtatcactctgaggagccacagacagacttaatttactctcattattgttcttgattcacacacatgtatgcgactcatcacatttcttggtgctgatctgtactgacatctttctctttggaggacaaggattaaacaagtgacctatttattcatttgttaattctgcagagatgaaaaagactgtcgataaggtaccgtgctaggcactgggagatgatatttagttagaacctactatacgccaggtaccgtgataagtcaacacttgcctaacatttgtgaagtccataatgacaataataataatagttcatgttttgtaacatttactatatggcagataacattttaaataaataatagtaaaatagtattataaataaataagtaaaataaataatatttatttattttattttattttacttagagtttatctctgtcacacagactgcagtgcagtggcaggatctctgctcactgcaacttcccaggttcaagtgatttttgtgcctcagccttcagagtagctgggattataggcatgtgccaccatgcccggctaatttttgtgttttcagtagacacagggttttgccacattggccaggctggtcttgaactcctggcctcaagtgagccacccaccttgccctcccaaagtgctgggattacaggcatgagccaccatgcctggccatgatgagcattaattcatttaaatctcaaaacaaccctataggcaggtatgttattaacccagagcttcaagaggttaattaactgggccatctactataagtatgacattgatggatgttagggatacaaaggtgaatcctagcaatggaagcatgagcagccagtttttgttttgttttgttttgttttgttttgttttttggagacagggactggagtgcagtggtgccatcttgactcactgcaacctctgcctctcaggatcaagtcatcctcccaccacagcctccagagtagcgagggctacaggcacgtgcccctatgcctggctaatctttctatttttgtatagatggggtctcactgtgttgcccaagctggtcttgaactcctgagctcaagtgatcttcccaccttggcctcccaaagtgctgggattacaagcatgagcaaccacaccttaccagcttgtttattcaaactaaagcagtggatgagagaaaagtggctgcctctgtgaatctgaccagtctttcagacccatgacaagtcatacctcattcagaagcctgcccgggtaataccatagactgatgctccttgaaagagatgtccccagtcacttctgccacctgatcaaaatgacttcagcatcccttggataacacagggttgatgttgtctctaatggttgcatgtgtgttcatcttgaaatgcccaactcatgtgggggcacagcctacacactatacctctagagaactttccaaaacgctcagtagaggatgggccacacagcaggtaatcagtggctaagcactgaatggaacctgtgggtacctgctcctgtgctaacatagcctggtctgttttttcaaagtttggagaaatcagtgcagaaaagagaaatgttggtgccccaacatggtgacaagtcagaagtctagcattctgtgagcaaatgccagaggacgacgatccaccaaacagggagtttgtagggaagccgacctcagtggaacctcagagtaggaccgcgtgctgggtagtcaacagcacgtcaagccagcacaaacatgttagctttgtcctggactttgcgatgtggtgccaggactggccccatgacagccccatctccataaaagaagatgaccatggtaccacacatgtcaccataatggagccccctaattctctccattcctggggcagactaccttttatctaaaaagaggattagtcaaagttgaaaacctcaacattgggtagaagggagataccttgctttcctcccctgtaaaacatacaagataagacctacctcctaagtggattatacaaccaaatatatgttatttttcaggctgatagctaacacttattgaagacttactgcacgcctgactctgctctgcacacttcatatggattaattcatttcattctcatcacagcccaactaggtaggaactactatcatctccatgatttatggatgaggaagctgaggcacagggagcttaagtaacttgctcagccagtagttggttgagtcaggattcagatcagggaatctgagtccagaatatgtatttttactctgtttgtggagtaaatgggagcctgcatgcacagtgacgggctagggtcccatgctgggggttcctaggaacggcagttgttattactattaccttctgtcctgcttcctcttaagttggtgtcttgcttggtcaccaactgactccagaactcctaacgtatccacaccatacagctaatcatcccacagcagataatgtggacacgccagattgctaaggggacaatgatgatgacttggacccacaatgagctccactattatttcttccagagataaactcggatgtggtcccagaatcgcctccacagaggcagactctgctctcatcattgaaccagtgtgttgcttccctttccattggttctgcaatatcttctccaacgaggccaaaagggatcatggcttacccaactctggccccatccccagtgccattccccaagacctccactcttacagacattcagggagtccctcgcagggtgtgtggttgggcagagggtctgacagcagtaggaagctcttacttgtgaagaaaaacgatctccacattgacgtcatcccggtccttgtgcagaaagtccttcaggaagttggaaacactctccagagtgatgtgtccgcagaccacaatgtgcctgaacaggagaggccagttagatcaggccaggcaccacgacaggaccctgcatcccaccccctggcaagacagcagaagccaggcagctgcaggggaagcattcatctcctccctccgcctccataaaagcccagctcccatccccagagggcagtgaggcaaagcagcggtgctagcaggtgctgagactcctagacagaaaagccatatggcttctcacctgatgctgcacaaaatcctattaaaagcccaactgtttggccaagtggttttatgcatttaacaataagtgacattatgcttgtgcttaaatgctgcattatcaagtcccttgcagattcatatctctccctttctgcccacaaagcgtcctccggggagatttactgtatgagtcttggtttatgacatagagcttatcaggtaatgagataacaaatcttgctgaaacgatgattttgtgtgtaagaaagcagacttttatcagggtggctaatgtgcggcctgacacgttataggttctgctggccataagcagtaaaaaggaaattttgcatttttccactataactcctccgacaatgggggcatgtaacactttacagtaagtgagcattactcagggctaaatggggctgggatgcctatggaatggaagatcatgccagctggctgtgcgtccccagagggctgcttccttagggtgcccgggatttccaggagagctaaaggaatttacctcaagatggggagatgctgggaagggatgaggctggaattgctcgccttgtttgagggtggtttggacttctgtttctggaagtagtggctcacccggaagagatgagccccacaactgttgagactgacagtccctccaaccgctcggggctcctggccaatctgactttggcaccaggcaatgtcatggccacttatatgtgccacataatgcccagtcaggagtgagcatttgatgcaagagtcagccacaagacaaaaagccagggactgactgtggagataaaaccactggcttctagtgaagagactgtatgtagcaagaggctcgactcctgtccctgtgccccccaggctcatagtgacagcatctgagtctctagctgcgctctgagacttgggcaggtggtgaacatgcagcatggtaatttcctgggtaaaatttagaatggccatgtcccttgcacttcataattgctctgtgcacattccactaaggcagaaagctcattggctggaggtggctcataataggaggcagtgatgatggcttatgcaatgttccattagatgccattataagagcctgccctttcgttgtaatttggtgcttgactaagtatgtgagaataatgcagtaaactcattggtgaaaggataatgatgcagaacaaagagtaaatcaataatatgcacgatgcagttaataatatcaccattatagactgttattgttacggtggtgcacttagcaatcaggcacgcagcggccaccaaggtgagggaagagtgtcaatgagctacttcagaagagatgtcttaacatgatcactttgctctcctgctaggttgatgaaggtcccttagccacccacccaaattttatgcccaaagcccatatgactaaccccctcattagtatatggtgagtagtatgaggctaagacagtgtgacacacagtgtatcagaatacacaatatagattgaacatttggatgatatgcattttatcatatattttaaaatgtttcttgtggcacatgtacatttacatggacaaaatacttcaaataaatttgcacgttctgaataagatttcagactttgaatttgccaaatatgtttgaagtgaatgagaaacagaattcccctactgacctaacttccttgcaactgacaatagggctactttgccattctaacatcctctgcacatagacttccaagattaggagcaaagccaacatgaatccaatgcgtgggtatctccacaggacagatacgtggctgaggctgttctcatcacttagatgtgaaagtaagccagatgtgattccctgctctgcgaccaagggtgtgggcaaagtatttattcccattcagtgcaggaggaagctgagaggttaataccacccagccggcctcctgtgccaggcattgtaaagttcgaagttctataccagcataagcctggttattactcaaagctaggctcaaatcaatgataggtctggggaaatgcctgaacattcgttcttcctacccagcatgcaaagaactgaatgaacatcagccagcatctcctcctcctctctgaaatcattcatccctaggaaagatgtgtgagaagtgcaaggggaaaagatgagttcccccctctcacccttgaatcaaaagctcagctggctgatttattcagccttagaaaaagtcagggttctcttccttgaaaatgtactgggtacatataaaatatattccaatgcaatcaatattatcccttaagcctttaattaactttcacttctcttaagaagtagacaaatgctggcaagagtgaggagaaaaaaaggattgacttttttcatttggtgctagctatccaataccattctagacaattgaaaatatatatcttttagccacagcatgatttctggggtggagagctgtctttatcaaaaaaggaagaaaaaaaaccttccttcaacgtaattggtatttttgctcagaaaaaaagcgagattgattgaaagcagattgcctttttgcccaaggagagttattaggtacattatcatggcaaccttggagaacccatattgttccaatctgtcctatatctgatttgaagatttatggcctcccccttttgtgccaataatcatttccctccattttgttttccatacagtgaaagttatcaaggagcccacatattgaaaatgtttgaatgcagttagaattgatggatggggagaagctgcctctaactcagcaatcggtattaggagatctgcttccgccagcctgtgtctgaggagggccctgcaagagcatgagggatggatggtgaatggggaacatttatttaccagaaatattttcaagacttttgaagattctagggccatagtttggggaaggatattattgcaggaagaagagaactagaatttattgcatcctcaattattagagatatcaacacaaatatgttaagatagacagcagggtgtgacctcattggaggcagagtaatggttgttcacagggcatgatttgaagaatgccaaaaaagatccccatccaaagttatctctgttgggttccatgatgcctacatatctaccatgtgagattcatactctgatagccctgtgttaactcagctcagacactaaataactaaatagtcttggacaatgtaccaattttgcattttacaattaaaaagccagagcctttgaggggccagagctggtgcctgattcatgaagttatcctgatatctaaggagatgatacatggaagggccaagtaatctgctccatggtaagcactatgaaatggtaagtgccatatggtatctgtaaattaggatgtaaccaatataaagtattctgtggcctatgcaatcccacctaatccttcaacaaccctgtgttctcactgcctgagtcttttcaggtaacctctctgaaactctttccttaagtcatatatgcctggcatcccacagcaagtaaaagtgacttgcccaggatgcaatctgggtctcccacttcagttcccactaagatgaaggtggtggtggaaaggaaagaggcttgtatatctcagcttctgctccttcagggcaagcagaaatggacccacagaggtcctcctggatacatggtggagggggtgttggaggggtcctccactggccaagggagaggtttagtctgggaactggagtggataaaccatcacagttttgcaagatcactagagtctggctggataggcagtatcatgatagtcttagcaaagtctgattacaggcagaaatcataagttccaccggtcaggaactctaagccaaacttaactgaagccatatgattggagcaagctaaggggctgcaaagtgatgcaaatgtccattttattttatattatattttatttattttttagagacagggtattgctctgttgcccaggctggagtacagtggctcaatcagaggtaattgcagccttgaactcccaggctgaagcgatcctcctgtcttaacttcctgggtagctgggactataggcatgccaccacagctggctaattttcttttggtttttgtagagataggttcttgctatgttgcccaggctggtcatgaactcccaacctcaagtgatctgctcaccttggcccccaaagtgctgagattacaggcatgagccaccgcgccctaccccaaatgtctattttagacatgtcatgtacagctcaggacttcctcaccagcctggaatctagaagataataagaatcttaatgatccatttacaatggggaatatttaggaaagttcagctatgagagtagctaaatctctccccatctgtggatgtggatctgaactttcttagaccatcagcgattgtcctgaccaatttctatagggcctgaccactcaatttgtgaagatgaccaatagtcctcaatcaataaccatttctgatctgatgaagtttttggttttaaatgctaggtctggatctgtaaacaaatatttcttgggcaaaggtaacataaaatagatataagctgacaggtcatggcttagaataaaagatccacctcagaaacacaaggaagcatcttcaatgccaaaatagtatccaacggcactttctggagaggaattattcatccagtgtgagcaagtagtgcctggtgctgggtcagggctccataaatatgggctggtttaactgaaaagggcagtgcggtgggtcacggcattggaggggtaagaatgacttcatgagaagaagtttgatgattatgaacactattgagggtcaccataaattcgccagttgcttatttcatgtgcatatcttcactaaatatacatgggtgtgcttctcctgccatttaagcatcgctgcctccagaatgaaatcccacaaattcttctcaatccttctactctcttctcagtgatgggccaggaaagcctgcatgcccaagttgagccagaacttcagtttcagagctcaattccacaggtacacaggacaacctaggggaagtgacttaaggcagaaggcagaagaggacaggagggcagtgactgaggcatcaagagagccactgaagatgacttttaggtctatgacaaggaaaatctacatacttttcccaagcctcagatactggttgttagagccagtagcctttgaaaagggaaactgtgaccatggaatagtcaccattgggccccctcccacgttcttaagtttatctcagcatctgaatgaatagcccttggcaattgtttaatctagcacctttcttctctttgatgtggaaacaggttgcaagatgagtgccagatccagagcacaacacctccctcagtttcatgccttctgatgaaagaaagcagctggtgccagggaggataacctaagctgggaattgggagactggggggcgagttctcagtgacctggggccagtcactaaaatgaagaggcccaggctgactgggctgcacccaccagacactgatgaatcctcacacagggctccagttctctgtccgaccttagttcacacctccatcataccttatctagacatctgcaatcgcttcctaactgatttccctatttactgtccccactgcccccaaccattcccacactccctcaaaaaagccaaagagaagggatggcagcaaatcctactgcgatcaggttctgcgagggcggggaggccttagatctttctttagcagagcctcgctctaggaagacaatgtaaaatgcacagctctgggctgtttatttttaaagatactatatccatttttactggaacgagtataaagaacttaaaaaacccagagctatcttgtcacaataaatcagacagagtaaattgaaaatcctatacagctttgcctgaatacattgtgctcactttgtcaaagaggtagatgaaatgtggcacatattgatctagatgtctctgtaaaactataatatttatatcaaatacatatgctagactctctgtctttctgctgagccttctaattgtgttttcctcgtcctgctcctcccaaaatgcatctcaccattggtagcccctgacatgatgggaatgaattttaagaagtacttctcaagagaaccagcagcactgtatcatacaggaagcagggcgtggggggttagagacccaacgacctaaaccacacagtggtcagcaccaaagcttcacgtttgcccccctaggttgaccttgaacccttggtgtctgcatcaccacctctccatgacactcctgcaagctggcctttcctttccttctcacctggtagtgcttttcttggctacttagtcttaatgcaggtttccctgatttggggcatgtccttcagggttactgtttcccagcgcttcccttgaggctcaatcccccactgccaaaaaataagactaatccaactcccaccttcccacttcctcctttactgaatgtctcaaagagactgacttcagtaaagataggggagacatcatgggcaaatgaagcctaactccaggctgtgctgcctcatccctccaccctaccccaggacctggcttggaacccccaaaacttgctgggctttcaggaactatttgttaactgatggattggttgacaaagtatgcatcttggagactctatcccatggtaagtgcagaaaaaagttaacaggtagttcactgcaagccttttagaccataggcttattccaccaccctgaatctactagcatatttcaagtttgtaagggatctgtacacataaagaaaaataaaaacaaagcaaatgagagtgtgtatcagtcccacaaccccaaaccctgactatcaccatttcctgttaaaataatttttttaaaaaaaaggaggttcagcaataagataatttcctatccatggacacatctagtactttgctaatcacaaaggaaggaaatgcattctccctcctagtgaggaagtgaataaagtaatcttcttctccagctgtcaatggagctgttctggatgtggcaggctgtgctgctgtttccctaaatggggcagaagtctgagcaaatagatcccaacagtgcagcaaaggcacctctaaagcagagccccaaggtcagaggacagacaactggcagccccagtggggaataccgggatgtcccacctgggccaaaactttgcatcttatcgcatgcagacagtcagaacctcagctaccctagagggatctgtgtctacacctccaccatcccaaatcacagttagacctccataattagaccgtggtgagaaatgatcacacatattttgtagcttgtagcctacatggagcctcagtccaagtctttaaattctgagaaactcagtgccggggacattggtagattttgcctgtcctgcatacaccctctcttctgtggacagcacctcattttaatttggggaattgctcctccccaaattaaatacagtctcccaattatatacagtcttgggacctttagtgaaggttttctgcccaagtgaggccaatgggtactcttaaatcttggatgggctgatgctaatcacagtgggagttgattcaacctgatgacaaaaccctgtaatgactactcccgagtttccacttcctcagtgtcagagctgcatctctggttcttttctgtcctttctgggatcttgctcttcagtttttcattggaatctctaaggtaccctaacctttaaaaaaaaaaaacaaaaaacttttcttcttaagtcagcaaaaaaataagtttctgttgcctgcaaccagagaatcctaactggtagacttgtttacctttactttggtttctcacctaattctcactgttacctagtatgcaagtattaccaccatttaggtttctttctctctcctttcctttctttccttccttcctctctggaaggggaattctgcagctttcttcagtaagcaattccacagttgctgaaccctcacaaactgcactgattcctcctatgcctccctccccaacaccctcacccctctgcatcttattcatcccattactttgggcttggtggcctttggccattttaaaataagcaagtcttcccttgacctgaatctcccaatgctagatggttctctgctcttacagagaaatcagggagctgaatggcactttccttttttcagatcaaagcagatttgcccgatttcatttttaatgctgcttctgtacaagcagagactgagagaagactaaggcaggcaaaggtcagcctcactcttcagggatgaaggtggaatagagggagaatgagtccaagcaaagaaatggctctgaattttgcccaggagagggttttgatttacaaagcgagccccacctccctccctaacacccctggtgaatcatgtatcatggtccttgagcacatactgttgggactgaccctcccataatgacaaccaacttgacatatctttgccttgttctccagccacacccaacggtgttgccacagctagcataagctgctagccattcactctgtagactcaacatacttgcataggccccagcagacctccagcatctgttagtcacacagggactggaaggagctacaggttagaaggctggcggatcacctgcggtcaggagttcgagaccagcctgaccaacatagagaaaccccgtctctactaaaaatacaaaattagctgggcatggtggcgtacgcctgtaatcccagctactcgaggggctgaggcaggagaattgcttgaatctgggaggtggaggttgtggtgagccaagattgcgccattgcactccagcctgggcaacaagagcaaaactccatctcaaaaaaaaaaaaaaagaaaaggaaaaaagtaaaaagaaggcatgatacgaggcatgacaggccacagcaggacctttgtggggtctggaaaggagtggacctcaggatcacatcagcggattcccaaccctcccaaatctttctgcacccctcttttactgggtctgtaagcttttaggtgaacaaggcaatctgctattacctatgctctccactgttcaatgggtatgttcaacaacgtgaattatcaaatgcttttgggaggcttccctctaatgtctcttgctttcatgattattgtacacttccatgatttcaatgaataaaattcctgaaaaaagagcatttcactgggaagacgctcctgcatactcaagcttctgtttcactgccactgtttccttgggtggtactgattggtcagaatctcagataagctccaggagagcaagaaccacattttacccacagcacatggtggggattcaaattattgtttgttgagccaatatgttagaatgggagttttcctaaggctgttctatacactagctgacatttgcctttggagtcaatggctaaggtcatataagctcccactgagatgggcacatatctatctctgaactgcccccatgtcctcttgttagaaaggtacaaggaggggagatagattacttttccagcaactggtacccatatttggaacagtccctgtggttctgggggtgacagcaggccattgtgatgcaacaccagtactggctgtggagactggaacccttgggacaagagaatcagatttccacaactctcacaatgtattgacctctataatgttttaataaaaagagacactggacttggccagttagaaagtttcctggtttagtttcatagtatgatgacagcagcatggaaggaaccccaaagctaccaggaaccattttgcacagctctggaaagaagtccagcagagtgaatgacatggtacgaagacagaaaacagggggcaacctagtctggatggctgcaattgttcctgagattctgaatctacccggcaaggattcacccaatcaaaggagccattgatcagaatcttcagcaattataatttgagaaatcatattcgaattattttttaatggaagaaagaatatttgagagtgaaaatctaggcttgaatacgactttttttttaaggtacacagttcatctcccacctacatttctattcttgttttcagaacaatagctggaacattttgctaagtgtgtggaagggaagagtgacagcaggaaaggaggggagcttcattctatcagtattatcaggaaattgatttaatatgcttccaagtctctttaaatagagcttcaagtttgaaagggactgaagatatggcttagaggaatccaaaacagatgccaagaaagaagtgcccatgtcccacgcccaccaagacccctctcatcaggaagggatacctagcacatcacatcagaagacatggcatctaatgacaagcgctttgggtatctacccctcagcaccacgtttcagaagtagtcaagaggtcatttttccaaagtattagggcaagctcattttttgttttccctgttcccaagaagtttaatgctaatcaaagcagaatgcctaatcagtccaagatgttctgtcaacttgaattatctatttgtcttcttatttactgtatctgtctgtctacagttcttcatatctttataaagatcggttattggggcctgtgtttccttctgactagaatcgctaccagatgatccttcctggtgatatgttgatgatttgctaatttatggcttttaaaatctaggaatccaaagacattgctgaggggttcaggctggggaagtcacgtggctcatgcaatgagggctgaatggctacttgatgagggatctaagtctgtgtaggatgcaaagcttcagtcacatttcgaccagagccatgtctgcaatagagaaatcgtaaatgacattttataggaaacacccctcatgagagcagtccgccccttgcaggcgaggaaaagtgagaatagctgttgcccaagacacaagtaaacatggaaagaaaaggcctgtggatcggcccaagtcagtataacatgaaatcatctcaaatccgattcccaagtgctagaggccatgccttcccagaaagagtcgagagggaaatggtgttgtagcaagactctctcagaaccaagagaagaggtttcaataagccctgatattggacttcccaaccacttaggtggccaaatagtacgatgtgtagctcagaaaagctgtggtatagttggagatttttatggatgtgtagaaatgcatctgtccccagtgcctggtagcaagccctcagtaaacacatgtggaatggatggacatgaaggcatgactcgtgttaattcctttaaggtagggtaggctatggggccatagattaaatgagtctttgtaaataaatgatccatgctctggcacactagacaatttaaaattccaaatcctttagaaatcagtctagaaccctggtggacaagacatgagtgtggtggaggaaatggagtggaattccacgttgatacaagacagccaggcaggagggaatagtgtgcgctctcaggaaggaacaaaggttctgagtgagaaggagagtccaaattctgatataaggaaagacacagagtttaaaaataacccaataatcaggaagcagggaagatacgcaggatgccatctcccgataagtcaagcaagcactgctcaggcaggttggggtctgagcgagcaatcagtttttaagacttcctctagtggaggtagaactgaagacctatgtttgcaagtggggcttgcataacctggattttaaaagcaagagtgttagctcccccagcttagtgggtaatgcaagctgggtcaaggtcattgaacaagcgttagttagcatctcctcctctgaggtgtcgcttccttggactactttatccagtgtaactaatccctgtttttctcagttgcagaatcttagtcttttctggttttgcagcacacattaaaaatgtgtaattggcatttgctttagttgtacccttgctcagtgcttgcaacctccttgagactgtaaactccaggaggacaggttccgagggtagtttgttcgccaatgaaccctgagcacccaacaaaacccagcatcatgcctgatgcataacacagagaatgcctgcctgccgagtgagtgaatgaaccgatggagaggggccacaggaatggacagtgaggcaggtcactaactgtgctgggctgtttttagttcttgaattttgttctcaactattgaatactcaattatttcttctaaagtatggaatcctctttaaaatatgagcatttacaataaagaagataattaagtactctagtttcatatttaaatagaaaagcatgacaaactgtccccatctctctgaatgtaaggctctttccaatgtggagaccacatccgaggttgaaggcagacagccctaactccctccagcgggatacaggctcctgagggtgaatattccaagtcaaagctatgaaacaaacacacagaatgcaccctgcagaactggtcacgtggggctctactgtgcctttcactgataaggaagaaaccacctccagatactgctctgtgctgtgcggcagactaactaaggagtgaaagggaacaggtggttccatctgcaagggtatagaaggctctgcaggtgagatctgcccagcagggaagtccaagtttagcagatcactacaattctccatggaactacctttaaaggatggagccaggaaggggaagaaaatgttgaaatccacaaaaaaggcacaattctcactttaggtgtggttcatctgtctgtccttgagagcctttcattgctagaagtgttcaagagggaattagaattctagtctaaccaaatgggaaaaataaaggaaggaatggttttgtcccctctccatctttttcccctcaatcctggggccaggacccttaggggtagtgggtgggcaggaggggagaggagacagccccaaagtgaagctcatgcctttctcttcctctccatcatgagcacggtactctggctccccttatacggaaaggtggaggaagatacaaacaataggagatcactgagtttagagcagaatggagtctcaagagatgacatggagaggcagcaggacgcagggaagcaggctgtccaggttcaaaccccagcccaactctttactagctgcgtgatgtcaggcaagttacttaacctccctgttcctcagtttcttcactcattccaaatggagatgatggtaatacctttctcacaggatcaatgtgaggattctgaaatatgcaaatatttgtaggtattactattgccagagaaggcagtcctggggctttaggctgcactgattcacattctcatttcaggaagtgtgtggcactcctgtctctataggcaaatgttccaagagaagccacagcatttaagtttcacaggcagctttcttgaattggagcaagagacgggttagtccatgacaactattccccaaaccagaatggcggctcagcagcttcatcctgaggaccttccttcaagttaattacactcactttcctctcccaccttggctacatctagtctttcatgactcattcccctctcgtgtgccctgtcagcatttggctaccaggaatcagtagaataatccaaacccatcccattctctctgtcccaaacacctgggcctaggattgcctcaaacttgagtcactcaagtcccaacatgggaaacacaaggtctgggtggctcccggctggactccctctaacaagggggttacagcagatggattcctctctgtgactgattattttccatggcccttggccatgtgaccttggaccacgatcttgtcagttctcataaactaaccaggagtggaatgaatcacactcagggaggagacctctgggggaaactgcaaggggctgtgagagggaggagagagctggggatcccaaaggccatgggagcgtcaccagccctcaggccttccctgtctctaagcagctttgaccttacacaaaggaaaggaggaggaggcagtggccttgggaggcaggctgggctgcaggagggctcccttatgaataagatttagggtatcagcccaagagcccagagagctctaatccctccaactcagagagattacctgcctcagctactcactgaacccttggttgtggacacccaaacccctattcttagatgctccaatccatcataacatacatgaaatagccaacacacacgcacatgtgcacaattacccatacctactgcagggactgggtatccttcaggaggtgatgaaaatgttgggtaaggcactctaggcccttgaaatagtgttgatggtgaagaggctttgagaatgctacttgaaatgtttatattatgccaaacacattgattaaaactgaaaatgaaatgccaatgaaatcttcatattctcaaatatcctgaatttgggtgttgtacaaacaaaaccctgatcttctctgcctaaattttgtactttaaataatctttgaatttcaaagttttatgtctctgtagctttagatcatgagttaccttgagttctctgacaagttaatatattgttagagaaatcatttctgaataaaatatgcacaagtaaacaaatcccttaactatgtatacattctaatttctttctgggcatttatttgattgggtcctggggagcagagaacatgtatgtgtgtgtccatgggcagagcacatggacttatgcatacacaaaaactcagagcacagcacactgttttaagagtctgaactttatctttcaacaaagtttagctgctttccttttgcaaatgcatttaattttatctggaaactttttgacgttagaaatagaacaactgtagtttctcattatgtttgctgccagaatccatgcttggttgctcaactaaagaccttatattgctaattactaccacatgcccatatcccaagcgaaagaaaacttattgattctgacagcccattctctcaacactgaattccaaatgaaaactcaaaatttggccaaacataacatttcatcaatcttgttttactgactggaaaaacaacatcaaacaaagggtgctaatggccctttattaccgtgcctttcccaagcttatattttctgatgaaagatctaagtgaccaaaggccttctttaaactacttagtaattagcttttgaaccaggaaacaatgcataaagtagtgaacaggcccggtgctgatgacaggacggactctgtgtctgcagggtcaggaacagtggggacccaaaaagaacattaaaagcaaagtgcattttcataaacggagaagaaaaaaaagagaaagagagagagagagagaaaaccaggctaaaagcggtgataaaagattacagagccagaacagagtggcaggaagtctgtgatctgaagtcatcagcacctgaaagtttgagtggaactgccagggtgaaagatgaccggatcggactgggggcagtgagtgagtgccgggctgagagccccatctgggtcagctggcaccgaaagctgccggcctccagcccacccaccagctcacccacatttgactaggaaaattatttcattaaaaaaaaaaaatcacctggaatgaaagtcaagaaatattttcaacttagccttcagggcaattgattttattgacttcttggggcagtgattgggaaatgctggcggagacgtcagaagatagggaggccataaagagagccccaggccctcagaatgccttctgctttatggagacctgtccacaccttcaaggcaaaatgaattgagatgctgttttcctcttggcatgggatacatgaccactgggaatctttggacttacttggccttttggatccaaccaatggcccagaaatcagaacagcttggttctaacctcatccagggctgttaagataatattgaggggagggctccattagagggaagatggagggatgtgctgcctcccggaaaagacgccaactggcctcctctggcccactgtcctttgtgcctttgaaaggaaacgggtgtcctgtgggtagttcaagaaaatgagcccttttgtccacctcctcatttcctgtgcagaggcctggacacctgagctcaggaagcactggactcactgaccaaaggggagggtccactctgtcccacacggctgactgtcaaaaagagaaggcagcagtggagggaaatacaatgctcccagtctgattttatttcctcttaaaaaaacaaaagaagctctttaagagttcatttgaaacagaacgagaagggaaaacaaaacaaaacaaaacagttccatgataggaacgtccatgactgggaagaggcatgagtgatgaaagttttctgtgtcctgatccggatggtaggatgatagtgactgggtgtgtacataggtacaagttcctcactttatatgttaaagatgtgtacatttaactctatgtaagttatacctcaaaaccaaaaacaaacaaaggtgactactccagaaaaagctttaaaaaaataaataaaggatggctgctgccagccccctctcccccatggcattctcctcttgaggttgtaaggtactgccctctacttaggaaaaaaccttggggtctctattgaacctgcacattgatatcgagagtgataaagtgatctgagcacacactaaaatagttcccgagaagaaagcattcacatttgggaagccaaacaaaagatttggcaggaatagcatgtagtaccctaaactaccagaaatatactatttcttgcccggaaggaatttcagctgagtaatgagtccctttgaggataagatcggtgcctcctggatgaagaggagaactgggttcccagtggccgcagtgcctttgcagtaggccagatgacctggatctgccacccaaggacttctctgccagagtcttatcctgtgttcttgctacacacaaaccaccataggagggcatcatactagtttgagggaccagaattttatcacatagccagatgatggaagaatgaacgagttttgtttacttgttaggggtcagaagagaaaatatgggcccagttataaatggactcctttcaggataaattcattacatctcttggaatttgtgaatgggagttggtccaagcgtggcaacgtcctcgggtcacctctgacatcacaccccatgcagaaactgggccttccctcacagaagcacccggtggggttggggaggggcagaattcagatggcacctccacagggactcctgaaagtcactcaaccacatcttttctgatgcaactgacttactttctgcctccatgtttgttaaaagtcccgccgaatttattccgactcaggatgagagcagcaatttcgggcacgtagcgggcaaacattgcctacatgcatgaaacaaagaaacaagagccaaaaaaaaaaaaaaatggcatgcagagaggattctaccgcagcagaggcagcaaaacctcttggcatacttactttcttccactaaccgcactataggagcccccgtatttcttgcggtttcctattaactctatgatttcagggacgtagctggcaaacatggcctgagaagataggagacagaagagagactaaaaagacaggccaaagaaaaggggggacctgttcagagggtgggggcactaagatctgaaaacacaaaaggattaggcctgcaaaggtatatattgatatgttggatcataaaaaactaaaagcacgaagagagcaagctcccagaaatacacaagacaaacaaacattggccaccttgacaactaaagaacaaaaaaaaatcacagtcgagaaaaatacaaaggcgacaggaataaataaggtgatatctagttcttcttgctgaagaaaaataggcaagagggggacatgctagtgaaactaaacacacacagacacatgtgtgcatgcacagacacacacagtttcgcaagagaagatcttcctttgtcattaaaattcagaggagaatcaatgcttttatgagtgacaaaagaaaataaacaccaaaagattaaaaactacatttttctattaaaaaaaaaaaaacactgaaaagctcaaaagggaaatttaggaaatcacctgggaggagaagatagcaaggagaaacacaaatctgccatgttttgtccaacaaacatctggcctgtggctggctggatgggtctttttatctataggcacctcacggatgctgtagaaatgcttgcgtgaatgtacacatgcatgtgcacatttatatacatttttaaaatgtataggccctatgcatacaaaacagagagaggtgtatgcatcactacatataaatgtgcgcacggtgtacatacatgaaagctgtgtatggattaggattttaatcactcgcttcataaatggcaaaaaaaaatctaaacttaaaatgagctactttgaaagacaaaatgcagcaactgccaacgtgtggccagaaatcccctcgatttacattagaaggggtggtttagtgcaacataaagagctgcgtagacttttaaaaagcaaacagtgaaactttcttagaagaaaggagcaaaaataccccatgtgtccgctgcagaatggagtgagctgtttgcaaaactgcactctgctcacatggggatgtccgcctggacaagactaaggtgctctctctcctttgatgtagggacccttctctttagggcaggccccagccacagtgtttgttggaagttaggggaggaacataaaggggaagggagagctcttgaaaccgcaaactgtctctacaaagtatcgacagcttctaccagaggcaggtgacagccactgtccttgtagcataccagatgctgagttacattgctaaggggtagacactctcccttattaacagcatcacttttcttaagacaattaggtttgctcctggctaaatggctgtccccgacaagggcaatgtgcctggatctatgggacaagtgtaatacaccaagaattatgcagaaaagtcaccatcgtgtttggatttacttagcctgattgtaacgttaaggcttgcttctagtgcagaatacagtctaaaatacaaagctttaaggaaatgtatcatggaaaatattaacagccatcaaaatcaacatcataataaagatttttttttaccagtcccccgaggatgaagaagaccatgaagaggcgcccaagtgtggtttttgcataaacatccccataaccaacggtggacattgtgaccatgagtaaatagacacattcccagtaggtgagagcctggttgttttggaaattttcccatgggtcccctgaattctccacctaaagcaaatgggacaggggagaaaaaagaaaaacatgctattgaagtgtatacatgcaataaacgcggaagctcggcactctcgaaggccacttgctactgcacaccactctccacacgagatgtgtggttcccgggctgagttctgtgagtcaggatgcagagctcctgagcaggacacagagaaagtggagaagcagctgcaggagatgtcttcctggctgattgagacagagagggaaagcaagaagggaaatatctctaggccttttctcttcttctggtaaaatgtgggaagccagctaaaattcagggcattgcctctggccaggttttagagcactctcttcaaggaaagagccagagattccgtccctgaccttcctcaatgggtttctaaggcccagatggcctggatctgcctctcccacagaaattctaaacacttccgtagggggctgcctccttccatcagtttatccaaagagtatatatgggccctgcttatttctgattcaaacagcatctctggaatctggccctgctctccctcctttgcaaattggcaatggtggtcccagccttgaggctgctggaatcttcacaggggcatggaaagtgagctcatgagaacagcttgcactggcacagcccgttagatcaagggctggcaaactttttcagttttgtgggcgacacaggtcctgttcaactctgcagaggcaaaacttcaacaaatgggtgtggctggatttggagagctttggcccgagactgcagtttccccactttcctgtccttccatcatatttgatctgccaacaaggctagtaggtgggcaggaaaggtactttagatactctcaggagagagggagctgcgggcccaattttactcaaatatgcctgtgatccacccacagggcctgtagacggtggcccccaggcctccacctctgcctctgcaaaatgtttccagggcctggcctctttcacacatcagtttgtcctcaatgtgccattttcacaaaagtttcctggtgaacctgaagggacttcactaatacccgtagtaaggtggggtcatcatcttattaaagacaactatctcctccacatatgtgatttgggtgcttcgtgcttggttacagcaagaattagggtgattaaggttgattttggccatgaatcccatcagcattaagggctgggcaggagactctagatctggtgactacgtgaggccccatgccccaaccactgccatcccaggcctgtcttcctttgggtgataattacctaaatcccaagtgtgggtagctaagcgcgtccttctatcccttatgcaaatagaggctcagccactggtggtcaactttatccaaagtctcagagctagacgaggctccttccagttgtaacagtctatgtttgcatgaaacacacttcccacaatggctgtgctctctaaaagcagggggaaagtctgccttcgggtggtgtgaggggcttgacttaatacaaggctttcaaagagtcactaatgaaaaagaatgaacatttttgaggtacaaatcagacaaaataatcaaaggtggcttttcgtaaggcggaagtggaaagaaattgagggatctgaatttgttgtttactaggaggtgtgggtccaacttccaaccttgtccccagaccttttccaggtgtttgcttaggaagcactgccatcttgtggcttactatagttattgcagacagaaggaaaatctaccaaagcccccatgacaataccaatgagcaatgaactgaaaaatgcaggttaatagtgcaaacattactcaccatttggaactagtttggggtaaaaaggttggaaacccagacaattgtgtggttgcttcccatcttcctgtctacaaccgaggtgaagttaatttccagcaagataaattttaggtaataaaatgactcagagagggtcttgttgcaggcaagcgagagcagaagggtcttcaaggttactcaccaaatggatgaacccggctgcagtcagccacgtgctgataaatatggagagcagattcaccagcttgatggaattactgtgcaagagacaacaagcaaaatccccacgttaccaagggaaggccctgctggggctgccttacagggtaacagcacccgcttagcaggagaggctgccacatctaactcccaaccatttctccattataagggaattctggaaggtggaggaagctgctgggatgaaggtcaggacagagcctagaggaacaaatttaactttggtaaaaattaacttttatttaaaaaactcttcaaatctacagaaaagtggaaagaacagtataatgaacacttgtacgctcttcatttagactgaccaattattaacattttaccacgggtgctttatctccctacatgctttttctcttatcccccccgcccttttttcttctcttcttcttgccatgtacatatatatatatatatatttgctaaaccatttaccaataaatcagagacatcatggcacaagccctaaatactttagcacccaactcctaagaagaagggcattgcacagcataatcacaataccattgcacgcctcagaaaattaaaacataaaaattcagtaatgctatttaatatgcagaccttatttaaatatctccagttgccccaaaattatgtttattgatttttttttattttccccccagacccaagtttcatgcactgcatttggctgttaggtggcttaaatccaactgtcaggaaacaaggacagagagtaaatattttaggctttacaggccatatagacattgtcacaaatactcaactctgtcactgtggcttcagagcagcttttggacatcatgtacaggaatagatatggctttgttccaataaaactttatttacaaaaacaggcagccggcatgggctatagtttgccaatcccagcttcagtcccttctaatgtataattgacaccactcctttgtaatgacattaaattttgtgtgaacctaggttgtcttctataatgttctatattctggatcctgtttatttacttatttatttttattttattttttattttttgagacgaggtctgactctgtcacccaggctggagtgcagtggcacggtcttggctcactgcaacctctgcctgccaggttcaagcaattctcctgccttagcctcccgagtagctgggattacaggcacccgccaccacgcccagctaatttttgtatttttagtagagatggagtttcaccatgttggccaggctgatctcgaactcttgacctcaggtgatctgcccgccttggcctcccaaagtgctaggattacaggtgtgatccaccgcgcccagcccagtttattttttaaataaatgttattgtgtatgtttgaggtttacaacatgatattacctaccatctcacatagttacgtttttgtgtgtgacaagagcagctaaaatctacatatttaacaaaaatcccaaataccatacaattttattagcaatagtcctcatgttgtacattagacctctagacttgatcatcctacatagctccctacttaagtatttctgttaagaatctcttcggggatggcatcacatcaggatatcccagcccaatgactagctccatccatgtggctaaggcagaaatgctaatgtctccactgagaggtgcccatttccctttgtaatgaatatgccaccttgagtgaggccccgagactgcaggaatatcctgctccccaaaaaccttatacctaatagctttagcattcactggtgttccttgagtggatcaactggaccttatgacattttgaggtccctaagagctgaggccttgtctgtctggattccaggagccctgggtccctggagcatagcagacccgtgactctgcactgagtgcactggtatctgcccctgctctctttctaaactgcatcctgttcagtcccactggggtatacctgaacgctgctgtcagcaggtcacttcactgtccaaaggcttcttgttgactaaaagatgacattcaaactctctccttccattgtcaacaccttgtgaagtcccagtctctcccaccacccctctttcacataaactcttgaaactgccatgccagctaaacctatttactatagctattgtttacactatttactcaacttgaaagcccttcccatctagtcaaatttccccattcttcaaagcccagttcaatccctactgcttccttaaagtcgttccatccatctgcaagacaaagtgactttccccggctctcaactccagccattcattggtaattgatcctactgacttaagatgtcttttgtaaagttttaggttgctatttgactcttgtgttccttgctgcatcttgcagaaaagaactctcttttctagctcttgcattttcccagtagtggcttaatgcagcctacagggttgcccaacccattagttttggtcagttcatctctgttatgactgccctctcttacctctcttttggagaaccaatgatttaaattctaggcatttaagatcacagtaatagtttcagctagcttgtttacagttctttcccagtgctcaccacatgtgccaccatcctaagtgctttaggatcacctgtgctttatgtatactaagtcatttaatgctcataacaacaatctttcttcttctatggaagagcacagaggaatccatagtcttagtttttccagagttgattctgacagttcatggaaagaataaacagattcaactttgtgggtgagactgatatttcaaaatgtgtggaacaactttcttctggctcgaaaacttggaaaaacagccaaaatgtccattctgtctctcttggtcatttctagagttaccagattataataattgccaatatttattgagcccttattatgtgttagatgttgtgttaagcagaattctctcctgcctgtaccttgtaagtcctctaaggtgtgctcccacattggagggtaagaaatagatgaagaactgatagccggcgacaaagggaggcctcttagggaggtgtgtgttgttcattttctcagggtatcgttaaataccaagtggcttcacttacatactcctggattcttgggacctgaacacagcagtgtcccaccaacaaccatgtagagtcctcttgagatattaaacctatttagagtctgagtctccttggtgctttggaaaaatgacctaaatatggtgattactaaactctaaatgatggttacagtgatattagtagtgcgttagggagctcttgccatatgcagaacatttaatcattgttgctaaaacagtccatgtttagctctgaaatctgattatttttatgacatcagtattatcacagatccctaggtttaggaatttgctttctaaatgaaactgtatgaccacacatctgaaagctacaagcaaaagatgcaaggttaacccctggtgggcattctccacagtctgaaatgtgaaccttgccaggttaagtagggctccttgggaagaaagagtgaggcacgccaggagcagggctgtgtgctctgcatagcaaaggttatatatctctgtgtggagatagtcatagccttcctggtcaagcccagggatctgggccaaacacgaagctaccagcggttagaatgatttgaaccattcagattctagcctgcttcctaagctttgagggagattatgatcttatcatcaacacctgatccaactaaagtcaatcattctcatgttgcctatacaattcctgagtctccatcccatgagttctaattcacatcgatggacacagtgaatcatgataggtcaggcacaggattcttgtagattagagacctcttccaagaaactgtggatgctgcaagagaaggtctggctccagagattacagctgtaaacccagagcttctggggcctcctttgtcctctatatgtttaacaagacatgtttcagttaacacagaaaatgccatgcactttgtacaaagaagtgtacgtttgtccctgttctgcttgtctctaatttttctctttgtttctggtactgccaggtgctgctggccttgtttgttttactgctctctttgctggacagatgtaaaatacccaccccctaaaaagttaactggactgcaccacactaacataaatggtctgaatgacaacatgagtggaacaaagtgaaattctgccaattcaatcccttaattatctctagatcccttcttctttctctgccccaatttgcactgcctaaggccatgccctaatacctcttccctggactactgcctcctaattggtcttatggtctatgaggtctttgatgcttcaaccccattctctatacaactgttggaatagtggatctttctaaaatgtcagtctaaccacatttcctctcctgattaaaatccttcaacagctctcatttgttctcagtaaagtccatgaatctaagaacctgcatgatttggcctctccctgcacatctcttgcagtctccatatagaatactcttctttacaaactttatcttggagccatttctaagttcatgtcagtagtaatgttttagtttcaaaaacgcctcccaaaaccatattggttaggtacacgatgactcatgcatatcatggaatgctatgtgagaaacaaaaggtgacatagtagatgtaatcattatctcaaagtagtgtgatgtggaggcaattttactttatcctatgtgattttgtgtgttgttgcaatgtttaccatgaacatattttcaaaattagaggaaacaggctgggcacagtggctcacacctgtaatcccagcactttgggaggccaaagtgggcagatcacctgaggtcaaaagttcgagaccagcgtggccaacacggtgaaaccctgtctctactaaaaatacaaaaagtagccaggtgtggtggcaggcacctgtaatcccagctactcgggaggctgaggcaggagaatggcttgaaccctggagacggaggttgcagtgagctgagatcacgcccagcctggacaacagagcaagagtctatctcaaaaaaaaaaaaaaaaaaaaaaaaaagaaaagaaaagaaaagaaaaattagaggaaacaataaggaaattcccattttggaaaaaattgctgagtgatccatgttttagtcatcaatatttaccacagtcaatgagatgtggaattacagcctttaaacacagctgctgactttcctctgacagtagaataagtgttctagcacctgtgtgttagatctccagtttgcagggcaactgagaaactgccaaaacctcagatagtgagagggagtctccttgtctcccctttaattggccgtttcaggctatggagtattctaggccccctatgggcttgcagtttgggaaagggccctgatgctggtcacataattgtgatttgcccatttcatcccatgcactttaattttccttctgctgcattcttaattctttatcaatctttctgcccaccttatgcttctctgccttatttctttcagctcttggcccagtgaggcagccaaagtactggaaatgaaacagcaactccaaatcattatttcaaattgcattgcaaagcctccatccctgcctaatgccacagattggcaggaattcaccgccaaagagagccagacaaaatctccctaaagacgattacatgggtcccccaacccacccttctggaaggaccgctatgaaagcagcagagtatggaagagtcacaggagaatcgctcaaaagtccaaaaccctacaaaagccaaggctgcactttctctgggacagaactttgggatccacacttggggatgcccaaaaggaaggagccaagattagccaggctggcacctggagagagaatggcctcagagagttgtcctaaagcttctagatttcttacaattacatgacgtttgcttctgtgcctggtgacctggcctttcctaccctcttaacctcatcctcctctttccatcacagaacgcttaatgtccaggagtgcagaattacccaaagtttccccaagtgttatgctctcacaccagtgtgctgttagcatcttccttgattagaagtcaacccccaccctacccctcacatgcccagccccatgaggatgacacttttttctacaaggcttacctaaaagtaaccttctcctcgaaaagatccttgactgccctgcaactcaggctaagcccagcttagttactcccctctcaacccctgggcatgctgacatcagcattaaccacaccgtcaggtggcctggccccctacgcagcaagttctctgacagcaggactcctagcatgcaccttgctgctgataccaatgggtgctcactccaggcttgctgaattatctcaaccatctggttatgaccataagtgaaaggaactctgaaaacccaggttgtgggtttgtggcaaaaagcaccctctaacaacaagagtttcatatagtgggaagtggggtgctggaaaaaggctgttttggggcccggatggcagatgcccagacagccttccaccccgtgactcttccctagggccattctctccctcgtcccctggctggctgcttcagcttccccgctctgcactgagagaggcagcactgagtgcagttggcaggtgagctgacaccagggatcccacagccacttcccgcatccaaaggaaagagaggtgagtgtcctagcagaaagtcagaaaaagatattcagatggtccatcattttctcaagttctaaaacggtccagggagtagacagtattcctcagagcaatggaaccttctcaaaatgctggcatcagagaataaaaatccccctaacatatgatgtaattgtgaaacagggagagacagacactacccaatgttagagagtgtcacaaaacaccatccctaccaaaaaagtaagtgtctcttaaggacaaggctctatgcttggtgctgggtactcacgcgttccatctttaaaacacagtctagtggagtgaatctgacatacgtaaatattggcgagatgctagcttcattgatcgtttacatttcaaaagtaatatgattctagcacatagaagaataattaaaaggcagaaatcaaggttattggcaatcagaaaaacatgaagaaatacaatattcactgtatgtgaataatattacattattgctaataaacagaggactgataaattcttatctcaggataatgaacagtaaaaggcaggaggacatacttttaaagacttcagtgccattggattctctttttcttttcaacttgactaatagaaagtgaatttgacctcacagtcacatagatgagcagtcagagagaggaaaccaatttggaattaaagcaaaataaaataaacaagcaaaaaaaacactaacacccaaggagtaaagccaatcataggttgaatttgttggctgtgtcaggttcattcaggaagctaggtcccagcctgtgttaccaggaaaatgatgctgaatctaatcctcaaaactacagatatattaattacaaatcacaaaatatggaggtgtcctgtttttaatcatttatcaaatgcatgaagggcaaccaaagaggaaatggaacattagaagttagcttcttagagtgtaatttcctagaagagaaatttatggcctgtacttattctccattagagcacgtctaacctcttttattagtttattcatcaagacagccttggtttcaggccagctctgcaagccggcaggtcatcaggaaagggatcctctgggggcttttcctcctggtccagttgtgttttccagatcataacgcagttaacagaagtattcatggtgcattcggcaggaggtttgtaggttttcccccaaaaggcaattcacagagaaagccccaagggctatacggatataaagtgaacatctaaaatgtgctttgaaatgaaatgattttctgtttgccgtatgaggtttgtgattgcctctcacagcattgcttctattgcctttacgactgggttcaatttcttatttagtgatgtaataaaggggcgatttagaatctggcagcaaggacttcccaatcaatgagcaaatctatccctcattcactgtgcacctttccccttgacaccgtggctcttatctgggcaaccccactgggcacacagatatcagctatgtgtccctaaaagtgtccctacttccctgcatgcacagctatttctctcttttcaccacatagttccctggccctgcagaagagagcaactcaaaccctactctggttttctctccctctctgtgttagatcactctttctgtgaataatataactattaataatgtcattgtgatgaaagcaagcacacctgatatttgcaacttggcataggggactggaatgaaaaaaatatgacgaagaacatcttaccttgttttaagaatattcagaaactgcaaaatttctgaaaactgtatcagtctcagagctcttaaaaatctcaaacctggaaaaaagaatgaaatagagatgcattattttcaatgtgtgattttaatgttcacagtctgccatttgatttacagttcccaagggtcgaagggatgggaagttcttgcagaagataaaccagctggtacctcagacatattccttcattctgattcttgactggtttaatctcgactgggaaatggactttctctttataaaggtggcctgtttggaacctctttagaggaagggctcatggggagaagccaggttaatgagacttttcatttggtgatctctgattgaaagcactgtttctaagttacctagttatctggcaggattttgtctctgaaaaatcctaggaattgtgatagctcagggtaacccttgtgctaagagcagattgagaataaatcggataaccttatgtctttgatggattttattttttatctttatcttcagccctgataaaatgaagagtacagcccacagtgttatctgttttctacaaacttctatattttcctcccaataaaaaaaaaaaaaagatcagtgagatatcacaccccacaacttcaggattcaaaatttatatagttccccttttattaagtgttaagataaatggtttgtcctttctaaatcaacaacctctcttgaatgaaaaagaagcatcagtgtttaggtggcagaagagagatggagaaggaaaacacatcaaggacattttaaaaatgcaaattattatgttttaatagctaagagtgaattatatttctgttcaggtgaaattcatggtcaaaacattcagtcagtcctgggctataataatttggctatcatgcaagggaattacttacaaaatgctggtttgtcaccgctttgagacacattgaatgtcacacccactcccaaggggattttcttttgcagactttctagaagcattttattaagcaccgccacgtgccaaaggcagtgcgaagccctccagtgcactgagttgacagacaactccacgcccgtgggtggggctttgttctcccacgcccgtgagccagtaaagggcagcctagggcacagtggtgggaaggaatccttactaccttctacttgaatgaggagtacactaactgcacgcaacgtggagctgtttaggtaataagggaaaattaacttaaagttcatggggtgggggaaaatctgtacaaggaaagagggagaaaaggattggctcaaaaaaataatttctcatctgaaaaggattaaccatcatgaacagaagactttttttgaaaacattctccttctatgctaaataatacttatataacttttattaaataattgcagagatgagacgggatgttgatgaaataaaaaggctcacggccaaaagcacagttgtaactgagctgatgaaaggctgacttagcaccgctgaaaaccgaccacggcgcagagtacaaaactaagaagtcacctcagaaagcagagaaaatatgagaaagggagaaaaaaaaaagatgaaacttcagaaaatagaaacacagtagaaatcacagagatccaacccatggataaaatgtgttggccaaagggaagtcaaaacatcacattgatcataagcaaaggccaggacataacagaaaagaacttttgagatatgaaaaaatgactggagactaaaaggtaaaatgaaggatcagttcttagagaccaatgccaagaagcatctggcttttcattttcacatttcaagtattaaaatcaagcaataaaaataaaccaccagtgttgatggggttatttaccgttaatgtaactaagatcattatatttaacaaaaagtgttggccgggcacggtggctcatgcctgtaatcccagcactttgggaggccgaggcgggaggatcacgaggtcaggagatcgagaccatcctggctaacacagtgaaaccccgtctctactaaaaaacacaaaaaaattagccgggcgtggtggcgggcgcctgtagtcccagctacgcgggaggctgaggcaggagaatggcgtgtacccgggaggcggagcttgcagtaagccgagatcgcgccactgcactccagcctgggcgacagagcgagactccgtctcaaaaaaaaaaaaaaaaaaaaaaaaaaaaaaaaaaaagtgttaaacagcaattgggcaattttcagaatttttagacaaacagaatttgacccaagatttttatacccagtcaagtggttgttcaagaataaaagtaacaaaaaaaatttcaaattctaaggtctcaaaaaatacattgtttgctcagtgtgtgcataaagtttccaaagaggttcacaagacttgctaaatcagaatgggagggggcaagggctggaaattaaatttataacagactctactgctggtcctaaccttccagcccaacctagactgttatctcataccagtatcactgtcgcatattgctgagctaaaacgacaaatgtagaaacgtggagtagaaggcgactggcagttagcactgaaactatgaaagataacaacactcttccatgttccttgagggatacattccaagacctcccagtggatgcctgaaacctcagatagtgccaaatcctatatgcattatatacacacacctacggtaaaatttaacttataaattagcacaggaagggattaacaatggcaataataaaatagaacaattatgacaatatgtaccagcatcactatacttgcgctttggggccgttattaagtaaaataagggttagttgaacacaggtaacatgggttacagcaagacatcggtctgcccactgaagtgccctgagagactaatggccagggagtgcagatggcacggatgtgctggacaaagggaggattcttgtcccagatggaaccaagcaggacagcatgcaacttaaacattatgaattgtttatttctagaatttcctatttaatattttcagactacggttgcctggggataactgaaacctcaggaagcaaaaccatagataagaggcactcctgtagaaatacatgctagcaatgtattagccatttagtgtttaatcctgaacattctgtgtgtgcatagatatgcttttatttatggaactaaaaatagaatacaaacaacctgaacttcaaactggatttcttctttttatctttaaacgatggtgtttgtatcgtatatccattgctgattggcagcttgccacatttgagtgagttacacaaatatagtagaataaaagcttttcttttaattaaggtgcatgaaagtaagggcaggaaagaaatgaatgcagaggccacaaggtcctatactcttgctagacacaaactgcagatctagctctgagcaccttcttaacaaaagcaagcaggcagacaggataagatcaatagtgtatacatatgagagaaaaacaaactggcttgcaggagaatcatttatttttcccaacatggagaccagagggaaatatctccttgcaaaagggacccagggtgatgcaggagcaagacccctgtgggctgaacaagggtggcctttgcttatttgactgcctcatactgggcatttttatggcactgagtttcactaatgcaaatgagccaatgaagttctccataggttaaaaaagtcagtctacatttcatcctcagatcaagccagactatctggagaaatggttggtctttcaggaatcattcacaatagcttccgtattagtccgttctcactctgctaataaagacatacccgagactgggtaatttataaaggaaagaggtttaattgactcaattccacagggctggagaagcctcaggaaacttacagtcatggcagaaggggaagcaaacacatcctacttcacatggtggcaggaaggagaagtgttgagcataagagggaaaagccccttataaaaccatcagatttcgtgagaactcactatcacgagaacagcagcatgggggtaactgcccccatgattcaattaccttccacagggcccctcctacaacataggggtattatgggaactacaattcaagatgagatttgggtagggacacagccaaaccatatcagcttcctaaccgctttctgccctggaccccttgtgttctctgctcagaagcctccaatgccacccattccacacagagtaaaagtcaaagtctttcaaaggcctaaagcaacaccatcccaccaccagcactatctccttttggatctgatggcttcctactgtcactcctactactgtccgctgatctggcagatgtcttcagtgacacttgaacacacaggtatgctactgccccagggcctctgcacatgcagcctctctgcctggaatgctgtttgccagatgcccacatggcatactccctcacctcctttgggttcttactcaatgtcccttgatcagcgtgactttccctggctacccgacctaaacatgcaactcctcccacaccacccgtgcaactccctatcctctttcctgcttcacttttctcctcagcatgaagcactagcacctcggttatgtggttactttctgccttcctctctttagcatcagctctatgaggggaggagctgatgtctgttttgttcagggctatatttccagcattgaacatagtgtctggcataaggtgaaggctcaataaatccttgtttgaactgaatgagtgaatcaaagttttgagaaataattagacggcggagttaaaggttagataatccacattcagaattctgagactatatgttgcctactaaagggaaaagccagaagccctgcggggtcccctgagagaggtcagggctgcactcttgggaagtagaaagtagcctcatcagggaaaagccttaacgaatgaccactctggctatacccagaaagagcccagaagactacagacagcgacttcaggctaagagaggagaccaagataagagaggtgagagggggaactctttggtgacaattattcatcttctctattttataatatcttttattatttttattctataaaatctctgaaataaatgattttctaaggtaacacaaaatagctataatagagttgtgaagaagaaaatgtgtatataccaaaagccaggaattacatgccctccccaaaagcttccaggttcagagagttttacaagtgagatttttacagtttcaaaaaatagtaacttctctatctattctctattatatgatcaattcttaaaaatggacttatctgtgtttttccatgctctgtattggtttagaaagttggcattacctggacacaagttcccttgcattttttcttaaatggcaagcttatcacactaatgactaacaacaataatcctaaataaaatactagggtatcatatccaagactgcattaaatgaataaaagacatgagctatagcagatgctgtagggtacagcccaaatcccctcttcagggaccttatttgtcctgggctcttgaagagtgacctgctaaaggctcagagctagtcccttcatgagaactgccctctgctacaaggagctgcctcacctggggctacatcccctgtcagtggtggtgccccccacccccccaccccccccccaccaccacacacaaatgctggctgatgtagggacaaaggtcagctgccttgcctcaatttgggatactttttcctgtgggatgggttgaggcttcccaggcagctgcagccagcctgagttctccacccttattccctcacaggcatgggcattaaatcctaccctggtgatctgcataccagaagaccgagcattctaagagtccatgtgggcatactggaggcactcagtaaatggtaatttcatcatatgaagaattacaatagcgtaggagtgtacacacgccacagaaaagtcatcaaactggactagaaagcccagaaacacacacacaaacacacacacacacacacacacacacacacacacacacacacacacacagagtacatatagtgttactattattttaaattactggtgaaatgatgatgttgacaatgacattaatctattattattgatgatatctagtatgtttatttacttacacacactaaaacttctaactatatcttttttaaaaaatacgtacacagaagaaaatagctaaggagacacaaatgagacagtgtatccagcatagtttgaaagcaacagagccaagtttcaccacaaatgtgacaaactccacaaagcccaagcttctagccactgccctgtacagacttcagccagtcatttccaattcagacattaggactcaagcacacactttcaagacttgtgatacatcttaccaacttgtcctcacaatttgcattcccttcagtatgcaaatgctcttttgcctgtattcccactggattgagtacagtgatagagaaaataggaaggaaggaaggaaggaaggaaagaaggcatgaaggcaagaagggagagaaggagagaaggcaggaaggcaggaaggcaggaggggaaagggagagaacgagggtaagaatcccaatttgaggtcgggcatggtggctcatgcctgttatcccagcactttgggaggctgaggtggactgatcacttgaggtcaggagttcgagaccagcctggccaacatggtaaaaccccgcctctaccaaaaatacaaaaaattaaccaagtgtggtggtatgtgcctgtaatcccagctacttgggaggctgaggcaggagaatcacttgaacctgggaggtggaagttgcagtgagccgagatctcgccactgcactccagcctgggctacagagtgagagtccatctcaaaaaaattaaaaatttaaaaattaaaaaaaaaatcctaatttgatagaccccaaataagagctcatggctgttttattttgcttttctatcttaacaaatgaagctaattattttttcatataattattagtcattttattttcttctctaaagtgctttagagtggcctttgccagtctgcctgtgtatttatcttaattgtagtaatacaattatgttctcatataaagaagattttgtataccatatattatctcccaccgttcgtcattcttctcaatttggcttaaagtatttttcctactgtcaaattttacttaaggtgggtttctttccccatgaattctaaaatatatcaatctttctaccatgttccctttttttaaaatttttttggccatccccatcatatagataatttttttttttttttttttactgcatctatttttttttctttgtacttttggggcactggttctggactttgactgtacatttaaatcacctgggaaacttttagaattgttgacacctgggtctcagcaccccctacctgcattctgatttaatgggcgtggggtacattcaggcagagggagtattaaggctccagagtgattctaatgagccatccaggttaagaagcattgcaaactttttctataaatgaacatatagtaaatattaataaatattttaggctgtcacaacgactcaactttgctgtaaataataggaaaacaaataggtgtgaccatattccagtaaaatgttattcatataaataggccatggacactaattttctacacttgctttggaggcatgggattcaaatccattgtgcacatgaatcacctggcatttgtaaacatccagattctgactcagtgggtctccgatggggcctgatactgtgcatttctaacaagctctaagctatcgtcaatgctgttggtcagaagaccacactttgggaaaacaaggctgcaaggcagtggtccccagatttctctgccattgcaatcacccgaggattttaaagcaatactgaggcctgcttcccaccagattcaacgggtctgggatacaagctgggcatcagaatttttataaattctgattcgagtgtgcagccaagtttgggaaccagtggttcagaatatattttcttttctctaacctttaatttgttaatctgttttgatgtatttatttattttggttaacagtgcaccaaaaggaccaagctttatttttctaatcaagaagattctaatgtacagccagatgatggatgaggatgagtccagtgtacagccaagtttgggaatcactgctttagagtatcttttattttctttttttaacctctaacttgttaatccatcaggatgtatttatttattttggctagtagtatgccaaaaggagaatgctttattttttctccaaatagcaaatttccgttaatccgagtaatcacttgagtaatttaaaaccagtaatctaccctctaagcacactaccagtctatttaaatcaattttaaagaacatactggctaactagaagttaaatcaataatacaataaaagattatttataaaacaaagcattcagcttaagattttgggggaaaagtagtcttgacaataggagaaagctgattttttagttcagtgtttatgactaaataaccagaaaaccaataaatatgaaaaaaaattttaaaaatctgtagaattttatgggagcaaacaatggcaacaagaaaacaaacaaaataaagttctggctgatccaataaaaaaagaaaaaaattatccacaatgatattctaataaatctgtgaaaaacctcagtgagagggatgactttctgaaaaatataaacttcgaaacttgatacacacaaaaaagaaatccattataggataacaattgagatatacattgaaatatatagtaacagcttcccttacagactctgcacccatatataatttatgattaaattattgcacatacattttattaaaattctaaactgttccataatacaaaacgagatctaaagctactaacttatattataaaataaacataaactgaggaccaaaaactgactctcaaagcacaaaaataaagtagaaatggccctcaacttacaatggttcaacttaatgattttctgacttttcagtggtgcaaaagtgatacctattcaccttaaaccatactctaagtattcacacaaccattctgtttttcactttcagtacagtattcaatacattacactaaattttcagcactttattataaaatatgctttgcgttagatgattttgcccaacagtaggtaatgtaagtgttctgagcatgtttaagatagggtaggctcagctgtgatgtttggtaggtgaggggtattaaatgcattctcaaacttaaaatattttcagtttatgatgggtttgtgaggatgtaactccatggttaaattgagaagcatctgtattctaatatcactaagatcatagatgccaaaattctgtatataataccaacataaattattcatcaatgaattaaaatgataatccagagcattctagttaaacatagcagatggatcacaatggtttatgtctgccccctctcaaaacttcactaaactaatacaaatgttgagggggtaggaaacagcagaatcccacaagaacaaaaagaatggaagaggagattacaacacagaacagacgaacacaaaatgtgggtagatactctgttagaaactgacttggcatacatatatatgtatttatttatatttatataaacatatacatatattttccatgtatatatttccataatgagaaagaaagacatatacacacacatatgtctatctccacaatgataaacagaatattaaaaatgtctttggtcaatacataaagactgaggttgatgggggggtggttgggatgcagagatcacagtgaagaagaaaacaaccatccaaaaggtgaaatgaagtggctgaccctgggaagaaggaggctgtgacaataacactgattgactggggtgccaaacaggagtagtcactacatggcagcaagtgcatacacttgaggtgttaaaatagagcaatatcctgagtaaactgtaactcttggaagaaacacactgtctctacagctgtaagaccagttaccgaatagaaacacacagtagcatatctcagtactccccagacaaactgcaacacacaaagacagcattcacatataggctaacagaagatctcaaatgcaaagataagcacaaaacaggccaagcacggtggctcatgcccgtcatctcagaactttgggaggctgagcaagactccatctccaaacaaaaaaacactgtcaagtacatctacatataaccacatggatgaatcacacaggcgtaacactgagagaacaaggcctgacacagagtcattctatataacccagttatatgaagttcaaaactgggcaaaactgatatatggtcaggagagtggttacctttgtggggtgtagtgactagaaggttgccaggagaagggactagggggtgacaggcaataatgactgtttcttgagctgagcgttggcttctcaaatgcattctcttcgtgaaaatttatccagctgttgccaggcacggtggctcatgcctgtaatcctagcactttgggaggctgaggcaggcggatcacttgaggtcaggagttcgagaccagcctggccaatatgatgaaaccccatctctactaaaaattcaaaaattagctgggcatggaggcaggcacctgtaatcccagctacttgggaggctgaggcaggagaatcgcttgaacccgggaggcaggggttgcagtgagctgagatcgcgccactgcactccaacctgggcaacagagcaagactcggtctcaaaaaaaaaaaaaaaaaagaaaagaaaagggaagaaaagaactaaagaattgccaaacatttgaggaaaggcaactttccttcaagaaatgcacatattacacttcaggccaactgacccttaaggatacaacattaacaaagcattaaacaaaaaatgctttagaaaaatatttgaaaaatataaagagttgtgaaaaactatctcaactcaaaaaatcaactaaatatcttagcaattaaaattttgaacatcaaaatcttaaaaggccagcttaatagaagaatgggcatagccacacagcaaagtagagggctgaactatcacacagccatcttcatacaaaggggcacaggaatgaaaagtgcaaaagaaaaactaagagacccagaaaacaggaataaagttttccacatccatgtaattgagctgccagaaggaaaaaatgaaggaaatagagaacaggaaacatttaaaataacattaaagtgtcctagaccgaaagaatgacctgtatcctcagattggaaaggtcttttaagtgtccagcaggttaaattttttttttttttttttttgagatggagtctggcactgttgcccaggctggagtgcagtggcgcgatctcggctcactgcaagctccgccccacggccagcagattacattttcaaagacctaaatccaagcatattgtggataaattttataacatcaatgtgaagaaataaatcccttcaaagcaacaagagtcaaattattgtcacaattctcctggcttcactggttgcaagaaaacaaaagaaggatatctttacaattctcaggacagattaatttgaaccaagtaatatatacttagccagttgaaagaaaaataaatccaaaagaagcaagatacaagaagcaacatggaaaagataaaagtaatggattcatttatgtgttgactgagtatgttttaaatgaataaataataacaatgatccaaaattaaaatctctggaaataaatggaagatggaggtgtgaaggagagagggcaatgggaaaaagaaaggtgtgcagaaattcttgtcttgataggatacaatcaatcatatatattaacagaaaaaaattaaagtatgtgtatcaaaaccttaaggatataaattccatagcctagagaaaaaaaaaaggacaaaggaatttaatcaaatggagaaaagaaaaaaagaacaaaaacttcagcccatccaatgaaaagaaaaaaaaaataaaaggtatattaatcagaaaacatagttacaatagcaaaagagtccaaatatatttgtaatcataataaaattaaattaaaattactttcacctatggaaagacagagattcacatgatatgaaaacaacaacaataataaattccaggcgcatgctatttaaaagacatacactgcaaacaagacatacagaaaagttagaaatgaaagaatggaaattatgtgcctggcaaatgctgagaaaagaggaacaaatagagcaatgactatatcaaataaagtggcagctactgcaaaaagttatataaaaattatatataaacattatattaaaaagaataaaaagtaatatctcatattgataaaagaaacaatccacaaagaatgtgtaacaaaaaaaaactttatacacctaaaagtattcctttgagataaataaagcaaatatgacaagaatgcacaaatataggacatttaagtagcatttaatcccttgggatatattcgtatctatatgtatctgaatggatgggcagaaagacacacacatatattagtaaactaggaacacacattctttaataacagccatgagcagtctcaaaaactgaccacatattaggccacaaagaaatttcatcaaaatctaaaatgcaaaaatcatctaagtcacatttaccacaaagcaatagaataagaaagtaataagagcatggcaacaatgactaagcagtagagaaatagactctattttatcagaagaattttacagacaataaagaggtcatcacaaatcaaaaggaagacaggcatcatgcaatgatggacctcataccataatggaaataagtttgagatgaattaaaaattaaatatagataataagggacagaaaaattgaggaaaatataggtatatattattagccctctgaaaagaagaatttctaatttcatgtgtaaaaggagtcatacaatctttgaaatacaggctctgccaccaccataaaaacgtcaaaattctgcatgtttaaaatcataataaacacaatatccaatgaaaaaataatcaaatatgatacaataaggataaattctttgtaatgtcaaaagcatgtatgtaaaatactttatcattagttgataagtaggcaaaaatcaaacagctacatcatgaagtagataatataactagtgaataatcattaaataaattaattaaatgaaactattttatcttaacttggttcaaataaaaaaaatgtgcaccatatacaaaaaccaactcacaatgaattaatgacttaagatccaaaactgtgaaactactagaagaaagtattgagaaagagccccatgacaacggtcagggcaataattttttggaaatgacccctaaaacacaggcaataaaagcaaaaatggacaaagaggattacatcaaactaaaaagcttggcccaacaaaagaaagaatcaaccgagtgaagagaggcggggcgcagtggctcacgcctgtaatcccagcactttgggaggccaaggcaggtggatcacaagatcaggagatcgagaccatcctggctaatacggtgaaaccccgtctctactaaaaatataaaaaattagccgggtgtggtggtgggcacctgtagtcccagctactcggcaggctgaggcaggagaatggcgtgaacccgggaggtggagattgcagtgagctgagatcatgccaccgcactccagcctgggagacagagcaagactctgtctcaaaaaaaaaaaaaaaaaaaaaaaaaaaaaaaggaagaaagaatcaacggagtgaagagacaacctacagaatgggagaaaaatatttgaaaactatacatctgataagggcttaatattcaaaatatatagagaacacatctcaatagcaagaaagcaaatagcccaattaagaaatgggcaaaggacctgaatagacatttcgcaaaagaagaaatgcaaatagccaacagtaaatgtttaaaatgtttgacatcactatttatcagggaagtgcaaattaaaactacaatgaactatcacttcacatctgttagaagggttattatcgaaaagacaaaaggttaagtgttggtgaggatgtgggaaaaaggaacccttgcatactgttgatgggaaggtaaattagtactattttccattatggaaaaaggtaaaaagtttccacaaaaacccaaaaatagaactaccatacaatcaagcaacctcaccactgggtatatattcagaggaaatgaaatcaacgtgctgaagagatgtctgcactcccatgttctttgcagcactattcacaatagccaaggtatgaaatcaaccgcagtgtccatcaacagatgaatgaagaaaatgtgatatatatacacaatggcatattattcagccaagaaaagaataaatcctttcatttgcaacaatgtggatgaacctaaagtttatattaagttaaataagccatgcacagaatgacaaacatcacgtgatctcactcatataaaacagctgatctcatagaaagaggggctggggcggttggagggaagggtggttgggtagatgttggtcaaaggatacaaaatttcagttaaataagagaaataagtttaagatatctactgtattacatggtgactatagttaataaccatatagtattcttgaaaaatgctttaaaaaattaaaagaaatgcaaattaaacaaaaataagtaagcactgtatttattctacttaatagcaacatatttgagcttcacctagtggagatgactctacaatgaaatagtcttataattccattgtggaattataaactgataaaaccttttcagaaagtaattcagcattattaatcaaagtaattccatttctgggaatatagcctaagaaaatataacaaaatatggaaatatgctacagaaacaaagatgctcattgcaaaattgttcattaagcaagaaaaatagaaagcagcttaaaatccaaaaataggtcttacgtctgatacatcttctttataggatattatatatgctcaaagattgtaacaaggaaaatttttgacataatgttaagttaaagaagtagaatgtcgaaattaaaatagcgattaccaggagctgaggggagaggaaaaattatttgtttaatgggtttagagtttcaactttgcaagatcaaaaagtactggagctctgttttgcaacaataggatatacttaacattactgaactgtacactaaaaataattaaaatggtaaattttatgttatgtgtttttcaccacaattttttaaaaatagcaaattggaaatgctgaaaaaaaaaaaaaagaagtaaaagatgaagtgcatggtccctatgataaaactatgaaaactataggtatgtgtaaaatgaaaaagtagaagaaaagcataaaatgatgacagtggccatgttacaaaggcagacattttggatttctttaatattcttgagttttttaatttttttgtaatatttatatcaaaatttctatttttatgcataattacttattgctgtagtcataaagtcagtggcaagtcaggactggaatacaggttttcctggctccgagccctgtactcacatgcaagattcagtcacatgagaccattggctccaggtgaggaggaccccctgccagagctttcccttcgaaacttgctgcccagggcctgaacaactaggtgaggctcctcctgagaactattgctgtggaattttagcaatgaccagacagattaagggatcttgaactcccttctcagataaaagcagagttactgtactgacagaaattgagggataaacaggtaaatgataactcattcactgcttcagggttcctgtgatccccagagagaaaagactctggagattcatacatgtgaggtctcgggagaggacaagacagaaaacacaacagcaaacacatccaagcccataccagaaagcctgccagggttttccaatttgctattttccattccctttcactccttaatctttaaatccaaaaagctgaaaggttccaataaacgtctgtcgtttccaatctctgcagccccacgcaaatcctgaagagcaattatttttgtggtgtctgacaaggtcattgttatctggccttgcagctcagagggatcaaactgagggcaggcatatcagggtaaacagaggatgcccaggagcatggggaggcttcttcagggtggtcccctgcacccttctgccatcacaggtcccacctcccatccccagcttggtcactgtgaggaccacctgcttcttagccccagcacagagtgaatctgagcctctccttcccagctggagaaaaaggactgtctcgcttcctctcaaatgcccctgggcttttgttcccacagtcagaatgtgtgttctataaacagttcttgcttgtctgaccttttcaccatcctttcctttggtaattgttcaggttgttttgctccctacttttttaaaaaaattttttgagacagggtcttactttgtcacccatgctggagtgcagtggcacgatcacagctcactacagcctcgacctcctgggctcaagtgatcctcccgcctcagccccccaagtagccagccaccatgcccagctaattttttctatttttttagtgacacagtttcaccatgttgccaatcctggctccctaccttaacccagtcctggttcctgttctgatagatgctcaacatcagttgatattcagactgggattgtcgcccattcattcattcattcattcacccacacacatgcacagagtcactgcttccaccaccccttgtggttccagatgctgcagcacaggggtgaggctcctgcttccaggtcttctatttgaatagaggagccagtaagtagagaaacacattttttaaaagtaaacaaataggacttactcactttacctctttactttgttttaaaattattgaattttttaagagacagtgtctcatggtcacccatcctggggtgcatgatcatagctcactggagtcttgacctcatgggctcaaatgatcctctcacctcagcctcccaacatgctgggattataggcataagccattttgcctggtctgactttacatcttaaatatatgtgaaataacttatcttttccctctccactgccagaaccatggttcacactgctgttacctccatctggaccaagagccccacacgggtcttcctgcttcacttctctaccccagtccccccaggccccaccagcattctccagaaagcagccagcatggtcttttcaaatatccatcagattacattgctccctgccaaaagccattacatggcatccatctcactaaaattactttcagattccttatctcgctctggaaggctctccatggtttctgctcatttcatcaccactctccatgtcctcacgccctgcacacagtgtctctgctccagaaacatttcccagttcgtcctcagctctgagtcttcccttctgtttcttttcttgggaatgttcttcccccagatcattgcaaggttggctaatggaggtcttctctgaccacccgatctggagcccagtccttcgccgccattatccattcttctttatagggtttaccacaatctaaaatgatctcatttgcttgttcaggtgcctgcctcctgcccgttcctcagcagactatctgctctattggggcaggtgtctcactcactggctcactaccaagtgcaccctcttctagaacagtgatgactggtacatagtgagtactcactactgaaaattaataaatgcattaatcctttcaaaggaaaagtaagaagggtattggatactaagttaaacccatggttttactcaattattcaacgttttctcaggaagtagtgtatgtgcccttagcttaataattccatcatttggtctcttctctctagtggctttaatcctgattctctccaaggccagatgttacagtacagagcagctcttctctgtgatgaagggagaggaaatataacaatctggccagctaattctagggttatagacacagaagcatgaatatttagattccaggcatttcagctgacagaaacattttatatcagttctaatgaaaaggattgactaggtttcacttattgcttgccaactggaattttgttaggcacaattacataatgcagaagtatttgagctgtgcctacccacatcagaatcctaaactaggtttcaaagggactacattccattttaaagaaattcctagtactgctaactttcctggaaataaaagctatccctccctaagactgacatttttatggccagaaatgtacatttaatctatttgttttaaactgtaatatattatggatgcctaaataaagccaaatgcctatcagaaagcagttgagaaaagaaaatctgcctagaaaactattcttatgatctctgctgggtaagaataaaaaagtaccacccaagacaggcaagaccacgctcccatggtcaaatgtaaggacagaaaatgagccacaactcgcactgtagcccctgaaaaaaaaattatcgataggtccaaatgcctcttccaaaaatgctgactcactgaaaattattgccatttaataaataggaagcaagctattacatcgtttgccaaactttctcccacatttctgaaatatattctttaatagctcaataacattcaggagcactagaggccagttaaattcatctaaaaaggaaggacgagatttctgcctcacccagcacatctgcgttgggtgggtatgccaagaaaacaggaatcaaggtggctatcacctctccactagacagttccccaaatccagcctagacggaaagcactttttttcccaggcagcctccaggaatacggaatacttttgggaggagaagagccatggacgggtgagtccttaccccaggatgcacaaacaccacagcaagacaccaatgactgccggaagttcggcggttcctccttctccggagcagcaggcccagacttcacccggtagccattatggaacaggtcccccagggacttcttgcggcgcctgccgggtctgtaaagctctgtgccggttctgctggatgggtggcggtacaccagaatcttactggggatcatggtagaaggagggagatgggctaggctttcggctcccttccattcacttcttgcaggagtcaatgctctggaaagacctggaggagcctgtgttcctctgacccgtgctgcaaacaggtcctcctgtccagcgcagtgtgggtcaccagcatctatgtcctggtggagccaatagacactctctcctccctcaccctccagtccctcttgcaagaaccccggcatgctctgggcactggatgcacgcagccacatcagaaaggcggttaagaggggcgggggaagcactctgatccacgatgtcctgcgagctgatcaatcagcttcacgctggaaataaccatgtaagctcctttggacatggtttagggggatagaaagagaaaaggctataattcctcaaatcaagtggtatagaatagagtgtgagagaggctgcagtttggggcccactaagtcgtttcttttattttagtaatcctgcttaacaactgaggactcataaggaggattcccttagaggatgtgatgcccaacaagaaagaaaaactgaattgtcctactcctcctgtcgtggccacctcccaccactaacataacccaaatacgcaaatcctctgctaatcctacatacaggactgaggaagaagagggattctgggctatccagaggaagatgggaggagacactcattagagctccttggcccaccccctgcttctttgtcccattgttttcagcatcttctctcattaccaaccccagccccctcttagttctctgttacaggctacattatggacccccatccctgccaaagtcgtaggttgaagcccaaaccccaatgtgatggtatttggagatgaggtactttagggagtgattaggtttagacaagatcatgaggatagggccctcatgatgagattagtgccattataagaagagagaccagagagtttgctctttctccctctctgccatgtcaggacacagtgagagggcagccgcctgcaagccagaaagagagccctcaccagaacctgaccatgctggaatgctgatctcagatgtccagctttcagaactgtgagaaaataaatctctgttatttcagccacccagtttttgatatcttgttaaggcagcccagagtgactatgaaagtctcccttcccagggtactgagtgtaaacaaaaatatgacacagacagagagaggggaaacattaaaaatataaacaggaaaatatccacattccacaagttgttagctgaggctcctcataatttaatccccacctattttttcagacctctagcaaggctaaaattattggtagaattttcaaagcataacatttcttctcaatgtggattagttcattcacctgaccatgacgtattgagcatctattatgtgccaagcgttttgctgggtactgggtatttgctgattaacaggaacaatgcacaagtccagccttggtggcatttatagtataatcagagagtgaaacaatatatcataactgtaattaacaatttggttaaagtgctgtaaagaaaaaccctaagtaggccgggcgcagtggctcatgcctgtaatcccagcactttgggaggccgaggcaggcggatcacaaggtcaggagatcgagaccattctggctaacacggtgaaaccctgtctctactaaaaaatacaaaaaaaaattagccgggcgtggtggcaggtgcctgtagtcccagctactcaggaggctgaggcaggagaatggcatgaacctgggaggtggagcttgcagtaagccaagatagtgccactgcactccagcctgggtgacagagggagactccatttaaaaaaaaaaaaagaaaagaaaagaaaaaaagaaaacaaaaaagaaaaaggaaaaaccccaagtagttatctgagtatgtgtatgtgtatgttacataaatgtgtatctgagtgaatgtgtatggaaaatgtgacatacatacgcaaaagggcttcacaataattctatatcctaatgatatagtagcagacagccaggtaaaaaaattatggtgatggcaatttttttaggccgagggaacagcatgacgaatatcttgaagagggaagtagatggcctggtcctgacttgaaagaaactcaatgtgtttaaaaagaaattggtgagaaactaactctccaacacctaaagttgtctggaaatgatagacagaactacaggtcctacaaacactaagaggataattttaaagtattaggaataatattatgtctccaaaacttgacaccctgatgaaatgaacaaattcctttaaaaatacaattttctccaactgacacaagaaaaaatagaaaatgtaaacagctacatatctgttaaataaatggaaacttcaatgaaaaacattcccacaaagaaaatttcaggttcaggcagtttccactgcagaattctaccaaatatttatggtggaaataataccaatattacacaaactctttcagggactggaggaaaagagaacccaacttgatttataatgccagaataatcatgacattgaaacctaataagagtattatgaaaagaaaaaaaattacagaaaaatatatgtcatcaacatagacacaacaatccttaaataaatactagtcaaatgaatccagcagtatataaaaagaataatactttagaatcgagtaaatagagtttatcccatgagtaaaagattggtttaaaaaatgaaaattaattaatgtaattcaccacattgaaaaattaaaagacaaatcatatgatcattttaataggcatcaaaaaataatgaaactatgttgtgttaagataatgtgtcgtgccccccaaaaagacaagttgattaatgaaacagagtccagaaatagacccatatatatacaatcaattgatttacaacaaaagcaccaatacaactcaatgagaaaaataaagtcatcgccacaaatggaaggaaaaatggatatctacaaagggaaagaaatcagtctcaactcttacctaacacaatctacaaaattagtttgagatggatcactgacttcaatgtaaaagctaaatctgaagcctctataaacaaacacagcagagtgtcttgaggacactcggataagcaaaggcttcttagataggacacaaaaggcactcacatttttaaaaagactgataaattaaatatcagtaaaataaaaaacttctcataaaaagacaataaattaaaagataagccacagattaagaggaaacacttgcagtacatttatatgacaaagaacttacagaaataaaaattaaaactacaacaagatggcaccacaaatccattagaatggctaaaatttaaaagttgacattatcaagtgttggtgaagaaacaaagcagctggcaccctcacacgttgctagtagaagtgtaaaatggtgtatcttcctttggaaaactggcagtttcttgtaatgttaaacatgcatctatcctatgacccagagactcaatttctaagtatttacccaagaaaaaaaaatatatgtccacaaaatcatttgtacaaggatgttcataacagctttattcaaaataagccaaagttggaaacaacctaatggccatcaacagggtggtttgataaacaaattgtggtatatcccataatggaatattagcagcaataaaatggaagaaattattaatatatacaacaatatatacaaatatcaaaaaccttattttgaaggaaaggagctagttagaaaagtgaataccctgcatgattccattcatacaaaaattgagagcagacaagactaatctatagtgattgaagccaagatagtgatttttttatgttcaagggaggagagagcagatattgacagaaatgagcataaagaaacattccaggatagtaaaaatgttctctatgttgatatggatgacagaccattttacagtggtgcatatctctgtcagaactcactgaatgcaccctcaggatctatgcattttattgcatgtataatatacttattaaaaacattgagatgggctgccatgttagatggtatctccctgtcaacagagatactcaaacagagtctgcttgtaccaatttagggaacactaaagtttcacctgatgcctaaacagagatcatctgctgtaaccctgtaaattccctcccaacttccagtgggcagtatggcatgaaacccctgcaactcagagatggctggtttaattggagaagtgaaggatttgtattcaggctctgccaccagcagctgcacatctgagtaagttatgtaactcctagcctcatttcctcatctccgaaatagggattatgacatctacttcacagacgaactatccagattaaagaaaacgatgtttgcaaagctctgcacagggtctgacactcagcaaattctcctccaaaaatctgccaaagcactagggcccagtcaaactggtctatattctgccatcgaatgccccatcatcactgggcaatctggtctcctactgtaaataaaaaccccacctatctccatggggcacatctgccagcctcttcctaggaccctgtaggtgtggcaataaatgtggtccctggaaccagcagcaggggatttggttcctggcatctccacatacgagccacatgctcttggaagttattccaaccctgcctcaagtctctgacttttaaaatgggaaacacttttcaagataaatctgttcatcacaagaaaggatttcttataaatttgaaatatttaaaagagaattctatgcaaacgtatgcacacatacaagtgaatgtgggcccatttctctggacatgtgtctattccaaaaaaaactgtcataaactgtatcctcattttgcactcctcccaccagtgtgtcccatggtgccacctggtattgtctgcctgaaagaattctaggagggcttcatttgtctctgaagtcatagatcttcatctaccaatactgggaaaactcccttgctcctcttcctctgcattaggcttgtttttctgagacagaagtggtcagagaaaaaggacactggaatccattcattcatttaaaaatattgaccaagaaatgaactcagacgaaattgacctcttcagtgaagtcatatctaattccctcaaccctgtacaaagtaatagtacatttattcaacaacatattttcatggagtacctatttagaaaagagacggaatctgggcccagtgttataggattcaaatcccagctctgccattaattgggagtgagcattagcaagttccttcaactcaaagtatctcagtttccccaactataaaatgggaacagtaatagtaacctacctcatggggttattgtgaggaatgaattaatatctataacggttaaaattgtccttggcacataggaaatgttcagtcagtgcttgctataattattactaggagccagatactgggctaaccatattggggatacaaatgtgatttgctctaaatctatcctcaaaaaatgtacagtcttgaggagctgtttacaatctacatttgtatttagctaagataggaaagatgactatctacataattttaggggacgatccaccagcccccaaaagaaattagccttcttctcttccttgtttattgatgcctaaaattcccccataagacagcagcattacccagtaagaaaaaactgtgccttgggttcaaatggatgtaagttttgaccctggctctgctcctgatgcactgagagaccctggctgcttatatgaaacctgaatgtctatgactgcatgtaaaaaataaagatgagaagctgggcgcggtggctcatgcctgtaatcccagcactttgggaggccaaggcaggcagataggttgaggccaggagtttgagaccagcctagtcaacatggcaaaacttcgtctcttctaaaaaatacaaaaattagccaggcgtggtggcctgcacctgtagtcccagctactggggaggctgaagcaggagaatcacttgaacccaggaggtggaggttgcagtgagcggagatggtgccactacactccagcctgggtgacagagcaagacttcatctcaaaaaaaaaaaaaaaaaaaaaaaaaaaaagaaagaaagaaggaaagaaaaaagatgagaattatgcctctcaggggctgtgacaataaattgatctacgtgtgttttaaaatgcctttcacacagaatatgctacataatcactcattcctggtctcctccagaagtccctgcacttggcctctctctctcgggtgtaatggattggtccccattgaaatacatttccttttcagagtcatttatccctcagttagaaagaagtattgaccatggggaagggggactgtgaagccacctgggcatggcagagggggccaggcacagaggagggagcacaaaagaacgaacaatgaagcacatagagaaataaaacctaactcgacttgcaagccagtgatggccctatttttagctgacaagtgagtaatctgatgtgtgtgacttgaaacagggaacataaacatcaaggctgaatctataaccagccacatataacttgtactataacttattcccagaattctagactgtttgaattaagtgtctgcaggtctcttcttcacgcacttactcttattaagtttgggaactagaagcctgtgtcatttgcacaggtctcaagttacaagggaaaaagatgctttgcttggtctctggtttgactattccaaagaatctttcctaatctccaattcgtctttgtctcccaccccaccagcctccctccctccttcccttccccctgaaagctaaccatcagaggggtggaatagcctctaattcagcccattcttccctcatccctttccctttcatcatcagctagcagtgaaagtcaccatcctcttggacctcccatttctgaggcattgtctgtcccagaaccccatgcaggacattggagacaagtgaatctaacctcgtccaatctccctcttcttcccgtagataaaaacctgaactcaaagaagagaactggaataatcctcccttatcccacttcccatggtgagccccagctgggacgctgacacatggccccaacttttcctcctgcctgatgtctggacccacaggggacagatggtggtccctggtcactgaagtacccacaggtttgattattgagacttttatctctgttgactacagggaggacctgaatcagtttacatggttaaaataaaagcgccatatacaaggataaagcaggacagggcccccaccatctaaaagtagaagggatggggattgccaggcagcacctgccaccaccaagaaaagactgagaaagggacacttcaggcacaacatgtaaggaggtgctccttttgggactgaccctgcctttgcatagccctgggaatgagccaccctcatgtttgcacccaggcctctctcttgcctcatcctgcacctgccatgagtttactactgagctcacttctgaaattggctctgcattgcctgtcacctatggcaagagagaaacaactaggttatgactattgtgaactgagaaaacctataaagccaattcagagatcaaatctatcctaaaattaaattcaagcagaatttttgtgccagcggctttgaataaagactgaagaacacggtgagttatatcttcaattacagtttacaaagaacagaggtactccttccaaaaggggactcttgatttagctctctgtaaggacagaaagcataacactgaatcttgggtcagcaaaaacattttcacaagggcctcaggtatcatgagatttagctctgtttaattctgatgctcaacattaatttaaggaaaatgaagtacttgttttgggggggattaatttgctaccaggcacacctcagctgtgttttattctgaagctctaaattagcaccaggatcaacctggataatctaaatcaggggttgccaatttttttctgtaaagggccagatcataaatattttgggctttgtaagctgcacaatctctattgcaagtgctcaatgcggccattggagtgagaaaactagccacagatgatacaaaaatgaatgagcttggcctcgttccagtaaaactttccttacaaaaataggtgatggaccagatgtagcctgtaggccatagttggtcaacctctgatgtagctgacatcttgaaatgaggaaggaatgtttaatttgagaacaggtacttctacatttcacaaggtagaaatctgtaaataacaacatttggaagttccttctgtttcctgcaacactcactttagaacctaatatcatgctatttttattgctctggcttaattcagttatatagaaatcatttctattcaaatagacgatgaaatccttgaggtcaaggtctctgtccaacttctttgggtataatccatcgtgcctagcacagctgggaactttgcacttgcttaaagtgttttcttccctttctgaaggacagtgattcacatctctgcttttgacatgcaaggacttgacgatctatttaacctaaggggagaagagtctctttcaaagaatggattgtcatccccttctccctgcccctgccatgtacattatgcttctaatcagtctggaataaagcgatgtcatgggcataaactaatttcttccaatccaaaacaagttagcaagtctcattttgtaattctaaagtcttcagctcatgtatttatttcaacatttttttcctataaataaatggctgtgtgacttgtctccttctttgtgttcatatcccaatgtccagtgtagagtggccttcactaaatatgtgtagaaggaatgaggaaatgaatgcaagatgggcttagctcataaaccctttgttttgttagagacttttgccaactcttttaggcagttacaatattttgatgggcaagacctgtgctgttgggctgcctggtcaaacccatgcatagtgaaataatccgtctccaatctcagcctgcatcctaaccccaatttgtccctgagtgcaaggtcactgatctgaatttgaatggcaggctttgttgacctaacaactctgttaggctcacccatttctgcatactactggtgagtgacagaggatggacactgaaatctccatcttttcatagaacccatgcaagaggcacaaaaccatctgcttagtggtcatgtggcagcagacagtatctcagaagtcctcgcagcatatgacttcactgatgaagatggatcacacttgagcagggattcttgatctctgcaaaacagctcatacacaacaggaacaatctcacagataagaaaaactccagaagttggtctcgggctatgaaaatttctgccacaatatgatttatatgaaaataaataaagtgggtctactactttatcattagcaataagtggattctttcttcctgccacagacaaactgaggatgtaaatgaacaccatactcgcattgttgcttatgctgttgttcttcacccactgcctgaggtgtaggtttgcaaataaaatcaaaccatcattattctggactgattatccaattagagaatgaaataggccagccctgtcttccttcttcttccatcaaatgccattcttgtagccatttcactgacaacatgaggggccaacagaagaaataaacaggcataaatttcaaacccaggaaatttatgtgagcaaagggaaagaatccagatatataaaatgaattaatcatcaataagtcaccacatccctattacatggtaagttcttttctgggagctgttagggccagaaagggactgtaagacacagtccctgctttaaagaagtacaaacaatcaccaaaaataaaagcaaaactgaaaaacagcaaataaataatcatttatcagaaccaactatggactatggatagtttaaaagtgctgagagcatagcccacatggcagaagtgcataaataatgcaaaaccttacattggctgacaatttaaacttcccttcatgatcattcttctgtcagaaccgctgagagagataaagaagataataataacaaaagaacttcaagtttctggtgattctaagtaggttctagtttcaggagtattccaacacactatgttaccttagacaagtcatgttctctctttgtgattaggtttctcatcaaaaggaaggaaagaaggaagggaggaagaagggactgggagtgttggtaatagataacccttaatatcccattcagatcaaatttctataattataatgtggctctctgcctctggaggtcactcagtaacaaagaaatataactttaaaaatagccaaagtaggaaaaataacaatcattctcataaatctgcagtttctttctttctttctctctctctcttttcttctctctctcttctcttccttcctttctttcttctttctttctttcttttcttttctttctttctttcctttctttctttccctgtctctctctctctctttctttctttccttctttctttctctttcttcctttctgatggagtcttgctctgtcaccaggtgggagtgcagtggtgccagatcagctcactgcaacctccacctcctgggttcaagtgattcccgggcctcagcctccccaagtagctagggactcaggtgagagtcaccaggcccagctaatttttgtatttttagtagagatggagtttcaccatgttggtcaggatggtctcgatctcttgaccttgtgatctgcccccccttgcccttctgaagtgctgggattacaggcatgagccaccacacctggccataaatctgcagtttctacagctactttgcaactatgaacaaatgctagtgtacacagaaaactccctccctcctgtaagcttcttatgcatgccacagactctggcctcccagctgggccagatacatttgaatgctggagcactcagctgattaagatacctaatttctgaatgatcccactcacaccaggaggacagtgtttagagcaagatgttacatctcagttgactcaccttgtgcaatgatttctttttataaatgctaattgcaactcactaattaagagagatgttacactgggcaggaaaatcattgagtcaggaaatcttgcaattttctctagcatatttcatgaatcaaaagtcttgatctgatgcagttttttcatggcctagagggcagaataggagctgaataccacagcttctcttcataagggtggtatggaaatggactcccagtttaaaagagagtcaaatgtccatcctgggagaattagcagagtattgtggttaagggcagaggctttgaagacaggcctggactaatttatttttgcctatggtttaggacagagggtccaagactgtctttttcatcttgtcatctcagcatttaggatagcaaggggtacatagcaggtgctaaataaatgtgttgtgaaatttaagtcctggttctaccatgcataagctgtttcctagggcaccttccataacctcttggagactcttctgtttttttgcttttgtgtgtgtgtgtgtgtgtgtgtgtgtgtgttgttgctgttgtcattattttgtaaaatgggatgtctcagttggggttcctctgcaggagaacctgagaaaaggatttgattacaaatagttaacttgggaagtgatctcaggaaacaccagtaagggaacaggaaagtggggaggagatgggaaagcatccataaagagtttgttatcaagcatttatcactgtgggcaactaaaggaaaatcccactggggtactctggcagccaggatctacacatggctttatgtgtaaacagaagagccttgcgaccaaggggtgagggggctggggcattgatccaacacctcctgttggtcactggttgaggaggcattaagtccctagcacttacgacctgtagacaggcccacaagcaagcttcagtgactggagaaagtcctctggcaaagaaatgcagatgctggcaattcaaaatctagccacctgcactacaggtaagggcaagcgggtctgggttgcggtgacaggcaccaacagggccagcctcccaggaataataaaacctatgtcttaggttgatgtgaggcttaaatgaagcggcggatggaaaggactgattgcgaccctgcacactgtacctccattcactgagggcttcctgctgtcatgagaacatggaaaatgtggcgctccccactaaggcccctggagccatgcatcaggtagaatacagtctcaagggcatcttgagaccttatagatccagagaaatgccacttcctagccttggaaactgacaatgcacattagcatatggaaggctctgaggattcttatggttaagaaactctttaattaaatgaggatttcccaaacttactggagcacagagttctctttccaaataatgtatgccaactttcagtgtaatccaacactccatgaagcacattttgggaaaagaaggcctgagactggtgaattttacccagaaaagcattccataatttccagctcacccccaaaattctgctgacaaatatgtttccttaactacacccaaatcttctgatttcatcttctttttttctttttctttttgttttttgagacaaggtctggccctattgcccaggctggagtccagtggcaccatcttggctcactgcaacctcagtctccagggctcaaaggatcctttcacctcagcgtcctgcatagctgggactacaggcatgcacctctacatccagctaattttttgtattttttctagagatgggtttcaccatgttgcccaggctggtctcaaactcacaagctcaagcaccttggcctcccaaagtgctggattacaggcatgagccaccatgcccagcctcacctccttttttaatgaacccaaacccaccctgatgatttttttattctgcatttctcagattcataatggttttcacgtgtgatttgaaatcatttatgggagctgcatgagcaacttacatcctggagtttacaggtgttgcaccctgcccaaagttgctgagtgctcaccaagtcctgcttctctcagaggcagcattacctaatggacaggagtctccgggcccagctctgttgcttattaactttcccaacgtcatttgtaaaatgagaaaatgtctgttgttcacaggtgatatagttaggctctgtgtccccatccaaaatctcatcttgaattgtaatccctataatctccacctgtcaagggtgggaccaggtggaggtaattggatcacgggggcggtttccctcatgcttttctcgtgatagtgagtaagtctcaagaaagctgatggttttataagcatctggcatttcccctgcttgaactcactctgtcctgccaccctgtgaagaaggtgccttcttctcctttgccttccaccgtgattgtaagtttcctgaggcctccccaggcatgcggaactgtgagtcaattcaacctctttcctttataaattacccggtctggaggattccttcatagtagtgtaagaatggactaataccacaggttactatagaaattaaatgaattacagcacaaaacatccagcactgtgcagccaccaactaatgctcaatgaatgtcgcttgcctttcaaatttcttcctctaaccacccctagccctgattccaattcttcattacttagataattgtcatataaagagaaaatagaatgatgaaatggaaagactgttgcctgaataattcaggccacttagtgagtatctatatccatatagacagctgtgtagctacctctctacaggtaggtaccttaatatgcaatgtccatctgtatctatatagagatacagatatatagaggcagagatatttcatgcaataaatatttattaagcacctgctggtgcctggcattgctctgtgttggatgaaaatactgaataagacagacatgatccctgctcacaagtaggttacggcctagtagtacagacaagtcacatcaagaaacaactaaacaatgaagcaaacaaacaactaattacaaattgcttcaagcaaatgcttgtataaattgctataaaacacacaaattccagtgagggacactttagactgtgtggccacagaggcctttctaatgaggtgatagatcagtggagaactgaagggagagagtgggccatcaggggacgcaggggcaagtgccatccaaaggagcgggttgctgcctgccattgctgaggcagggagaagaagcctggggggtgcaggagaaggcagaagctctaaggccatggcaggctttatgggccgtaaggaggtcttggtttccatctaagaagaaggaaaaagtttaaagaggtgggccacaaaagcagattgaaaaagggttgacattttaaaagatccctgcaaacaactaaagaaaggagatgactgtgagattctcagagaattctttcctgcctgctattgatctccaaaaagtgtgattctataacaagagcaaacattgacagtgagtcagatacctctgtaatcatttttaaatcactcattttattcccacaacaccttacatgcggtggccatggttgtccccattttacagatgtggcagcagttgaggcacagagagcttaaacatcttgccgaagctcacctagcaatgagatgatggagccgcggttgaaatttaggcagtggaactccagatgtgtgctcaccctgccctgttctgcctccctggaagcacgctcagccatggctctggctgcctctcccatgctgcccccgagatttcattccctgtatgcctgaacgtcaacacaagtgtctttcttctcagtcccatggaaacggttcctccaccattacgatctgaactaaaacaataagaagatgctatgcaaaaaatgaacctgggtgagtactgaacactttaaaatgcaagactttactaaggctaaatagaattgaaagctatagcctcagaagagaatgtcacaaaaccctgacacagtgaaacaattacataactaagaagtgaggggaaaggatgggggagaaaatgaaatgtcattttctcttctttcacagcagaaagttcatctgttttacaccaaattaaaaaacaaagttggccgggcatggtggctcacgcctgtaatcccagcactttgggaggccaaggtgggtggatcacgaggttaggagatcgagaccatcctggctaacagggtgaaactccgtctgtactaaaaatacaaaaaaattagccaggcacggtggcaggcacctgtagtcccagctacttgggagactgaggcaggagaatggcatgaacctgggaggcagagtttgcagtgagccaagatcacaccactgcactccagcctgggtgacagagcgagactccatcttaaaaaaaaaaaaaaaaaaaaaaaaaaaagttaaatgaaaacatgactctaccttcatcttttctcctaattgctttctcatattcatatcagcatgtcttaggaggtaaaagttacaaagtttagcgattgcttcatttttctccaatttttctacattcaagtgaaatcacctttgcaaaattatgacaacaagagaaatctgacagagctgactccctcttgcttccaacttccaagctacccttagtcattcctgggcataggccaagctaactttgggaggaatttatagtttaacctttaagcaaggacagtaatagcccttcccaaaactaaattgtccttgtaaaactaacgaaaggccataaggttagggttataagaggtgcctgaattctgctaacacataagcgcagttaaatgataaccagccattgttctggaggtcacagatttgtaacttcctcaattactcttgtaaataacatcactactgtagaactgaagactggccctgggagatgtttttcagacttctggcatttctggcgagtgactgaccccacctggacccaagactcatgactcagccagtcctgtggtccccacccagaggactcaacacgagtggactgttttccatacgcttgtggttttacccccaagcaatcaacattccctgttccctagccccctgcccaccaaaccatcctgaaaaactcctaacctcctagcctttggggagactgatttgaaggataaccctagtcctccagggtggccagactcacattaattaaactctttctttacagcaatactgccatctcactgaattacttttgtctgtgcagcagacagggaaaatccactgggtgactacacaaataagcttaaacttaacagttttattttttaaaaaaacatgtaggccaggcacagtggctcatgcctataaccccagcactatgggaggctgaggcaggcgggtcccgaggtcaggaattcaaaaccatcctggccaacatggtgaaaccctgtctctgctaaaaaatacaaaaaattagccgggcatggtggcaagtgcctgtaatcccagctactcgggaggctagtacaagttcattttatataaatttctgtttgtctaacttatttacttatctactgtacagaaaaatatctagaatgatctttatccaatgtgatcaaatgttttatgatatttgctttggtttgttggacacattcttcttggcattttctgtgttgcttccatttctcttaaatgaatatgttgagttttttaaataataaaataattattttgaaaatacataaggaagacgtccagacttgctttacttgatcatatgaaataaactcctcttcacgctggagcaaaataagagcactcttatcttgggggttttggaagtatttctgtggtttctgggatgcaatatctcagccagaaaaataagcccttcatcctgccttcagcgaggcgagccccacagcaagggccaaagtctaggaggcctgagcatgaggctgcagtgtctccaagccccactgcctttaatgggaacagcgtcctggcaccctctccaggatcacagcagtgagctctgtcctctggtcacctgcgccaccaacaccctgacaaggtcctcctcctccttagcgatgggctgcctcctttcccacagcttctggtgcccccatgggttgggggcagggagggaagtagcaaagaattaagaatcagatccagagaagcatgtggtcatatcaaagaaggagtgtaaatagctcctatacaatgaggtgatcagatctctaagaggctcagggaaaataatcaggaataagtggaaagacagaaatgaaactgaacaaaagaaaacacttttagggagaaggaagtttgaggcaggtcatcatcctcaagaatcttctttgaggcaaaagagctgtatgccatgaggagaaaatgatacaggcagagcaagagaaaaataatgacctagtcattggctcaagattaaaagctataatagaccctttgatcctcacagtaactcctttaggtagtgaaggcaagagctcatctccttattataggtgagggtgataggattcagagactatagcttgttgctcaaggtcaagcagactggtgcaggtgcagcctggaccacaaggaggtctctggacctgatcactcggccatgggagtctcctctctctccccttcccccttttcatggaagtgagagttgtgtgaatctgatattccccatagtccccccctccatgattcctagtttgctcccagctcctctcccctctctagctccataactggggtcaaagccaggctaacttgagaagctgagtggaaatctcatttttggcttgctaagaagttgtcttgagacccctttgtttcatagggaggaaggtttcccagcagaggttaagttttgtgctcaggtttaaggcatgagtcaaggtcaagcttcggtagttgcccaggttttatttcaagggaagaaggagttcaaggtgatagctctctttgagggagggaggaagggaggactgtgtagttgtggatatggtagcctggccagccaatgcgtaagtgtaataagtaatcctcatactctcaccccatgctgcaagaactgtggtaataaccttgagcaacggcacacccttcctcctaacaacacaggtttaggctaaagacattatccattaaaaataaccacattttataaactttgtgttgtgtgagttttttccccattcttttttgaagcaactggcttggtacataaattacactgtgtgctagagaatatatgacacggctgtgaattacaaggtcataattttaccagcaattttagatgctgccataaaccatccaatgtctgagagagctctaatacattttgatttttttcctaagcccccagaatggcattctaggccagctcttaaaagatgcttcatttcttgcttttgttttaggaaaacaatagccaagtaacatcatccgctcctttctttcttttcttccctatagtatcgttgccttttatttttttgttaaattactagcatctatcttagatagatgttccctcagccttcttatgggaaagatgggcttatgtagggctttgagtgagcaaagttcccagagccacaccattttggcccagggcttgcctaaagacataacgaagtgaccttggaccaggtggttctgttcagtctcaggtggaaatgttttccctggtcttctgtccttaccttcttctccacttcaacttaagttacacctacatccttgcttttcccctaattttcaggcctttgttcatttgcaaacacttgccctcagtttgacctgcctattcccccctcctgtagctaacaaatttctacttcagactccaggaaccagccagaacaccacctccttttggaaagtcttccctgggacacgtcaggctgtctcttttctgcctgttcccccagcactctcctgccatattcaatgcaacacactggaattctttacttacttccttctcccccatgaatgagctcaccagcccttgtcccttttcttttgttcattcattcatgtctaaattcacaaaacattcattgagggttccttttagtaacttcagtaagacttgacacagtgcctagaatgtggtaatgggaatgtctgttgaatgaaacaaaatgagctaaaaagaaataagtggatggaggtggatgaatcccaactactgtgcatctgcaggacacggtcaaagagaaggtccctaacagggtaactgggaaggctctcctcctgttcccctgctcttctccaagggtgtcaacggagtaagtcctgccccagagtaaatccactccagttactataaccacgcactgaggatccctcagctgcctccctatatgatcactctgaaatattcacaccagtccacttcctggctccccaaagaaggatgcaaattcctccccctgctcacctttttctcttgtctggaatgctcttggccctccactccacttagttaaggcttttccatgttttaagactcaactcaagtccagctcccccagcaagtccctatggctacaggcacatctgcctacttttaacttatagcatatactacatgtggttcctaatcagaacataactcatcccatctgaatacaggcctaactaattggcgtgcactgagggagcaggggcagaccatagttctcactgctgagggggaatgtgactggttaaaagacctctaagtctagcccaggctatgctatttactacttgtgtgacactgcagacctcttggaacatccttgcccatatctgccaattcagagataacaataacatccatctcacagagtttatcaaatacagtaatgcttacaaaaggttttcacatagttgaacagctgtggaaatgtcatgtcttataaatgcacctaagtaaactcaggcaaccctaataggccctggttttgttagtcattgaggccactccttccatatgttatgttcccttggcactgagcttcctttcaaattaagaattgaattgattcatgcaggtgactcaacaactcataatttagatctgctttcactctcaccatgaaatacacacagacagctgacaccatgctcttgacttacgagcctatttttctaaaaggcccagtccctccaaggctctttcatccactcaatatggtcagccacaggcttggtttgaactgcctgttgatagaaacattgtctgtcggctccatggtccttgaccacatgacagccttcaaggacagatgtgggataaggaaataaataacagctgttttactgacacttgtactcattcattcaggccaaggtgagaaggatgggtaggattcttcatatggactcactggtatatcctagtgagttttgtttaagagacagggtctctgtgtttgtcacccaggctggggtacagcggcatgattatggctctgagcagcctcaacctctttgcctcaagcgatcctcctgcctcagcttcccaagtagttaggactacaggcataagccaccacgcccaactactttttttttttgtagggatggggtctcactatgttgcccaagctggtcttcaacccctgggctcaagcaatcttcctgccctggcctcccaagctgctgagattacaggtgtgagccaccatgcctgatggagttttaatagtagttactgcattgcaccagccagatatttcatctgagaaaagtcaggcacactaggttccatcattcaattactatcctattaagctgaattcagttatgagtgtgtttagagatgtgcatgtatcttgtagtcaacgcatggataacatgtgaattctatccaaagcaataagtgctctgcatacatttaaatgcatgtcttctcatgtttactcttctgtagtattatttaactatttattcatcttttgttatattgacttatgaaagactttgaactcttgttgtagaaaaggtatttggaattcccatatctataactagattaagctactctaggctgaaattgtgtcttacatttcacagtataccatgcacaacaagcagagtgctatgatccatatgtatctattgagtgaatcatttattaatctcaaattacatccccaaatcctgttctttccttcctttgcctttttttcctagatatcaagaagcacactgattctagttaagtagttattactttgagctcagttaaagatactaaatattggcactcttggtggcccccattccaagcatccttttatgtaaaagaactgtaatcctatgagcaaagacctgtaaaactgactgcagctaagggaattatgcccccatgcagataatgctgtggaccaaacagttccgataagcaaacaaaatctctcagacaattatgttcttgtttaaggccgtttgccttggaattcccaaaaggattctggaggattgcaaatttgctggggatgaagaaagaaagtactagctagagtttaatagattattggattaagacaggccagaaacagtcaaacaagaaaagtattatgcaaaaccttctaaggttctaatctcaccttatttctattttgattaatattttcctgggaaagaaaagatgggggtttttgttgttctctgactacaatccagagataacatctttgcctccagttttcatcaagataaagacctggaagacccgagccaaaaggaaggagctggaattttttttaaatctttctttctggtctttaaggaagttatctgaaaacccactggtactctccaatgggtaaagaatgagacagaactagcagaaagtgttaaagcattagacaggcaaattaacttagagacagtgggagaatgattccatctccattgattttccagtctgtaaatatgaaatgctggaaggatacttgtgacatttggaaagttttatctagaaatctccaattaattttagagtgcatagcatacatcaattaaacagactgcggggttcatatttcctacacggtcgtgactcatcctcggaagatctgacccatcaaggataatgatttcatcttgatattggtgactaatatttctgtttgtatgtccagtgtctgctacagagcctgacatagagtaagtaaatgctcaaacatatggataaatgaatcaattaaaaacctcataaaatctttaccctattaatcttcctcctatagcaggggttggtaaactacagcctgtgagacaaatctggccaccaccagttcttgcacaggacaccagctaaaaatgttttccccctacattttaaaacagctaaaaaaattagaatattttatggaatatgaaaattgtatgaaattcaaatttcagtgtcccgaatacaattttattgggacacagctatgtccactcttttacctattgcctatggctgctttcatgccacagaggcagagttgaatggtggtggtggagatcatacagcccctgaagccaaaaacattgactatcaggccctttatggaagaattttgctgacccttattctatagaatggaacttgggaacccttatcatttgtcattcattccattgttcactcagtggctatttactgagtatctcccatgcgtgcagtgctctgtcccattctggggataaaacagagagctgagaaagatccctgccttgatggaactcacagtctgggtctggagcagcagaaagaggctcatcaagtaaccttccaagcacctttgcaatcacaacagtgaggagagctaagaaatggtacatggggtaagcttccatgatgtactgatggttatgctaattactaaagactgtcaaatcaggacccaaattgtctagtgccaaggtggatgtctttgctccttcctttttctgccctgagacactcttcattctcagttgggtttcccttttagaatgacctgtgacatgtgtcttctcctcatgtgacactcttcctctttctaaccccagcacctagaacaaagcctgacacacgggagacactcagggcatcactgttgaacaaatgaaagaattaattcattaggagaagaaatgtaagcaaattcctgggcatccccaggccccagttttctcatcagtagaataagaaggatatgatgtactcaagcctcccagctcggcattctgcaatttgtcatgtcctgagagctggactcatctggctttctgattcactcctctctgtggacataaggcagactccctctgactcagcagcctgatgcatcttcctgagtgacacatgaactctgcccaaggcaaggcggccagccccaatccattccacggatcactgctgacagtgaatgggagtatacctgggggttttagccaaggtctgctcaaggtctttggcataaagggaggccaggttgaacacacaccagcaggaagagagatgaccttgacttcataaattggccataaattagagctaagaatcaggaagattctccttccatgcacatttctaaatggcagtttcaaggcaggtggctattttaaaacacagacacaaactcataattcaccctctttgtcccccaccctcctacatgccattgatctttcttttttttttttggaatcctgaaacatgatctttaagaaaagacaactggactccaggattacttcctagctcttcctcctctagaagccaccatttctcttcgctatctagaccccagggaagtggctttggcaaaagcacatttgcacccatggatcatttggttttcttgtcctgttaactgcctggttctgcagcacccagagccagataatagaggtgttccttcaccagccacagctactatcaggatccctcttagtccggaggtaacagaagcaactggttgaacgtgtttcctcctgggaaatcctaaatgttccatatggcaatagggaatctagagttgtgtttctccttgtattagggatattttccctctttcagtttcttcccattttttcccatctaaaatatgttttttccactttgctgagatgaagaccagccagagagtcaaaggaaatgacagacatgccataatagaaagaaaaaaatacagacttctgaagaatgagttgattcatgccatgaaaactcacgataaaaatattcactacttttttttggccacttgtcatagtgtgctgcctctgctaggcagctgaaagtgtctcatatgaaaagctctattatcctccacagaaatgacctttgggacccacccaacggtagtcaatggtaatattatactaacttgccccccaagaggaaagaatgaaataataatacttaaaatatgaatgcagagaagtcctcacttaaacacagtacttctggttcataaatcagttctgacacattgaagtacacatatgatgactagacgcaagtttattaacacattttctttctttttaggtctgagaaacatatctattcagaatccatacatttgttcattttttgaagctgacagcttgataggcaaaaagtaaagtgacagatcatttcaatatttcttttaaattcaaaaccaattcagtcaaaagaccgaaggaaaatattctacggagataaaatgataatgcaaacaattgaagacagtcctttattttagtgaaaacaggtaatgtctgtactctggagtcgggctgacttcctcctcttaacctgccctgcaagtccaattagaatggttttctgcggggagttgttttccatttatacttagcccgaacacgtatacctacttttcaaactcttagctattcacttgacatttgtcttcttcagtcttcactaaatagtctttggaccctttgggagtcttataagagttattttctgaaagttaaaaacgtaggaccttatttcggcagaggttaactaaaccaggcttcaaagaggattctgagggcgacagccactataatgtccattcctactttccttcactaggtggcagcacgtcacaacacatttttcagaacagtctggggaaaatgcagttgagctaaagtgaggttggggagtctctgcgggctatgggaggaggatacacattagggcaggtcagtgcatggaaaagctggcgacacttgtgtttcctataggtcccctttgttcccagtggagctggggcccttcgtctctaacaaaccagaagtacttgtactaatggaagggaggctatttatttcataaaataaatataaacaaacaagaaaattgaaataagaagtcctctgaccatgtgcacgttgctccagacaccaaaacatgagaaagcacttctgacccagtttgtaaattcgagttatagtattttacgtttgctaaaatattcacctaccacagtaagaatttttgtttatctgatgcaacctgtttggtgttataggcagatgctaagttacaggctttgtggtggatactgggcaacagatgtggtaagaaggggagcagcccaagatgaaatttcctccaaaacaccagaggttcctgtctcaagcagagaaatcataatactgcaacacatactagtttgcaaagggcaagtcgctatggccaaaaatgattgattcagaggaagaggaagggaaggaagaagaaagagaggaagaggaggggaaggacatggaggagggaaaagaaaaggagaaggagggagagggagaggagaaggaggaagaggatgaagaggaagaagaaaagaaggaggggaggaggagttttaactgaatactgtatttttgccttaatgtaggaaagatgaaggggagaaggaggtaactgctagtggacattgagaagctgtcaatacagcaagaccttgccaaaggttgatcaatagcctctttttaaaattaatacatagtagatggatgtattttcagtgtctatgtgataatttgatacatccatattgtcaaactagggtaactgggacatccatcaccttaaaatatttatcttttctacatgctaggaacattgaaattattcttttgtagctattttgaaatgtacaattgattcatgttaacttgtcaccctaatgttaactggtcaccctactgatctatcaaacaccaagtcttatttcttctatctaagtgtatatttattcccattaatcaacctctcttcatcctcccctccttcctacccttccctgcctcagataactaccaatctactctctatcttcatgagatccccttttttttagctcccacatgtgaatgagaacacgcaatatttgtctttctgtgcttggattatttcacttaacacaacgacctccagttccatccacggtgccacaaatgacagggtttcattctttttcatggaacagccttcctttgaagagagacattcactctcctgctagagacagcctccacctggcctgcttcacccatttgttatcttcttgtccctgtaagcatttgtgtttgcaatctggggtttatagattcatctttcctatagtagggctaaaatatcttagtttaaactccaagcctaggacaacagctggcacattacacttgttttaaggtttgttgagtgaatgatgataataataaagatgatgataataatgaaaccggcaatatttatgaagtttcttaaccagggcagagactagggtaagacagtgatgcatccagggaacaaaattgaaaggcacgctcattttctttttctttctttcttttttttttttaattttgagacaggggctgactctgtccccaggctggagtgcaatggcatgatcttgtctcactgcagcctcgacttcctcgagcaatccttccacctcagcccccaaatagcaggaacttcaaacatgcagcatcatgtctggctaatttttgtattttttgtagagatggggtctcaccatgttgcccaggctggtctcaaactccaggactcaagcgatcctcccacctcagcttcccaaattgctgggattacaggcatgagctgctgcacccagctgaggccctcgctttcagggtcacttgcttcatcttgctcctagcctatttataacataggccagttttctttacatgatttatctcattggtagggcttttaaacatttctgtctctcatcacatgtatgagttactactaaaccgtgggtatatagtagtaattaaaagctcaggcgctgagatcacaaagatgtgagttcgaattcttgctgtatcacttgctgaagtcatacagcaagtaagacaggtcacacaggtcacctctccaagttccaagttcctctacctgtgtgttaggattaaatgagataggccggtaaagagctttgtccaatacctgccacaaaatatagtcatgcattgcttaatgacagggatgtgtcattaggcaattttgtcattgagcaaacatcataaagtacacttagacaaacctagattgtatagcctcctacacacctaggctatatggtatagcctattgctcctaagctacaaatttgtacagcattactgtactgaatactgcaagcaactgtaacacaatggtaagttttgtgcatctaaacatataaaagatacagtaaaaatacatattataagcttatgggaccaccattgcatatgggaattgttgctgacagaaacattatgtagcaggactgtacatagcagctataataataataacaataacaagagcaaaaataacttattttattcctattacatttataaggatttcagagaaaaattcatgttcaggtcatcaaaattgattagtagctattgtatgcaaaacatagtgccagacatttagaggaatataaaagaatatataacatagctgcaaatctagaccagggatcagcaaactttctctaaaaagaaagataataattttttaaggcttttttgggtcctatcttcttcatgtcattgccataaacaatatgtgaacgaatgaacatggctatgttccaagaaaactttatttacaaaaacaggcagtaggccagagtggctaactcctgatctagttgatgagtcaggacaggtacatgttacttataaaaacacaaccacatcagaagatcacccatgatcaaaagagtggctcagactatagtggttttggaagaggcaagtaacaggataataactggttgagtgcaggtaagcagagaagacaagaaagcagctgctagacaagaaactaccaaaaccatggcgatggaacatatctgagattgggtaggagtggttggtaagtaggctggctagagtgaaaatgggagaaattcacaaaaatgcaaacagggctggagaagaaggctaggtgagaatataaagaaggaagaccatgagactgagttttttgtttgtttaatttaatttaattttttatttttattttttttttaagatgggatttcactgtattgcccaggctggagtacagtagcacaaccacagctcactgtagcttcaacctccaaggctcaagcaatcctcccacctcagcctcctgagtagctgggaccacaggtatgtgccaccatgccgggctaattttttaaaaaaatttttgtagagacagggtctcactgtgttgcctaggctggcctcaaacgatcctcttgccttgggctctcaaagtgctgggattacaggagtgagccaccacactcagccaagtttttacaaaaaggaagtatctgctgtgctcccaatctggccagtgaggtttgcaatccactcaggaaataataagctaattttaccctttatgagctgggttgctaaattcctacctggccttaaaggggtaagtcgaatttagtgattgtgatatgggagcaaagtgtcaccacactagtgtttggcatttatttcgagtgatatagtgtgtcttatgaaaaatgggccaggcacagtggctcacacctgtatcccagtactttgggagaccgaggtgggcagatcacttgaggtcaggtgttcaagaccagcctgtccaacatggtgaaaccccatctctactaaaaatacaaaaattagctgggcgtggtggtgggcacctgtaatcccagctacttgggaggctgaggcaggagaatcacttgaacccaggaggcggaggttgcagtgagccaagattgtgccactgcactccagcctgggcaacaatgcaagacccaatctaaaaaataataataaaaataaatttaaaaaaaagaaaaatggagctctgctcaccacctatcatctgttcttactctcatgagcaggcttgggcccaggcctgggcatctcagtgtctgcaagtgagatgactgggaaagaagatttgttcaaataagtcaccctgctattggagagaggctggaccctaagagagcccttccctcgaggagcgggctgagatactgtatccctgggagaaggttggaggtgaggctccatccctgggagaaggtcggaggtgaggctccatccctgggagaaggtcagaggtgaggctccatccctgggagaaggtcagaggtgaggctccatccctgggagaaggtcagaggtgaggctccatccctgggagaacatcggaggtgagactctagggatgagttagaaatttggcctgggacctccctccgcccctctccttccctaatctccaacacaccctgtatctattttcctgaatgagttgaccctatcctaatttcagagagtttaggaagcgatatcaaccaaattggctctagacaaaatactagtgactaataaagtcaagcaaaggtgctcattcttactagtaaccaaggacttggaataccttagaaggggattacaagtggaagatccaagagctatgggaaaagggttctgctgttcaagttgaaattgtaatatggaatatcataggatgagtatatctcaagatgtaaatgactcagattttaatctcaaaaacatatgaaataaaggattacattaataagaatactgatatttaggagcacaaaatagcaaggtttactctaataccagaatcctggaaacttgcatagcagctacaactagaattcaagttcagcctcaccgtgggctggaccagcagatctcaaagtgtggcccccagatcagcagcagcagcatcacttgggaatgtgttagccatgcagatcctcaggccccatcccaggtgtactgaatctgaaactctggggatggaacaccccaaatctgtaatttaaccagacctctaggtgactctggtgcactcaaagtttgagaaccactggtctatctagaatacatagtgtgcttgttccaaagcaattgtccttaccacgacccaaagagcctcacagaatagatttcggaaagtacgtgtgcgtgtgtgtgtgtgcgtgtgtgtgtgtgtgtgtgtgtgtgtgtgtgtgtgtgtgtgttgaagtttctcaggtattcaggtatgttcctctggtttaagaaccaccactgtgccaggcctctcaacagtggctgcacaagtgaaattattcagagaacttgaaaacattctggtgactgagttcatccccaattctcatatgcttggttagaaatacagtctggccaggaggacgtgtcagagttcctgggtgattctaacatactgccaagatcatttagcccatagaagaatcaccaggagaatttgttaaaacagattcctcagccctacctttcagagattctccaggtttagggttgaactccaacatttttatttctattaagctcccaggccatgtgctggcttgcagaccgcacctcgagtagtcctgctctaggagaaacatgtttatattttagatacctgaaatcttctttgggctgggatggccaactttcctccatctgttcctcctctaaattcctataaacttactgttctttctagaggacactccaattaagttattaacatcttatagaggcaagatctatgttttccccatctttgggtcactcctagcacctagggatttgcacacagtaggtgttcagctgaataatgcagtcgaatccctgagctggtttcaggtgttcattttctccctatctgatctgctagccaggtcaatccattatggccctggtctcatggaaaagaatcaaggcatctattttttgaagatgatgtgaaggtaaatatacgtccagtcctagagatttaggttgctgaggaggctgttccaataataccccagatgaagtacagccatctggagaggttttggcatccatgcaaacctactgctgaattcgttccttgaagacattcattttaggatggtatttccaatttggcatataacagagccatgcaaatcaatgaggatttagaatctctacttacggagggcatcttatttaaagcgtgtccctgacaaagcaatatcaagggaacacaattggaaatctcttggagaggagtaatttctctagaagcagttttagctatagcagcgaccggaacagcaatgagctccctgaaatacatccaaatttttagtattccacttggctgggctgccttcttcagagcccaatcatagggacagaacttaataatgagttcatttttcttgtcacactagagcaattcagttgcaatgctattcataaggtgtatgttgccattgaattctttctcaaaaaaaaacaaaaaaaaaaaagctcaagccaagagtagagccccatgtcagtctatatgcgctaacaaaataccttagactgggtaatttataaacaacagcaattgattgctcacagttctaaaggccggaatgtcccagatcaaggcgacaacagattcagcatctggggagggttttttctctgctccatagatggcactttcttgtttccctgcatggtgggagggacaaacagcctcccaagggcttctttcataagggcaccaataccattcctgagggctccaccctcatgatctaatcatctcccagaggccccatctccaacacgacggcattgggatttcatttcaacacatacatttggggcagatacaaacattcagaccatagcagcccataacatctagcatgatactatttcaacatggactaatggtaaaaacatggattgtttttatttatttggctacttgtatagaatgggtcaagaagctcagaagaggggactggtgaacatgggggaaaaaagtagtttggaggctggtaagttattaaaaatgtgttaacttgtagcttgagagacagcatagtatcatatcaagtaacatggactttggaggtagattgcctgagatcaaagctgagctctaccatttactcactaggtgactctcagcaatttatttaaccttctgaagcctcagtttccccatctgtaatatgggcccccaaatgacacctatttcatagtactgtttggaagagcacttgagacaattatatactgtatgtacatacacatacatacatatatatacacatatatgtaatatgtgtaatatgaacacatctaactttattctagttatggaagcacttttcttttggatttctctttctctcaaaccccccaacccccactctcctaaggacacctggcccaaaaagggaaatcatactttttcttttctttatttcactattcttattctaaagaaacccacagactacagacagcagtttacttagaaggctctgggcttcagggaatctagatgtccaagttgaaagtcagctgcctggaacatggagtgggtgacctctgggggcactcaggggcccttccttccaggcttcgggcactgtcactgagaagcaactcccttgggggaggggtgcttttggtcatagcggttgagtcaagttatcagatgtcaaatagcttataggagttcaaagtgagcctatctccaccactgctaaccacgaactgcccatctgagcatgatgaaattggcccccttcccctctccccttgctacttaattgctcacaaatccagcaaattgcaggaccagcctctagggggcaccagagacctttcctttcagagcccaaaatgccatttcagtagcagcagagtagtgtgtcctggagctggagcatggtccagtgtctcttgtgctttttggcctactgagtccttaagtatatttaatttaatttgggtagggtggtagagggttccttttaacagtgtattcatgatttctctagcatttcttcaggaaagttatttatttcttttagatatagaatttttaccattggtccattcactcaaaatcacttcaaaaaacatttgctaagcttccactatgtgcaagagtgtcctgggcatacaaaaagtaaaaagccatggtgtgtgctgtcacagactcattctagagcagcgtggtcccacagaactgtctatgatgatggaatgttccacatctgtgctgtccagctccgcagccaatgagccacatggggctcttgagtacctgaaaaacagctggtaggatggaggaactgagcttttaaataggcaaatgtggctaggagctaccatactggacagcacagtgtattagtttggtgcaaaagtaattgtggttttggccatttttaagtggattggtaagcctggctatttaaagtgtggtccacagagcaggagaatcactacacctgagagctggtggaaatgtagatctctgacgttagcataggcttcctaaatcagaaactgcattctaacaagatctcctggtgcttctcatgcacagtaaagtttagaaagttaggagatgcatacaagtggttctcatcctgactgcacttcagacacaactgagaaacattaaaagaagctgagcctaggtcacaccctccacccagagattcttaggttaatggtttaaaggcttggcctgaacatgaagagttttaaaagcactctgggggattctaataaaaattcgagaaccatcccagcataagtcagtacggtggctccaaaactggagatcaccaggagtgcttgttaaaacacagactgctggctccaactcgcggtttctgatccctgggtctcggttgagctctaagaaccctcatgtgtaacaagtccccagtaacgctgatgctgctgatccaggaaccacactttgagaaccactggtctaatcattttaaaagatgggctccagaattggactaacctgagtcttggacctgccacttacttagaccctgaacctcagtttcccaaactgtaaacttgggctatgaatatttactcatcgagttattgtgaatattaactcagagaatgactgtgagatgctgggcatagtgcctacttttaataagcaatcaataactgttccttactatcatgatcctaagaagactcactcattcattcattcaacaagtatgaactatgtgtcaggcactgttccaggtactagggacatagcgaaaaacaagggggccacagtccctgccacattgctatcatggaagctgcagtcctacctgtcagtacaaagcaggctgcgtatggtgctcctatagcacgaatcctaacagcacaatacaaaggtcagagaggaattcattccaatggatgagaatgggaaagctgcacacaggagctggagtcagagctgtgccttaatggggagaaggattacaacctgcagagtcagggcaggaacttactcatgaccaggcacagggcagagacagcaagaagatgcagctagcagcctagtggagctggggcaggaagtacagggaaaggggaggcaggaggcagggctgtgcatatggggatgccaaccagggtctgcctccactctctggccaaaccatactatttgtgtttgtttaaatcccaaacactgaaaattactgatgtcaggaaactgaaaccaggccacagctttcattcttgattattcttaccaaatgcagaggccagtcaacagaaggtccagagattcacagaatcatcctgaccctgcctgaaggtggggcggggctcttcagccaagcaggtggccttgggcccagatgctccattgaagcagaggaacagagagatgcttgagacttcagctgagccctgggtggggtaaccattaaaaggaagagtggtgtgctgaccccatccaccgcttcccttaggaaaatggtggcctaccaccacaactctttggtctcatttgggtttctctgtaaactccagaaagcaataaagcatgattcctaaaaaagagggctactaggtggaggttatgcagacctaatatgttcccctcagtcactgcagctgcacaggaaggggcacccaaacctcagagtaagttgcgtaagaacaacagacaacaggcaagtctgtctagtaactcacctgttcccatgaaaagaaaaaaaaatgtcactccatgcaaatgaggggtgtgggagggtgttgagcttcaataaggctctccccaacggtctcctccctaacaggctgtaaaataacatgaagcatggccccaaagggccgtgaatgacccctggagcaaaggactccaaaaggctctgcagagcttttggcacatctgaacaggggcccggatcccagcgcaccctcttctgggctctgactttggcaagttactcaacccctcagagcctcagattcctctttggaaataataatgggaataataatatgccccttttggtaggcagaacgatgaccctcaaagatgtctgtgttaatcttgggacctgtgaatatggtcatctacatgccagaaggaaatgaacgcagcaggcaaattaaggttgctgataggctgacctggagatgggaagagtatcctggagtatccaggtgggcccaatgtaatcacaagagtccttaaaagtagaagaaggaggcaaagaagagatggcaggaagcaagatcagagtgatgcaaggtggggatgcacccttagttgctggctgtgaaggtggagaaaggggccatgagccaaggggtgtaggtggcctctagaagctggaaaaggcaaggacatggaatcttccctagagcctctggagagacccatgttggacttctcacccacagaactgcttggaaatagaaaacttctacaccattttgcaaggttgtgaggctgatgcttggcactcagcaaggcctctctctttcttccttccttcctttcttccttccttctttcctttcttccttccttctttccttccttctttcttttctttccttccttttattttccttccttcctttcttccttcctttccttccttgcttcctttcttccttccttcactttcttccttctttccttccttccttctttcctctttccttccttccttctttccttttcttttccttcctctttctctgtttctctttctctctttctgactttctttcttttcttttcttttcttttttcttttctttagcagggtcttactatgttgcccaggttggtctcaaacacctgagctcaggggtcctcctgcctcatcctccccagtagcaaggccactttcttctctaggctgttattagcttctgtgggtacacaccatgctccacacatactaggcttcattctccctgtcttagcccatcattgcagcctccactgagccccagcctctcacagaagcctatcctcattctcccacccacatgagctctcactcctctgaactcccatggcctttacagcctgtaccttgcaattacgggcttaattatatagtgggtagtgttacctgctgtcactgcatgtgtgtttattttggttccaaaatgagattgaaactttagtctcaaacaggaacaatgttttgtccttttgttgttgttgtttttaagcacctgtgctttttttatataatcctgtttttattgccttctgacacaaaaaaaggactattttgggcatatatttataagcagataccctacatcattgcaactgccctgtgattgggcattaactcatttttctattttctagcagagtttactgaaggttttaaggtttaaggtctaaggccagttctgatacagacaatagaatcaagtttatagttttccaatcatggttccaatgaccatggtcccttatcatatgccgatttcatcagtcaaagaacaggggatggtgttggaaatcacagtaccagtaggatacagggtggcccggcatgtgttcctctcatcccagtgctgagcacacagtaggtaataaaaatgggctagaaaactggctggtgagtgcatcattactttcctcctactcccttctttaaatcctacaagatcaccctcaacaaaaacatacacacaggcaaggtgcagtggctcacacttgtaatcccagcactttgggaggctgaggcgggtagatcacctgaggtcaggagtttgagaccagcctggccaacatggcgatcccgtctctactaaaaatacaaacattagctgggtgtggtggcaagtgcctgtaatctgagctatcggggaggctgaggcaggagaatcgcttgaacccaggaggcagaggttgcagcgagccaatatcgcaccactgcactccagcctgggcaacaagggcgaaactccaaaacacaaaaacaaaaacaaaaaaacatacacacaaacagaggcagcacagcccattgacctaccttggggatacattcccaaaagagaatgagacagacggacatatgagttctccttggagcatgttattcaaatctcaaaataagataaagctctcatttcaaggtgcatttattttagtgaggtttggatttgtaagggaaacaaaatgaataagttggtgggtggggacaggaattaaaataagcagcgtcttgctgcttgccgacatgactgtcctcacatccgctgccttattttttattctgttctggtttgttttctcctgcggtgctttaaaatatgatgggtaggttagaaagagagaccgaggtaatcctggcttctgttcattaagctcgtatgaagtacgtgctgtgctactcacattacctcggtgaatccctatgaggtgggtgctgtaattagcccattgtacaggtgagataactgagcctgaggcagataaaatgctcatgctgagcgacccatcagcaaacagtttagccaagatgtggactgagttggtggagctcagagctgagctttaatctactctgcgccaatatccggggtgttcttaagccccagtctctctgtcccagatggagcaggtcggatctccaagctgctgaggggcactaggactcgggagacaccaggctagctctgcattcttctggtcctcctggcatttctagaaactggaggtgggcaaggaggagggggaaagaggagccaggagaacacggagtcttaaataagatctcttccctctcttcctgcctggagtgaagccctttatgagtaagcaccgatggagggatgccaacacaacacagcaaaactagccctgtcattcccaacccaggcctcacaactccaaatcattcaaggggtaaggacacagaaagaagagcagaggaagagtgtggacataaagtcagaccacatactggggaatgcacccctcccaccactcccaggagatgtgaccttggacaagataatctctcttagcctcagtttcttcatctgtaaatggggaaatgacaagtcctgcctcataggtttgctctgaggattaagtgagtccgtgtctgtgaggggctttccagagtgcccatcacacagtaggagctgactacatagtagtgtctctatgagtacaccgttacatgcactaggatgatctgcacaatgaatatattctgtactatacaacacgcaatcatatgccgacaattgaaaactaaacacggtgtggggagcgttctgggacaggtaagggcagggaccctgcattcactctggtttttatctcccacagagccagctaccgcacagtcctgtaccctcagcagggccaggaaagtttgtgcaggagaatggggatagacttcggtttcctgcatcttatcccaaacctcagccagaaaaggcagcacccttccactttccaggagaagggcagccatgcctgaaatgcccctatttaatgggattatttcttctcctttataagtcatatctcatgggaatgttcattttctctctggaagctcattggtacaatggttgtttcacaatgtaataacccatgtattaagtcagatgagaacctccttgaaatattattgtactgaattctcttccataacagggagatcagttttagatttcacccaaggagatttcgctaccaaagaacctaaagcatttcattaaaggtgctttctcctacaagaggaaagaggtttttttatttttgttattattatttcatatcccaaaaggttattgttctatgtgttcaatttcaatagtacttatgcttcctaaccataccgtatcatttacttccttattaggttcagtgtttcctgctttcccaacactgcagtataggagggtagggggataggactctatttcttcactgttgtttcccaatcatctggaatggtacctgacatatagtagatgctcaataaatattaatatacaaatggaagcacatttagagcacatttcttttggaaagcgaccacagttgatacaaagatgtatctcattagaaattcatttccacctcttttatttcctattcaatttttttcacccccattctgtgtttgtgccaatagattttttatgagatcacaacatatctccaaaaatcagaattaaatcatccacaggaaggctatggatttcaaagcataccagaactcctggccctaaaatgcttcagggaacgtgtcactcaccacaaggaagctgggctccacacttttaccgggggcatgttctgctcactgcagaggaggatgtctccaccacagtcaccagggagcccttccatcacccaggcccacaggggaccaagagacaatggacactggcagaaagtgcagattcatgaagtgtgaggactagaaggtaatttcatttaaacccccattcttcagatgagaaaactgaggatccagaaaagcaaagtggttgttcgagtgcacagggtaattaagcacagctcagtgaagaaggcagatcccacctctccccttccccatcgatttccctgtgtgtgcatgggtatgtgtttgaactcttagcaacaagatgttttaaaaggagtccctgttaacaactcatccataattttgactcaggggtgctgctgatagaattctactagcttccctgtccaccccaatgacctagatcccaaatttcccattaatgacccaagaaccttaaagactttctgagctaaaagattcttcgaagtcatctagccaaatctttatcttacagatgaaaaacaacaggctaggtaaagaaaattgagctcccaggtcacaaagccagttagcagtgaagctacagcagctgggactgctggcacccagggccacgtaagttacactgaggacacttctcagatttgtgtgtgactctactagcctcatcaggataaggagaaaataaggaggaatcaggatacgatacggagaaaataaggaggaatcaggatacgataagcaaaaaatccagtctaaccaagcatatctcaggtccaaaacaaaaacttttccttagagcaagagaatataattctaatgagaaaactgtagcaaaagaaatctttttaggatatggacacatacatatatatatatatgcatgcacacgtgtatgtgcatataatatagagattaccacacatactatattaagaagatgcttattttttaaaaaaatacttgacactaggtatataataaattcccagtgctagcaatggcatcaaaatggattgctagcggaagcctatcttgacacaacattttttaagttatccatcaatgtctgcacaaaagaaaatacacatattctttgaaccagcagttcctcttccaggaacctggaactattgatagaattagaattatacaaatatatgaataacagtgtttattaaaccattgtttctagcagcaataaaaggaaaaggaaaacattcaggtggtctatcattagggttatggctgaatatactgcgatacaaacaaattatggaattttatgcaactcttacaaaatgagttatcacagagctgacggaatgtccatcatgattagttaggaagccaaattgtggtgcaatgtaattatttgaaacaatttcttatacaaacaccaccatctctaaaacactatcatgtgtgcacatgtgaaggcctgggaaccgtgggtgtctaaaggaggaggcagtgatggaggcaaggggaaaagatgatgaatgctctcttcacacatctttgttttcattgattacaatgcatgcatattactttttaaataattaagccaaaaatcctaaaaataaggacagaaggaacccacaaatagtcctccaggttctgtttcggcctgccttcttccctagtagaccccatgacagcaggaatactctgaattcagggaaaaaatgaaatcaacgcagcaatgagaaacttgaagctgtctctctaagccctgggcttccatgactatcctctggtcaagttactttctccactaaagtgttctagtcctggtccaggaggtgccctgtacagtacagcccagcagcactctccccttaacacagaaagggacctcagtctcctgtaaggtgagagatgactcaagaagcttcatctctccctgccctacaaagaaccttgtacctataaatagaccatgcagaacccactttttggaagcagaccaaagctaactttggcaggcaggcctctggggtacctgagccagccactcggaaagttggccttacccccatgggcttcttaatccagtcctgactctaagttcctgaatgaaaagtgacagaaccatgaacataaaggccctggctgtgacagtgatgaccactaggctttgacaatgataaaactgcactgcctgaagcgcaaactgtgcaaaccctttggggctagtgctccaaagagagctgccaccatcaacttctaaaactccaagagcccgttgttcacattaatacatacaacattgtttgtagggagacagccccctcatccactgcaaattctgtccttcagccatgactcaggaaccaggaaggagaaggaaagagaggctgacttaccaagccaacttctgtttaagtacacagacacaaacacggggggcaccgtgaagaaatccactacagagttcacttccagccagaaccacaatttatcgttggctgcaataaactgggggaaagaagaaataagaaagagaaaaaacatgagaagcatggtgctggcatccaatgtacactcttttgtcaaagggtaagttttgagttttcatagggccaccacgcccggctaatttttgtatttttagtaaagatgggatttcaccatgttggccaggctggtctcgagctcctgacatcaggtgatccactcgcctcagcctcccaaagtgctgggattacaggcatgagtcactgcactcggcctatttctatttaatttttaaggtctggagggagacattatgtccttctcatatctacacaaagcacatgcttttatgattggacacacacgttttctagtgccccatagagagccctatatagactaactatatgctatgctagtcttaagagaaagatcaggcagtgtatttttctgtggttcccaacagcttcatagggaagattgggtgattttacttgtattagactcattcatgtaaatataactataaataaagcacatatgtacgcattcacacacacacacacacacacacacacaaaattccatccatctactctcctcaccttcctttcattcatactcacaactgctctctcagggctcagctaagtgaacactgctaaacgtaattttaagagctgaagaggtttatttctatttacttttgttttgttttatttttttgagatggagtcttactctgttgcccaggctggagtgcagtggcgtgatttcagctcactgcaacctctgcctcccaggttcaagcaattctcctgtctcagcctcctgagtagctgggattacagatgcccgccgccacgcctggctaacttttgtatttttagtagagatgggatttcaccaggttggtcaggctggtctcgaactcctgacctcaggtgattcacccgcctcagcctcccaaagctgggattacaggcgtgagccaccacactcagcctatttctatttaatttttaagggaacagggcattatgtgaatagagagatgagaaacaatccaccggtggatacatcatcatttttcttcaatccctatttctcccccttgaaacaaaactgatgtgaattccagaaaatgcttagctaaggagagggctctctctcagactgaaaatcagaatgcgggtgcgctgtttctcctggaaatatcttgactgcgagagcagaggctgagggggatgatccctgggtcccagactgaaacaccccattgtgatactgaacaatgttgcacaaacttacccgcaagccgaagtagagaaggaagaacacgttgaaagccatgtcgatctgtaatgtgaaatctttgtagaaattctggcaggattctattgggctattagacaggaagaagaaaaagcaagaggtaaatgacaggtagtatcatcctgtctcccacgatgctgagaagtggtagtgcttagggtagacgatgaaatgaatattcataaaagaaaacatttggtctttctgcctcctgggatcatcaagcaagcattgccaaggggtctttccattcaaccattcaggaactactgttcttttatttattgttttcgaaattattatatactatcattttttatcatcattcagcagttgaactaagaatctaaagaggatcatgcagataccctggaggaaggacaagcaggagaggcctccaaattccttaatttcatattaacccttaaagaacttctttctttctttgagaggacacatactaaagctaaaacacagttcctcatgccctccaacgcattggcagtggggcctgttttcaattaaacacagtggttgtgttttggaccttttaaaaaccattagttgattaataaattcaggacccaggagcatctcaagaaagctagagaggagaggatcctgggtgaggttctggctagattaagcacagactttctgtgcaggactcggatctggggaaagaagcattgtccgaccagtcaaattcagaccattaaaccaaaaggttgaagcagtactctaagggttaattttttttttttttggcatgcatgctaattgacttggtgtgtgtgtcgagcagccaatgcaaacccctagcacactctacttcaagagtcgccagttcaaaagggtactactatacaaactggtacaagacttctgtgtgctttcctgtgtcaaactgatcagaggatcagtgtgtggaaagtcccaaggtttgggctgggtgggaagtaggaaagcctcataaacactcaaagctgtgaatggaaattcacatagtattctgtgatcagtaggtaaatagtaacacccaggccaggaacgtgaaggtgaagtgaggtgagggaaaggagacagaataccaagagaagcaaaacactttagctaaagggaagcgacagacctcctccctccaggagagggccagcttgagaaatggaagatgaaggatttcctagtagtgccactttggaaatcactgtgtgcaataccagttagtatagttgcacttctgtaaggacaacgcttggctgttcaacaggcaggaatctgtgcagtagaggaactcggggcccacttagaggcagggtaagttagtctgtgggaatctccgatcatgttccatgcactggatttatccattcttcatctctgctacaagtcaaacatgccctatatcatctcccaaatcacgtggaaaaatctccagacaagcattaagagtaacctttatttgcattcacaaactaggtggactgaacaaaaaacaacactgaaaaacagttcaaaaaaaaacaaaaaacaaaaaaaaacgacaattgccaggttttcactaaggtagggaattgggtagaaagacagcatggaatttggttagtccaatgctgaaaggagacacaagcaaggaagccaaatatcacagcctgccatggctctaggcctgctctcctacacaggtactaatttcgatgaaaaaaggaaaatccaggctacagtgaatcggtgatacttctgcaattctcaggccatgggggtgcttgtttttgtttcaaaaacaagacccaaaggtccatgggtgtcagagttcccagccactctagttgcagtgaaaaatgtacaggaactaggttgaccagaaatcctatagactccagggttgaagagacaatgcatctctgcaggatacgttactaaagagtaaatgtgtgtgtgtgtgtgtgtgtgtgtgtgtgtgtgtgtgtgtcagagaataagcaagcaaggatggggagatctgtaggtaactactgtactcaggtgctcacttgtgccagcggggactcacatagctgtgcattataaactcacagtcatcaagattgatgtatacgcagtcaaggggagagaaaaaaagggcttggtttccaagactatcatggaaaactgactattgtttcaccaaggccaaaaccttacagttgccctcacagtcgttattggtggagttactggtggcatatttggggccatcatgagttccctagctcctattaatcccgtggcctctgtggttaatttggtggtaacctagaaatacagctaattggaaaagtatttgctaggctgtggtagaaaatggaatagttgggggagagatgtgagctgaatgccacagaggatacttggattcaacataaatggaaacaggtattgagaagagcataaggaattggctgcagtgacttctccactgtttcttaccttcctggtcctttctgtcatccctcctcataatgcttatgttcaatggccacagtgagagggcttgaagctagaggacatgggtgttgaaaaacgcaccttaacaacacccctggtttacaggaaaccatgttgaagccatacaagaccttttccttttctctaatcctttcaaaaaatttagaaccgatttcatcatgtttcattatcattccttgcgtactagacttggagctgaaatactaaaggaagtaaatgatgccgctggcgcgggtggcttttcctctggctggagctggcaggtaatatgagcatacctcaataatatgagggggcagggggcaggcagagaagcaggaaactctgggacaaaagacccatataggatgagtgatcgggcaatgtactttctatcccttttagctatttcctgcttgccactacagccccaggagaaatgtcctgcctgatttttttcaagtggcaacagaactgtttatcagatcccctctgagataagtcctctgagtgcctgtagtttacggactcgcacaatcagagaccacagagtggagcttccaaatccccattatttcattccccaaatggaaacaacccatggagaagttcaatgatcctttaaaaaaagaatacatatttcaacaacaaaagagttggccatatcaaccaggatttattttcctcccaaagagacttcatcttaatgattaatgcacattataggatggagaatgaaatacaaacacctctcccttcttgtgtaaagtaggaggagtttccttgtctagatacacagaaacttcaaaagctagcaaagaaattgtgctttaaagaaaaaaaaactacaaaggaaagtgactctggatcacacacagacttagatttccagtctgatgaggcatatccacctcagaaggatttacatgggcatatgttgccaacaggaaaaaaaaaaaagtggagttttatgaactgaaataacactagttctgcctctggtagtagaaaactgacttaccctaaattgctacgggttaactaacttaacttatatcctcttaataattagagaatataagatacttggtaagtggcagactattcatttctaggctcccataatccatgaaacaagtgtgatactaaaaccacaggcaaatttagcatgttgaccaggactccatgactgagcaccttcaaaagagcctcagtaaagagttgattcttatggagtaaatgttcagttgtagggtagaggttgaaatacaaactcctatttcctcttggccatcaagtaagtacatcctcagcatttagatgcctctacagaggaaaatgagactcacccaaagtgggaaatgtttctctttcctcatctacttagtcatagaattttcaaaaagactcttgagcaggatgatccaacagaccttcccaaagactgacttaagaacttatcttttcagagcacaaggcaagtgagggctacccaggttttttttcagagggcaggagctctcagcacaaaatctcactgctagcagttgttcctctgggcatcttcctcatctccaagagggaaggatcacccgctcctcacagcctctaaacttccctgggtttcctgcagtctgttttcccacctccctgagtctggctgccgaaccctgtgaagctacttctccagggtagtggttctcaaactttggcatgcagttggagggcttgttaaaatcttgctgggctccatccccagtttctgatttagtaggtttggggtgggggccctagattttgcatttcttacagtttcccagataatggggatgctgcttatctgggaacaccgctttgagacctgccactcccaaaaaacctttcttgcaactacacactaattataggtgttgctgctcgagaagcttcccattcagacctgaacagagatgattcagtgtttgagccagcccccagataaccagctgcctaccacttagctaattgctgggatcaaggggttgaacagacattttctgtttcagatgcgaacaagggggtgaaaaaattaaaaagatacagggaagcaattgcaatgccactgtgcaagcttcaccagtggacgttccaattaacaatcagagagtacctgctgagcacattttagattaagattaaaaggaaaaatgatgaagtacagatggggaggggttacggagaccatcatttacaagggataaagaaatggtaagtagcttaagaatgacaacaacaataacacacacccaagatgatttactagggacgggactggctgaggaacaagatatcattttgtgaaataatttccaacgttcaaattctcctcactcttgtggctagtccctttctaaattgaatggggccctctcaattcccaccaggattatggacaggcagagttcaggcccacagcaccacagacatgagtcaatgcaataagcctaatgattctagactcttttcctagtctcacctctgcaatgttgccaaattaatttaattaaaaatgtcattcatccaccatcacggtccctgcctgtttcatatagtaactctaagcctggctaggaagaatttctaaaacctaaactcattctacatctcttactttattttctactatgtttcagtccaaacccttgccttcattatttcatgaatgtgacccatgtattccctaattttaaatctatgccttctctgtggcctcttcaactgctgattactctttgtgttcaaaccttgggcagtcttcgaggccaacctccaggcttgattcagcaaactacttgtgccctcattgacctctcccatctctgaattcccatgctactgggaggaaaaaaattctaaactgcctcattatgttcatattcaattattcttcaattcaatgtaataatacctgacaattgtataaaatttacatatgctattgcatttggtcctcacaaaatggcagaataaagtagatattgtactataatccccattttacagacagagaagcagaggctcagatatccaatcaagaccctgcagctatgtggtagagttaggatagagacccactagccttgtgccataccacttcctctccagatggagtgcagccttcttggagaggaagaggaagcataagacatagtgtctgctatctacagagcctcgcctggggctcatgcaaaaatgatgggggttgactgattcataaatccttcatagaggaggacaaactgccctagaaaataactgatgtgtctgttgggtggtctaggaaaatgcagaggaagcagatgtattcaacctgtacctaaccctaaccctgctctgtagagactgtcatgtgggacactaataatccccagaagtcctctctgggaccccgtgtggggtggtggtatcaggaagactgatcccatcggctgaggggaagttcttctgcttatagagggataactcctagttatccaactgattaaagatgaatgacccttcaagtggcccaattttccctcaccctctcctattctaggagaacaaggatgaagataatgaaagctgataatacttagacactctgaagactcttaattatgaactagatgattaataagctttgcatcccatttgatccaatcaaaataaataaaaaagatgatatcatatggatatggatttttatggaatctatctataaccaagagagtaggtctaagtgatttgaagctttcctggctacctctggatatcctggataaactgcctacactggaataaaagcatctagccagccagaatattatgagacagactaattttaaaaggaggcaagtctttgcaatgtacttcaaattagaaactgatattattattcataaaatttaagatcacagaaaaatattttgtgagctaataacaataatggatttagtgtgaatgacatgatatgaattcatcattgagaaagcaataatatttatatagaacattttctcctgaacttgggacaacaccccaagactgccctgaacctgacgggatccaagctgaaagctttgtattcttttggttttcttcatgctgccattttacttatcttatcagagctgtgtacctaagagtttatctttctaatatcgattcttctcatgtttacactggacggggcatgtgtgttcaataagttgtgtagtttttagttttaccaaacagaataaagcctcttcactttatcccagacatcatggaatagttatcttctaagatgtggtcacctttgatgggtcagtttgtggtcaatcatccatcaatagtaatgatgataacatcaaaatgggccccccttttttaatcttaaaacatttttcttagaccttgaaatgactctaatgtaaatagaaaacagtttttgttactctgcagtactgatcgattatgatcccatgccagctggttgtttaactggctttactgggaagtcatcagttatgggtttgtatcaacaggactattaatccttttgatggcagcaggcttctaattatagctctgctcagttgaagagatgtgatccaatagccacaaatatatgtattccatgttgaaatgaattggagcataccggaaagtagtataaaaaccctaacaactctttagcatccatatacactctgtattcttgagctttgagtaatatggagactcctgaaacaatgatagcagttgacttcagagcagttgtaaggctcaggatgtctacctgaataattattcctaagagtaaaacattcttctaggagacaaagaaaatgacatagattgctaacagagagaatggaatatgtcaattctttataaatttctcaataaaacacacacagatcatttgctttcaagaaactcaggtggcgagaacccttttgtttgttatgaagttcttttaaattttatctaacaagacttcaatattatatctgaactaagagtctcctttcccatcttcattccatatttcttatccacgatagacctagataggtatagcaaaagcaaaatacgggcattacaagttgacctcaaaagtggttggcagctaggtagttttagaattcaatggaagagctaaagttccagccctatcacctcctagctataggatcttaagcaaataatttgacctcttcaagtctttgttttctcttctgtaaactggggataaggttacgaattcccaacgttgttctaagactgaatcagatgactcagcactcaaaagtgatagtaatttccaaaactaaggtaataataatagtgataatagtaactgtttgtagaaaatgcccccaaaaggcaatcattcaactgaacaaaaactgataggatcaattgtttctatttttttcatttgtatctgctttactgcctctttatctggtgttgcactgtaatccaaatgcccaacaggctgtgcattgggctactgtaagatttcacaaatgcctagtataattctatagagtattaaagaagaaaaagtgaaaattatatttccatgaaggcagccacacagtctcataaatgctaaataattagccaagatttcttgacagagaaagccataagtcactttaatgagtggccacaggagtttgttattctccttttttcctagtttttttttttagagatgagagctttccttgcctggttggcttagcacggatctacataagaggcagagatctgaaccagtcatatgtcttgtaaatatctcttgtaagttttcttctctaagagcacgtactttttcactgttacacttttggaatgatgtccaagacaacctacccactaatgcttgttttctccagcttatctgcagactacaattatttcaatcacagttgttaccagagtagaattagtgttcatatttgccagcaacttctatgtaataaatcagagctaagctactacataaaacagagtctttccaaacaagtattgcttgattttagttttcactaaactgtcttaggaatcatgactgaccaattctactcactcgttccactccctccactgattctagccatcccttttttttagggaacccttatttatctagaaaaggaatgggatggagtaggtgattcaaatagcactaaatgcatatgcacttatgcacatataccagaagacagagtgaaagttcttcgagggcagggtcaatgagccatgtataggtatggagtggttcatgtgggtgggcacccacacaacgtgtacacacaaacatccccagcctcccagcacaaatatatgctctccatccaaccccaaccccactctgggaccactcacaaaacaggacagcctagatgaggtgattagaaatgggggaaaggaaagagaagagaagtcccaggtctgaatggagagctgagaatctagacacaaatgctggcatggggaatggaacctctgacccctggatccatactcctctcacatctacaggaatttagtcctagggaaacaagaatagactattcatgtaaccactacattctgcttcctatgccttttttttctggatattaaaattgccacctatgtgctaggaggctgataaacaataatctataaccagggatagccaacaacccctagccattggggagcaacagcctggagctcacatttctgaaagagagggcatcctagagaaagtagctcagggtacagtttcaaggcacttcatatcaaggcttcccaaataagaagccctcatattcatacaggggatggcagaggctcctaagagaaaagaagagctctctatttgccaaaggctggccaatcagggcacggttgggcaggtaggctggtactcccatagcataacagactgtcaaatcactgtgggacttctttgggctgttactagatgcagacttcaaaattctgtctgagccttctccagatgtttgccttggactctttgggcctcccctggtcatctcaccagtcccctatttaacttatgccttatactcccttttcttgccctcctacctggctttgacatagtcctgtcatacctggatggcatgaccctggcaatggcaccttgctatgggtctacctgtaaggatttggagtacagaagctaaaactattgaatcgacagctagaaccagcctgttctgagttccggactgacagttgcggataatgagatgcctgagacgtatctctttcttattctgaaccttagtatttcagccagtagcctaagaggtctattacagttccaactcttgtacctcttggcacatctgcactcaagcagaatggcacacaagcccctcagcagggcactcaaggtctacactaacaaagagtaccaatgctgaagacttgctgatcctgaatgtaggaagcctgagaacatctggaaaaaaaaataattatgtttaaaaaacagttgttccatttatctgctgcttcactttgacgaacagaaaacaatgtcacataacatagatagtcaccacaaggacaccagcttgtttaaagttacacatgaatttatatgtgatgctgaaggataattataatggcttatatctatttctaacatcttgaagttttgttgttgttgttgttgttattgttgttgttgttgttgaggattttttttaagaacacacagagaaagacctggtagaagtctttctgacatctggcatagaagacaattatacctttattgcacaaggaaataaaatagctgtgtcttagctccgtctttggctgacagctaaggcctggaagttttgtaagttttcctatttaggagttttgttgagagcctagcagcctcacagccaaaacggagtgtctgagatgctgctgattagaagtcatgggtctgctgagtacaaggctagagtcactccttaggaatgtcataaaggacctgggcagtagaaaccaacaccaccatggaaaatcagacaggatgagttacctttaaaacaaactgtcatcattaatagggaaaatggcaatgacttattaacccctatgattatacaatcatatcttcaagtatgcacacttttcatttccttcttgacaacttcatgaaagtaatgtctcatctcctggaacatttcttttcctttttttttctttccttcttgcttctaattaacattgaaaatcatttatttatcaaaattaggtttcccctgcccatgtttcagaaataataaatagctggctgagtatggtggctcaagcctgtaatcccagcactttgggaggccgaggcaggtggatcacttaaagtcaggagttcgagaccagcctggccaacatggtgaaaccccacctccactgaaaatacaaaaattagctgggagtggtggtgaacacctgtagtcccagctactcgggaggctgaggcaggagaatggtttgaactcgggtggtagaggttgcagtgagccaagatcataccactgcactccagcctgggcaacggagtgagactgtctcaaaaaaagaaaaataataataaatagctatttccaccatatcaatgacatccactagatttttgggtataaatttggaaagaaatatgatgaattacctgctcagtggggtgaagtgtctttctccttgcttcctcctgcaggcccttcttttaattttattgtcctatctttgaacttctctagagatgttattcctatcattataaaaacatctctgtgagaggcctaggatggccccaggaagccgatttcttaggattttctcttctgtctctgtgaatggatctctgtatccccactttctgttgggcttcagaaatcctttcattttatgaggaatcactgtgtttttctgggaaagaggaatgggtctctgtactgaagaatctcacaaaagagaatcagatgtttccttcgccaagcccccagatgaaaacgttcataaagtgagaatatgccaacgtgctgggcaggatcgcctgcctgcacaggtctgtactgtaattacatttaagctcctttcaaaaagcgaaatgctcccattcaaaggatctttttactggttaccaaaagaacatgttatgaaattctaagcaaagtccatttcaatataatacatgggatatggttaatagaataggaggaaaaaggactgtgggaagagcttcaatctactaagcccccagattgtagaagatcagatttcatgaagaaaacctaaaaataagataagaagcattcggctttgtttcattctgactgcttagtgcctactcttgggctaagggatgctgacaagctagtatcatcaagaattgtctaggaactgttattcctaccctaggattatcacagcttggaatgcctcgcctttcatttttctcagcttacaaccaaggcatgtctaaaatgcaaagtatctatttgaaatgacaaaaaaagaaatgcagtgagaaaacagatcctgacagttgtgttttataaaagtccattctgagaatacaagaaagaagtatacaagtttaaaaaaaataaggaaaagaaagcagttttaaagtaagtcattagacagccctaaggcaaaaaaaaaatatttcaaggagagaaaatgatcacaatttactaatcaatgatgttgaatgcagtgccaacatgctttaacaaatgcgatatttcttcctagtagtaccatttcatttcttttaaagttgaattaatagttttactaaacactatgaaaacgatcaataattgcatttcctgaggcatttagcccaagaagtgcttttaaaaggtatatctttttatttagatatttgttagatctaagcaaaatcaaatcaggtaacattattcagaaagacatgaaagggtatcatcatcctggtcacttggtgcacacccaggtggagtcaggaacatgtaggactgatgatcaggtaggttgttacttggaaaactggtcctagcttctaattatttgtcattagtctttgctcagcataaacctaaaaacgggagatttatctctctcttttccaatgtcctagtcttgaattttcaagggacatggtggcctttgtgatatcacagcaaactgagggcccacagggatgatccaggagaagcctcaggcccagtgcttcagtgtattggaatgctcgctgctttaattcatgcatgcgtccagtgctcaccacgttcagggccatcggggaaagcacgtcaacatgcttgggcagtgcaggaaaagaatctggttaacctggaggcgacaaccgaaagggggaggttgcatcatgcaaatgaaaaccacagcttggccttagctgccatgcagaaaggacctacatcaaagagtctgcagtgcggctcctgggtaagagtcgatatgagagaggtgagttacttcagcaatgagagacacaggcagaaaaatgttcaaaccactctaaacagaacactgtacagagcgctggcattacacgcgagaagaggcagctttggggacgaggaggggcgagacagagggaaggtgaggacagaactggccgttactcaatgaaatggcttccctggccatcctttcatatgcatgtatttttataatgtatttcacttcaacaaataacctcatgagagtttttaacatcaaccataattgttaagatgttgtgaaaattcaggagaaacaaggcatcagttacataaagatacacaccatggtttcctgtagttacagttcattatagaagcagagctgaagcgggtcagataaataagagacagttaagtgccaacatccttaacactttggttacagagctcatgatgactctcaaggcgtaatgtagtgttgaaggaacccaacagtcgtgaaagctcgggtggtgcaagggtagggactctatgcatctatacccctgaaagccatttataaccctgaagttaaccacgctctcaagtgaagccatcttttcttcatctcagcatgaatgacaggtgaacagtgagctcacctcatacatattgaccatttagcagaaccctagttacgagcaagattctcaaaggtatttcttatcaaaatcaattcatcagcaaaaagcatatatatgtgatatatatatatatatatatatatatttcttaacatttctcttaaaggagtaataatactgttttaaattcagtagagattcatcaagcttcgctctaatgtcaaggctacactggatatctaaaaactagtttcctgtaaactccctgcttaatataaggcttgttatcatttttcttgcctcttctgccttttatgatctctggtacattgaacacaactcaaaaaatggtacggtctagtcctaactcacaattcctgcctcctagttctgacaggggaagagcaagccccgtgcttataaattactccttctaaaatgttctccaggagttcagccttctgattccctgcgtgtatgatggaggccttgatagggaacttaggtccagtgtgaatgagcagtgcactgcctcactttccacactcagtgagaccttaacatacccactgaaacttgagcaccacccagaacatgggagtgaatgcaggtagaagcaaaacacaggattcctcccgacactaccttcctcattccttgagatgcagctgtttccacttgatcacaatttattctctcttatagattaaaaactcagaggcttagttgaatgacatcttttcaaaggattatctttttgaacaaaaacataatagtctgtacattcattcaacaaatgtctctgagtttttttctttggtgacaggcactatgctggttttggagacatataattcaataagacatgattcttgctctggagtagttttccatttagcagagaagtctacccagattttaatttctggcagcagatatgcaagagcagcttgtttaaaaattctactgattaccttgtatgaccttggataagatatttaatcatgctgtgcctcagtgtcctcatttataaaatgcaaataatacctacctcctgaggttgttgagagaaataaatgagttagtaaacgtgaactgctttgttagtggccagcacatgatggatgctatgtcagtggtagctattatgatcagtagtactcaaatataagtaagaagcaaaggactctggaagcagaagatcgcctctgcctaacttttgcagtaggccttgagtgaggattagaaactcatcagcgtgagaaggcaggggaagggatggaagcagagggctaagcttgggcagagagacagaagcacagagaacacagtgcattctgggagtggaaggacacctcgtatagagcctaagtagattgtaaggttggcaagaaacaaggccagacaggagacggtgaagcatctgtgtgccctggaagcatgtctgctctttatcctataggaaatagggagctgacagaagtttatttattttttatttttattaaatctagtttttgagacagagtttcactctgtcacccaggctggagtgcagtggtgcgatcttggctctctgcaacctctgcctcccaggttcaagcgattctcctgcctcagcctcccaagtagctgggactacaggcgcctgccaccatggctggctaatttttgtatttttggtagagatagggtttcaccatgttggctaggctggtctcgaactcctgacctcaggtgatccacctgtcttggcctcccaaagtgctgggattacaagtgtgagccaccacgcccagcctgatagaaatttaaatgctggagagtggtaccattatcttgtcttgtagcaagttaattctggggacaatatagagtaggaattggaagcagaaggttgtgaagacagaggtcaattagtcaaattaaatccccacggaaaaaagtaacctatgcacatactaagatgagcatcattgttgccatataattacagtatcttaatatcctgggaaataccccttcttcagggcctgctgctgtcagagttctttaggaagaggggattaggtccacagtatcactgaagcaatttcctaaaccacatggttctctctcctaccacggcccccatgtctattgcaggaatctgtgtcatgaagaaatgacagcacatgtctcttaatcttctggaaaaaaaaaaacccaccctagtaagaagctgttctttctgctatttggagagcagtctctaaattatagttagaatcgacataaaatgaacatatttcagtacctcaaataggggtacctggacatagtagacacatgccaacaattatagacaaattacagataacagattatagacaaattgtatacatgtgatcacacccaggcacatagaaaaattacagtgaacacttctgctgcatccactattaattacctaaagaacttggttagtcataccgtcaagccatcaacttaactgccttttaagtgtccatccaaccctgtgcacagttaggatttcatgagcatgttggactggttttctctcacagaatcctgacctttagatttagatgtccttagtttccagagggctgcctgaaagtatgaattctggggtgtgcagggggtagggggtgaggctttcttttggcaggagttgacaagaggaaagatgccattttcaggtaatgtgctttctctttaaaaagtgaccaagtgtgtttgatactcacttagctcaattttaaccgtggtgggagctctgtaccctatgttggtaaatcagaaacaggaaagttctgtctgtgtgctgctgtgaccatgcggtcatatttgtttggtggatttccatttgttccaagtccattctagtttggagtttccatgaagccaggccaagtgtacaaatgctaacacagggaaaaagaaccctctatacatggacttacggagaagacaatacacactgaacttggaaaaggagcacaggctgagattccctaaagtggcagccaccttgctgcacagcagacactcagggagatgctccaggcagcaattgctcagcaggaaggcatgctggggaaggacctcatttcaaaggagagtagaacaggcctaagtgctgggattacaggcgtgaggcaccgcacccagcctgaaattagtattattttaaagttcacgcatgtgaccttataaaaatgttggtgcttatttttaagttatttctttttctttttaaaatttggtttctcacaagagaatttcattgtgctgatggaagagttctgtatactgactggagaggtaataaaacaaatttatgtgggataaaatgtcttggatctacacagcaaaaaaaaaaaagtgcttgtaaaaactggcaaaacatctgtacttgagtttacagcagtacgccaatatcaatttcctggttttgataacataccatgcatgcctatgtagcatatagcactatcatggggaaagcttggaaaggatacagaaactctgtcctgtttttgcaacttcttgtgaatcttaaactatttcaaaatgaagttctaattttaaaaaacagttattctcctgtttggttttactgtagccagacatcaggctagtggtctatttctggtgatatgtgcctctaaatgtctacagactgatttctttaacaaacatttactcagcacctgttataggtataatactgtgttcaattccaaaagatataaaagagggataagaaaccacagtgatacaaatcaacattaactatcttagttcctttctcaaaggagtgctaattgaggcaaagacatcatttacctactgcacaaattctcagagacaatcccccaagataatcagctgtcaataaatgtaggtcgttaatgtaataagcaagcttctagaattaacccacagtaatctcttcaggtaagcagatatcaggtaacaagctgtgctgaataatgcaactgatgtgataatgactctcttccttcacgtacagttggtgcaggctaagccatccttttccttagtttttcagtccctgttttgtccttcccagaactcagtgctcaccacactgaggagccaacaagtgatacctgcttaatgaaggtgcagggtgacactaagagctacttagattttaagaaacaactgaaaaggcttcaagaatgaatgtctaattggtggaatttcaggtactttgcaagttagaagagatgttttggagtataggagtatttacagcaccctcaaactcacccaaggatggccatctaccacactctctactaaaataagttgtcatgggcaattatattggaagtaaagtcaaggccaaatgaggcaataaggatggatccttagaatgccaaagactttgcaaggaacatgtcaacagtttttatcattctgagaagctgcctctaacaggaacaaaaagaaaacagagaaatgtgcaaagaataaaatctcctggaattgaagcctcagcaaatgaatatccaggaagagccaattcaatccttcctgaaatagaagatgtgtcactgctgttaacctgacaccgttattacctgcaagtggcttgggcttttaagaagtctggaagtaccatctttttcttgctgtttaaaggataaacaactagaacagctcaatccgggaacaaatgaatttttcaaagcattccccaaagaactgggaaactcctgctatgaagaagggtcctatcctaatcacaacaatttttaaagaagttttgtaacagtggaagacagaagactcccagaaatatttgacatctgtaagaatgaacagcagctaagaatggacgggctgctgcattcactcctctgtttcacacccatgctattcccttgcaagctcttactcatccacctttgaacactcaactcagtggctgcctcctccagaaagcctcccctgatcctcctcccacccagaggtaactgaacctttttctaggcttttcttcctgggtgcttctgttgtggcgctcatcactcatgaagtggtaatttatttgtttgtgtatctgtctcccttccctgctagactgtgagctcctgaggggagagccttggtgttttgtgtctgggttcccatcatcatggtacccgcaaaataggccctcaatacatgtttaaggaggaggagaaaaataaatgaattgagggagaaaatagacaaacctggaggaaactgattataattcaacagtaccaagatactagggaagtcccatctcccaacatggtttcaaatggccccatagtcccataccaattcagaacttaaattaggctaggcgtgatggctcacacctgtaatcccagcactttgggaggctgaggcgggcagatcacttgaagtcaggaatccgagaccagtctggccaacatagtgaaacctcatctctaatagaatacaaaaattagctgggcatggtggcgggttcctataatcccagctacttgggagactgagtcaggagaatcacttgaatccatgaggtggaagttgcagcaagccaagatcacatcactgcattccagcctgggggacacagtgagactccctctcaggaaaaaaaaaaaaaagaaagaaagaaaaaagaacttaaattatatgacaattacatcagttacaatattactacaatccctagaggatgaggtgcattcaaaggactgatttgtgtgctcttcccgtgtttcaggggagtttcaggttatctcacctcatgtgtgcaagaagaagaatgggaatgaccttggaggtaacaagattcaccactcagcaaagccatttgacctcactagccatgagaggtccaagacctgagaaggctatgggatagttaaaattccacaggagagtctccccgagggcattcaatttctgtgtcattaggcatcacaaaatctaaatgcctaaaactaaaaaaaagtcattcctctgaaactaatgagtatgcacttttctccttctatgagggttatcttctataactgggaaaccaagattgaaatgaagttgcccctgtaaacattataaaattaatcagggaagaagaaaggggaaaaaataaattaataaaccaagcttgaagcacattcagcattaagcatgaggtcaactcattctctgacctgcttcctcgacatggtttggtgcctattgtcctagaatcatgtagactctgtgataagatgatagttccccttaagtgctctatagataacaacttgaacattaagaaatgttaagctttccccgtgaggtagtctttcaggtcctgcatacgagtgaaactactacatcagctgatctgaatgaaagaccccacgggtgaccccaggaaggtctgaggaacaccacaagaagctgactcaccaaagaacacaatttccacattctgatgatttaatcccccttcccctgatcagtcaacaaccccaattttccagcccatcacgctccatgatgttcttaaaaaccacagcccagagctcctcagaaagatgaatttgaggctctcctcccatctcctcccttggtgccctgagatagttaaacccttctctgctgcaaacctgctgtctcagggtaatgggtctgttactatgcagtgggcacacaaacttattggttctatatcagaaataatacacagaggtgattgaagccccagttcgttcttctctctttgcttcaaatgatatatttttttgtgctctagctcaggaagctggacctaaacttgacacgaagcatactaggagcaaagctaaaaatctagagatgtgtgcatatcaaataggaggaagtcagctcatgtttctcttgctgattcatttctccaggaagccaacccaaggaatcaggtgttcaagcaacaatggaaaaagatgaattaaaatctccacataagaatacatagatgaagaggagtgtgggtgaggattttaacccaaagggtctccttggagagtaacttatcttactggatataaatcaacatgctctaatttttccagtaaggctgaatatatttaaaccttcaaaaaatatagtaatttttaatgcagtcttagattgatgaaggtttcttatagtttttactccatgctgcatatatgatgaagattccattaggaagtccatctgaaccaagtatttaaatcacttaacattaactttcctttgaatttgtcctctcatatcagcctagattttgataacctgctccttctagtcatcactctccctaaatataaaaccattttttaaaaaatcaggacgactttttaaaagtctatgaaattgtaaaaatttgtagagttatcactagcttctgaagtgacacctctgggtaggcaattctacaaagactatttgtaactatatgagctaatagtatagaagcagtgatgtaaaactgtattatttgtttattatgagcaacagaataatggaatgaattaatgcaccaatctcgctctaatgaatctatggacaacatgacagtatggtgtgaacagaacaaaataaaaccattgagtgggtccatttgcaaataagcccatttccccataaggcgagagaacatttgtttaatttaaagcttaagaacaatctctttacatacaaaatactttttctcagttaaaaaattataagtgctaagacaattaaattaatacagcatcaccatttttaaaactgaaaaaaagaggtttaattaatctcattgtgttctaactcactgttaaatcaataaaagagtttgaaaaaaatgtgtcaacctgacgttggattcattgtttttctatttagtagatatgtttaagaattcattgagtggtgttgtggagtttaaatgagttaaaacaggacaagggcttagacagtcactggcactgattaagggctcattaactgttacctgttgtcaaatgtaaagtcatgcgccaaacttctatctgctcttggtttttcgtctaactgggaactggacctcttgcctctacgtaagtctcctaccacccgtattactctctctctttcccactgagctctaaccatactcatcttctttctgtttcttcaactgtccaagtttttggccatctccactggaatgcaaggcccataaaagcagaaaacatgtgtgttttgttcactgtttcaccaaaacctacacaagtgcctgacacagactaagtactcaataaactttgctaaacaagtaaataaataaatggagagccaaaggaaggaataaagggaggcagggagggaggggggggcgggtcttagttcattctcactaagattaagtctatggtcaatactagtttgctagtgtttcctttatcaaaccatgcttgttattaggatcaggctgctcccacctcacttcctatgtctatatgatttttttgtactcacaaaaaggattttcctctcttgcattccaacacaaggagttccttgacaatttaatattatataatatatgcacctggaaagatgtttgacatctaatttttgacttacacttaaccacatatttccgctttcatttgaaggcaaaatggaacattttcttgtcaatttttttttctagattatgtgaagaagaaattaatagtcttgtcccatgttaatctaaagctcttctgattacataaatttaatagaggactctccctaaacaaactttaattccacacttaaagtatctttacaatgacaaaattgttctgcattctatagatattggaatataacacattgcataatttagaggttaagaaaatggactctggattcagaccaggggttcaaactctagttcctattactaaccatgtggacattgaaaccttctgaggtgttctttcttcatcaagcaaataaagaaaatcgtagtagtgctactaagtagaataataagtttgtaaaaggcttatcatggcactttgcacctagtaagtactcaataaatacagaagctgcttgtagacctagagagagcaaactagaactaagatcagaatcccctaatgatagccaggcaagccagtacctgacctattgaacatctggtagagatccactgagtgaacggctgctactggtgactaactgcatgacagcctttccttgtcttcctcgctaatgtctgttcaggttgtgtggcccttcctatactgatgtgatgtattttgtagaatccctctccttgagcctgtgatggccaaaattgcgtgcataccataaatgcttaactaggtaaaatgcctttgtaagactctgatgttagtccctgctgacaactttctacctcactacaatccactttaatctttgcattgacatttctgtttagaagagcaagccaggaatgatggctctgggctgagaatctggaatgcagattataactgctcagcaagttcgcttgctttgtgtaaactggccgcacttcttttgtcctcatttggaaaatagctttggctgcttgatatcgccacatcttccattttacacattctcagtttctgacaagaaaagtagagagtggaatgccacactgttgcaaatctgcggatacgcatcagcttaaccttatttgttctggtggatttttgtagatgagaatgaatatttgggctacaaacttccagcttgattcccttctcttagttccaatttcccagggtttgtttgctcaaatgcccaatgtaagagcactactctattctaggggccaccttccactgctgtgggttgacctcaacaggcattaaacctgtatgcagagccaggcatggtggcacatgcttataatcccggctccttggaggctgaggcgggacgatcacttgagcccagaagtttgagactgcagtaagttatgatcacacaactccagcctgggcaacatagcaagaccttgtctctaaaaataaataataagtaaataaaacgttttaaaaacctgtgcgcagaaatgaaagcccatgaacagcaaaaaaatcaaatgcaatcctggagctatgcataaaccaaaggagagatgaatatgtctagattaaagttctttagcatctactgtccatcttatgggattccatagacaaacatacagtagaaaagctcaaaataaaatggctttattctatatttaaaactacattttttccttatttgtgttattgcagactattagtttttcatgcacaggcaagagctaaacaaatacactgattccccaatgtgaccctctatagcatcaagacctatttttatagcagtgtaagtacatgcaccaactattatgtgttcttatgaagtaatcctcatcctgtcaactgctgtaagatcctggggaacatgctgagcaatgctggtgttctatggttatgcagtacttggccaagctcagtgggtaatttctcctaagtatatatatgcttaaatggcacctaccaattatctctctttggaagagtgcaagtgtagcatgcccactctcccagatgtgtgcacattcccgcctccacagagctgtctcttcgcctctcctctctagaagctctgggttagtcctttctccaggcacagaggcagctgagtgaactcagcctaggggagctatcactgttcttttcttacctctaggagttacaacagagaaaacctgttctccagaaaaagaccaccctctacaatgtcttcataggaaaaaaaatggtcacacctgtgacacagccctaattgaattcttataggcacctcagatcaaagctacccaataacctgaggtaatggaaaagaaaaacaatagagtatgacatttattcatgtaccaaattcttggtttctcacctattaatttttggtcttgcaaattttgctggaacagaacatgatagagtactggctctgaagttctaggttcagataacaaactcaaaaggggtttaggaaactaatccaagggagaatcataaatttgaaccttaacatggactctgttctccacattaaaatatattgtactaccttttttcatataacatatcaaagaaaccaagagttggctcttcgaaagaatatacaagaatgctagacagctggccagattaacaaaaaaagaagattcaaataagtgcaatcagaaatgacacagatgacattacaactgatcccacagaattacaaaagattctcgaagactattatgaatacctctatgcacataaattaggaaatctagaggagatagataaattcctggaaacacacaacctcccaagattgaaccaggaagaaagtgaaaacctgaacagaccaataacaagctctgaaatggaatcagtaatttaaaaaaaacctaccaaccaaaaaaaaaaaaaaaagtcctggaccagatgggttcacaaccaaattctaccagatgtgcaaggaactggtaccaatcctactgcaactatgccaaaacactgaggaggaagggctcctccctgatgcattctatgaagccagcatcatctttataccagaagatggcagagacacaacaaaaaaagaaaaacattaggccaatatccctgatgaacatagatgcaaaaatcctcaataaaatactggcaaatcaaatccagtggcacatcaaaaagttaattcaccacaaaccaagtaggctttatccctgggatgcaaggttggttcagtatatgcaaatcaataaatgcgattagcattataaacagaattaaaagcaaaaacacatgatcatctcaatagcctcagaaaaagattttgattaaatctaacatcccttcatgatagaaactctgaaaagagtaagcatcaaaggaacatacctcaaaataataaaaaccatctatgacaaacccacaaccaacattatactgaatgggcaaagctacaagcattccccttgagaagaggaacaaagcaaagactcccgctctcattactcctattcaatatggcattgcaagtcctagcctgagcaaccaggcaagagaaagaaagaaaaggcaaccaaataggaaaagaagaagtcaaactacctctcttcactgataatattactctttacttagaaaaccctaaagattcttataaaaggctgttataactgatcaatgattttagcaaggtttcagaatacaaaatcaatgtacaaaaatcagtagcatttctacacaccaacaacatccatgctgagagtcaaatcaagaacacagtcccattgacaatagccacacagaaaataaaatacctaggagcacagctaaaaaaggaagtgaaagatctctatgtggagaactacaaaacactgctgaaagaagtcagagacaacacaaataaatggaaaaacatttcatgctcatggataggaagactgaatattgttaaaatggccatactacctaaagcaatttacagattcaacactattcctatcaaactaccaataacattcttcacagaattagaaaaaactattctaaagttcatatgactccataaaagagcctgagtggccaaagcaattctaaacaacaaaaacaaaaacaaaaaaacaaagctggaggcatcaaactaccaacaaagctggaggcatcaaactacctgacttcaaatatactataaggctacagtaaccaaaacagcatggtattggtaaaaaaaacagacatatagatcagtgggactgaacagagaacacagaaataaagccgcacatctagagccatctgattttcaacaaggctgacaaaaacaagcagtggggaagggactctctattaaataaatggtgtgggtataactggctaaccatacgtagaagaatgaaactggactcttacctttcaccatgtacaaaaattaactcaaaatggattaaagatttaaatagaagacctcaaactataaaatctttgaagaaaacctaggaaatacccatctcaacatcagccttggcaaagaattttttactaagttcctaaaagcaactataacaaaaacaaaaattgacaagtgggacctaattaaactaaagagcttttgcacagcaaaagaaactatcaacaaagtaaaaagacaacctatagaatgggagaaaatattcgcaaactatgcatctgacaaaggtctaataactaggatctataaggaacttaaaaaaattgacaagcaaataatcccactaaaaaatggacaaaagacatgaaatgacacttctcaaaagaagacatacaagtggctaacaaacatgaaaaactgctcatcatcactaatcgtcagagaaattcaaatttaaaccacaatgagataccgtctcacaccagttagaatggctattactaaaaaatcaaaaaacaacagatgctggcaaggctgcggagaaaagggaatgtttacacactgttggtgggaatgtaaatttgttcagccaatgtggaaagcagtttggaaatttctcaaaacacttaaatcagagctaccattcaacccaacaatcccactactgggtatatacccaaaggaaactagataattataccaaaaaaacacatgcacctacatgctcattgccatgaaatttcacagtagcaaatacattgaatcaacctaggtgcccatcaatggtggactaaataaagaaaatgtggtacatacacatcatggaatattaaaaagccataaaaaagggtgaaatcaagtcttttgtggtaacgggaatggagctggaggccataatcctaagcaaattaacacaaaaacagaaaaccaaacactgcgtgttctcacttataagtgggagctgagcactgagcacacatggacataaacatgggaacaatatatactatggactactagagaggggagggaaaggaccgtgggttgaaaaactacctattgggtactatgctcgctacctgggtgcaatatattcacataacaaacctgcatatgtaccccctgtatctaaaataaaaactgaaattaaaaatatatatttttaaaagtactgtatgtatactacttttaattatgaaatgccaatttgttatattctctctctctccttctctccctcccctgctcagtgtctcttgctcttttctctctcttgctgtcttctcttccctcttcctcattaagctgtatggttaaggaaatgagagcaatctctgcttcaaggcacagccaagaggaatcagcgctcttgactttgacatcttcaattcctactaccacacttcgtcagagaaaaaaaatgacaggaaacttctagacaagatgattccctgccattatccttaaagatctatccaaatcacatcattcctttcacttgctaattggtttcgtaagccttcttcccttccttatgttttctattcttatttttgggacaattgccgacgtatgcatagttctggattttttttttaagtaatttgtagttgactatcgtttatttctgcaattggtgtaattaaatctaattacataatcggtgaaagactgagtaattacataattagaatgtgcaataataacagttgaaatcctattgttatgacgtgtaatgatacaattatgatgtataacattcacagggtactctgcaacgagcaaaaacggctctaaccctggctgaatggagcacagctaaagttggagacctggaaagtagctttcagcacctatacttggacttgcttatcatccttatccccctaatgtatcctttgacttttatactccacaggaatcaaaggcagtaggcgaggtctaaggaaggtcctcatgagggcaggagcactcacatctccaagaaccaaatcaccaatacaatcagcccttagacagaaaggagcagcaagagatggactcacatttctgaaacagtcactcctgcatgtcagttttaagtttgaaactgtaatcaggagacaaaaagttagggttggagaatgtctggtgatcacacacacaattacaagtgggcctagtgattatggcctgggacatagctcccagctctcagtctgccctctccaccccaactccagtcatcttaatcaccaggacatagaccaaccaccagaagtgctggcctcccaggtccttgctctgctgattgtcggtgaccctttcctttcctccacgccacccacccactcccatgatcttgctctggacccgaagaaagcagcaactatagtgtttctgatatctcggcctcaaacaccccattcatcaacagcaacctctcatccttgtgctcgcctgttcacgtgctccccactgggacccttccccaacctcagagaaatctccaaattctggacacctcccccgacatcccacccctggccagtcatctgctccctgccttgccttgcaacgctccttgtccagcctaattcccatagtccaccattgtcatcacccctgggcagcaccctccttccataacagaagccctcagccctacttcacaccagctctggaaagctgaaagttcctgaataaaaccacacaagggaaatgactggtttcgctttaaattcatgatctcaaactgcaaattgacactccatactgactggcaaactgctatttttcttgaattggtttgctttccaattttccaaggccactatttcacagttttccttctctcctccaacctcccatgttcttttctgcaccatcaggctcagtggatggcctcgcctcatcatgtcattaaaagtcacataaaagaatcaggccagttacactttttttcctaccagcagctctccaacactgcacttacaggcgcccagcacatcctctgcctcttcattcataacacaccatgccctccacagacactctttcagccctgtactgtctaactgtactgtgttgctatagcaagctctcccttgctgctggagctctgctgccaaaatataagcttgctcaactgtcctccatagccaaccacatttccagagactactgcaggctccatcctttagcccactttgatcaggccctccctccactcactagagcttcaatgtcaaagaaaccagcaacatccctgtcacaaactccacagatgaccctagacccttaccttccctctgtctcaacagtgcttggcaattggccactccctctgcctgaaaccctctcctccctaggcttctgccatctccttgccctgtgtgtgcccttcctcagtttcccatccagcctcctcctgctttactcaccctctaaatgttgggcatcctcttgccttcacctggggcaccttctctcctctccctacactctttccccagatggtaccatcaactcacaggcattcaaagtcatctttgtaatttccaaatgtaatatgattcctctcttctgagttctggactcaattatctaccctgctgtttgacatcttctctttcaggtgtcacagacttcttaaactgaacatatccaagatggaaatcctgatttctccctagtgcagcccttagcccccagtgcagcccctcccttcccagtaaatgctaccaccagcgacttgtcattgaagccaaacactagaaggctagaaggaccctgattcctccttccattcactccacatccaattcatcatggagtcctgtccaaaatgtctttctcctctttaatttccctacttcaccaccccactagatcaggccagtgccctcttctgtcgggatggtcttttctttatcttctgaacatgattacagattgcacctgttttgttttgttttgttttgtctgtcttttatttttgcttttttttttttttgcctgtctcctcctctagactgtgttccctgattacatttattgttttacttatttacagtttccagcatagatcaggtaattaactttcattagataaataaataaatgactatggtattggcatctataatatgcagactatgagcctcatggtaaacttataagggccaagatgaaagccagggccagagcagagataataaacttagctgaaagctactcaaaaagttaaacatcgagataccatatcttgatgtgctatgaactggattgcattcccccaaaattcatatgttgaagccccagtccccagtgttatggcatttggaggtggagcctttgggagataattaggtctaatgaggtcatcataagagtggggccttatgatgggattaatgtccttgtaagaacagataccagtgagcagtgagcttgcccctcccccccacctgtctctctctctctcctctctcctctctcctctctctctctctctctctctctgccgtgtgaggacacagcaagaaggtggccatctgcaaccctggaagagagccctcaccagaaattgaccatgctgttgccttgatcttagacttcttagcctctatttctatcttgaaaacatcatgctaattgaaagaaggaagtcacaaaaagccacatattacaaaattcaatttatatgaaatgtctagaacaggcaactctatagagacagaaagtagatgagtagttgcctagggctgagaagactgggggactgggagaatgtggaatgattgccaattgatatagggtttctttcgggggtgttgaaaattttctggaattagattgcagcgatagttgcacaaatctgtgactatactagaaaccactttaaatgagtgaattctatggtatataaaacatatttcaataaaactatgaagaagaaggggggaagaggagaagtgggaaggaagggtgagagaagcgggaggaagagaaggcaaacagcagcagctcaaattagttaacctagctgagttagtctatggaatctaagttgccaccaacaaaaaagtaagccactgctttatatgccaccaagaaagaaaatatttaccaattatagccataagaagtcatgaatgatgagacacttcctgattttggagattttaaactatgaaaaaattgtatcttagaattagtaaaatacagtacacgtagctgttgtcagatctaggtaccagcttctgaaggcttctaaatttgaattacttctttaaagataatttattaaccatgaactcattcattcataagaaaaaattttatcaaatgagtattataagctggatattggctttatatatggttttgactctgtgcacatcattcatttaatcttcaacaactacccttcaagataaacattatattcctcattttatagataagggtgtgggctacagaaaggtcccatagttcttaagtggcacagccaggatcctaagccatgtctccaggtctctgctctgtccctgtgttatgaatgaacagttcagatgcagaaaccttgtgagcaaaaactgaatttttggccaggtgcaatcttaatcgctcacgcttttaatcccagcactttgggaggctgaggcgggcggatcacctgaggtcaggagattgagaccagcttggccaacatgatgaaatcccatctctactaaaaatacaaaaattagctaggcatggtggcaggtgcctgtggtcccacctactcgggaggctgaggcaggagaatcgcttgaacctagaaggtggagattgcagtgagctgagatcatgccactgcactccaacctgggtgactctgtctcaaaaaaaaaaaaagaaactaaacaaacaaacaaaaaaaaactaaatttttttctaagccaaatgtttcctctgtcagctttagagatgtagatgcccatcaatcccatcatctcaggccttacttctcacatggccaacttctcccaacatcaactggtatgtattaaaggaataggaattacagtacatttctggagaatattcttggccaccctggaatttcctgcattcaatatgttggtttgccatgaagtctccaggagctgccgaatgaaaacatggagatacttacagatgacacagacagaacaaagtggaaaatgagaaacaaaaggagaaaaaaagtggtatgaagtgcagttgcacctcaatttatgctgcagatgctttcttgaaaattatgtgtagatcaaattgatttatgaactaaaccctatcataaattcaacaaaagcattgtgatggaaacttttgtaatcagaaaaatttatttgtgctgagaatagttgattctcagcctctcttttgaatttacttgttattcttctcaaggggagcctacctgcacataaaagttcgataaccaccagggattcttgatgtgcaggaatgtcatgagaccaaaatgctttacaaaggcttaaaaatataaactatctatgccatttataatagccatttccataatactttaaatatatatctcaacataatgggagggttgagaagatccttctcagggatggaattctaggaccactattgaaggagattatttgcgtgggtggggaagttcagaggagataagtatctcccctgggtaaccaaaagccctgaacccttctctcttgacagttgagagggagggagaagttgaaggagtccagcactccatttccaaatgactcccatggcctccttgcaaattacaacgtcactagctccctggtcttccatagccaaaggttacaaaatggccacccatacaggccatttaaaccatttaaaccatttaaaccatttaaaaccatacaggttttaaaaatcaagtgttacatttcttaaaatggatttgcagaattacttgaatgaataaaagatctgcaagacatgctccatattcccactggggaataactcactggagctgggtagatgctcctgaagacgtgtctcctggtccccactacttcttaagccttgcatccagcctggctcctgcaggcattttcacttgcaccccagtagaagtctcctctgagctaagggtcaccaccacacgactcacccaatcccatgtagagcccgcaaatatccatgatcccaagagcatcctttctttaatgtggtctcatttcaaaatatatgagactgttggatttatttatttactgatttatttatttattgagacagagtctcactccatcgaccaggctggagtgcagtggtgcaatctcggctcactgcaacctccgcttcctgggttcaagtgattctcctgcctcagcctcacaagtagctgggatcacaggtgcacgccaccatatccggctaatttttgttttttgggtagagatgggatttcatcatgttggccaggctgatctcaaactgttggcctcaagtgatctgcccgcctcggcctcccaaagtgctgggattacaggcataagctactgcgcctggccttattttttttattatttaataaattttttagagctagcccaaattctttcagatcctctgttcttgaagtgccctcctggttcatttcgtctagtgacaaatatgactccatatcaccactttcccagagaatcagcacagcagccatgcctccagagcttttgcttcacagacatgcttaataaattcactttaccctttagaccacagggcttagaaaggaatgttgtttttgttgttgttgttattgttctgctttccatcagcttaatacaatcgtgacgacatgcttctaagaaggatcctaagacgttcatttctttgaagcactattaccagtggagctgacaacaaaaagttaatagacataggactcaggcactcaggctcactctgcttaaactagcggagtggggaagaagagagacgtgtacattccatatccataccagcctggggtcttgggttctaagaggggtggtggcttttccctgagccctaaacccagcagctgcagttagtgccaaagattatgagggtacagaaagtaaagaaagatcagtgttttaaagtctccacccaccatatgatttctcagaaacctcaaatgtcctttgttgttgttgttcgttttgttttgttttgtttttgagatggagttttgctctgtcgcccaggctggagtgcagtggcgcgatcttggctcactgcaagctctgcctcccgggttcaagcaattctcttgcctcagcctcccaagtagctgggactacaggcacccaccaccacacctggctaatttagcaacctcaagtcttaatccatataggaactgtaagaagactactggtttgtttctcatcactaacatggtaactcatgattgccgaacactggctgagcagtcatgctctgcccagtggcattgttttctaagaacttaagtgtatcttctcattatcctcataaaatccccattatcagctccattccacaagtggagaccttgaaacttagagagcttaaataataataataactaaaattcatgaagggtgcccttctagcccactacacataccaggcactgttctgagtgtttttatctgttgactcaattaatcctcataacaccctttttgtgttactatttatgttgtcttcatattacaaatgaagaaactgaggcacagggaagaggtgaaataagatcacttagctggtgagtaattaggcagaacttgaacttgggcagcttgacaccaaagctgtgcttttactgctaggctgatttgctcaaagtcacaccactggttaaggctggagtttgagtctactccatgtggtcagaatctagagccacaggggcagccatgtgctctgcggcctgcttagatgttcatggggtcagatttcctctgcagtggctccaacggctggcagcagggtctgggatggatgtactgcctttctcagagctaggctgggaaaaacatttccttgtcatttattttttaaatgtcaggagattttaaaacttctaggagagcagataagtgataagaagaaaatctgggtcgtttttgtgcatacaaaggggccattctaatagtggtttcaaggggtcttttctagacaaaaggggaggagattgttttagtagccctctcttcctttcctggggagtttgaaactatctagttttgaaatctaaaaatccccaagctcttggatctggtcctttttacccccttagccatatattccagtttctgctaaaaaaagtctgcctcaagatataagtgacatccaactgttggggctgttttctcttttcatagaaaccagagcttctggggttctgagatgtctctagcggtcactgacctaaccattagcaactgggttctacaaataatgtccctggggaactcaataaaattatcaatcgctagcccccacaggtcttaatagagagtggataggtggaaggtttataaatcaggatgagtcatttgattcaccaagggaaaagataaataaaccaacactccaattaattttaacctgaaaagaaactgctagtgaatggtgcgttagccaagtccgtagggtcttaacaaccttaattattcacaaatgcaaattgcttttactgcttgctaatttcttcatgtcttccatccagttcctcttcccctcaccatcctcctctctcctcacccagtctctttattcctgaagagccaaaaggaaatttctggaaatgaccttctaatcactcaagctttttctctaaaaaaatttaacgaatcttcccaagaccctaattagcttaacctgggatccaaggactgccctaggcctaaataatccatagatgcgcttcagggaccccatgagctagctgaaattatatgcaaaattgtgggggtgggtgcaaaaaaaatcagaaagaatgaataagacctactatttgatagcacaagagggtgactatagtcaatagtaacttaattgtaccttttaaaattaactgcaagagtgtaattggattgtttgcaacacaaacgataagtgctctaggggatggataccccattctccatgatgtgattattacataataagtgcctgtatcaaaacaggtcatgtatgccacagatatatacacttgctatatacccgcaaaaattaaaaattaaaaacaaacaaaaaattgtgagggtagggtacttcctggctccctgcccacccaagaggtccaattttcatcaaattctcaagaaagtctatgttctccccaaccccctaaaacagcattaagcattaaaggactagactgtacccacctaaacactgcatcacaaggaatatttatgatgcagagtgagacagcccaggcttaggagccagacagatgcaggttcaaatcccagctctgtcacttacgagctgcatgaatttagacaaatgtcaaattctctgagcctatttcatcatctgtaaaatggtgatcataactccttcagtacaggattattgggtgactatacaaaataatacgagaaagcacaaagcatttgtacatagaaagggcaaaatgaaaatcctccctacaagagagagaaaaaaaggcagatctaggctcaggagtagagacgctgctctcccatctttgggaactgcatttctggctttgctaaagatgaaggtcactgtactacaaagacaatcagattgggatcacccctgggaaatccataagaatcagattggaagagcactctttatgagcatcatattagattataaacctttttatagatcttatagtgacatgcccaatctgatttaaaataagcctctaaccctctattctcctactgtctctacctactactcccaacataatgtgataagcaaagcctaaacatttcaatcatgtacaatgtgaagttgcaccacagtaagggcactgaaatgacctcaggaagcccgcatagccagatgtctgcagtccttctgcaagatcccaatattttcaggttctacctgggtcagttcgctgctctggggtaaatatcaattagaggcttctagatcctttggctgttgggacttccagaacagcatcaatgacttcaaaaacatcctgaagtcgattaatctgctcctgttgtatgggctagattcctgattccagagaacaggccaacagaacgcaggccaagaggaccccacctttgcatttctatttctcatggcaaggttgcctcactcccagaaaaaagaactttagctttattatctgagacaggcagaggattgaagctgattgccattctctacatatctgattttatattatgattgtattgtggggcatgctactgcagagtttaactgcattgaaatcattatatcatttctctttggctataaagaattttaatttggggctgggcgtggtagctcacacatgtaatctcagcactttgggaggctgaggcaggcagatcacaaggtcaggagttcgagaccagcctggccaacatggtgaaaccccgtctctactaaaaatacaaaaacttaaccgggcatggtggcaggcacctgtagtcccagctactcgggaggctgaggcaggagaattgcttgaacccgggaggcaggggttgcagtgcgctgagatcatgccattgcactccagctctgggtgacagagcaagtttccatctcagaaaaaaaaaaaaagaattttaatttggaagccattcatagtggttgtagtttttgctcagaccatgttgtgacacacagtgtattggcttttcagatgacattaacccagccacctgctcatcttggtcctgctcagttaacctgcacatctgtatttttgtctttaaagtctttattatcaacctcactccccagctataaaagctgtttgtcccccaaacaagttgaaaagaaagtgcagaataatcagagtgtatctagaatgaataaaaaatgagaatcccatgacatccaagatgggatacagtcttgattggacatacagacagacatggtgacagaaaactcagaagccgggagggtcagagcgatggagcttactagaacacaagttcattttctcaaatgtgagtgttttgccctctctgattggcatgccttttttccttcctcaattgtggggcactgtcctctaaccacagatgacttctttacaccgcacggttgcagatagcacagtttcaaggagggtgtgcttggatctggtagaggtcatggacgaagtgaagacaaaagtgaagtcttggtggtactggttcacgcaaggaatcaaacagcccaatgagtcagagatctgctaagtatatggaagccttcatgacttaaaatatccaactgccacgagagaagttccagaacagaggagcctcttccagcatggacccagcagctacaggagggctcagattgcttgctctgccacgcctctgccatctgccccctgctgaagtcaggccagggaagaggtgctgcccatgagtcagccattctcaactgctgcttctgccttctcactttgccatatttgctccctatctgggatggtacagttccacagaccctgatacacctggggttcagcagacctaattagccttacatgtgtctgctcccaaaatagagagtcatttattccagtttctgtcctgatcagcaaggtgtgacctaggcccatggcccatagccccagactgggagaggagccacattccttctgaacagtttctaaaaaactttcagtcccaaatgagtgactttagaagtggagttttgaggatggagctgagcacgtggatttcacatcttctcctcttttcagtatagctctcaagccccctggatgcaaaggcaggaccctgatgaacttgccttttctatgacagtctttacactacaagaaaggggctgcaggacaatcccagctcccaaagacccagcccagagctcaggaaagccaggctgcttctcaccaaaactgaaaaccaggacaccttgggaacactcaggaccccactcaggcaccagctccttccggcagctcttccttaccctgctgaagtgctgaccatccctgcccttgactcactcccattgcagtgccaactcagagcatctatccccaaagccagagtttctgggattcagatcttggaggtgtcacccattccctatgtgactctgtgggagctacttagttaatctgcaccctaatgtcctcatccatcaaatgtcgatgatgacagcacccatctcacagacttgggtaaggctcagaagagctaatataaagaaaatgcttagaacgtggactagaatagtaagcactcaacatacttcccatgctgttgttggcgccgctgctcccacttgtcagataccatgtgagaccaggagccccttgaaggtgggaaactttttctgtttacttctatggtcccagcacccagcacagagcatggtgcagaaaaggctcaaaatgttttatgagtgaatgaataaagcgaatccagttggcaatgctggactatatacagcttgacttggtgatggttaccttacagactcctcccctgcaatgttctgaaagagggcagaatgtcaacgggcaggcacactggccagagagaaactgagcaatgtgagaatggccaggggagactgggcattacagcaaaaaagactggcattgaagctcaccaactgggttgtcttgagcacatccatttcctcttgggcttcagtctggccatctgtgtgtctaaacaaaggcaggaactactagaaagatggggtatcatttcagcaagaacaggtggagaggtgaaacatgactcatctttctccacctgccccaggggactcccc[450 bp omitted]ctctgagtaaacaatccaatgatgctacccacaaaggccgcagatccaagcttaggaggcatcttcccgtcaatgccctgggggcccctgttgccaagtgacatgtgtctgtgattgcagaaggccctattctcccagaatctaggggaggaagggggactttatgcagctggaaaaggcaaattctaacagtcctttgtgattttagacatggtatttaatctcttttgaaatgccaaataatattaaaagagggcatgctgcttttatgatttttcaggaagggtcatggactaataacaggttgcaaacattgcaacattgctgggagggttcttgcccttgctgtaggtacatattgctgttctatttataaccaacatgaaaacaatgtaataatcagaactaagagatgtatacatccctttagcctacctatttttcttggatctggaatattttgggcctcacttgttgatttttagcagcagttgaaaggagctgaccaaatgcacattaacgagacgacattcctgtctctttctgtcttcactgggagacgtcctatttgagccatcctggtttgagatcccagcctcccacccctcaagcatgagacagccacgagaaggccccctgcagccacaaacatttgtcagagtgatttggtgaagttcagcagtgaaagcaatttcttactcggaaaatcatttatcatggatagcctgtcgaaaacaatctcatttcaaacccttcccagggagaaaagaactgacaactggcactaagtaatctacaacagagccatgggagtcattcatctttcctttgcccagcccaggacttgatgctttcagaagagaagtggaatcaatcataactgctctgaggggcttcaggtaaaagaggagggggctaccgggacagccacatactcctgagtgcacaatgggagattgttcagtctctattttactaatagccaaaaaccagaagagtagttgtaggggtctttgagggaggtgtgcctccttcattacaaaacatgttctttttgtacttttagctcatcttaaatgccagaatcctccttcttagggagcaattaaggaaaagcttattgcttttttatataagctgacttcccctttgcctggggcagtcttttctttgccagaccatagcatggagcttgtggcatagtagataatgattctgtgcatgccatttccactgacatcaacaccctggaaacagaatatctagcaatttgaggctcatggagaaaagcagaagagggaaaatttttccccattaagttccctgcttttttaaaaatacaattagttacagataggaaaagcaattgatcactttccttactgaatgtctgattaaacccaggttctggttttgaggttcaccaagccccagaagaagctaatgaatttcagggctccatcattctcatgttttggcattaaccagtgactcagaaggtactgccagatgcaaattatgacatcaatgctatactccctgggaaccaaataaaacagaaccacctttgtagatgggtagctcccaccagttcccagaaatatttatattatggatattagtacttcattagtacttcattattataccaatcttaactcagaaataaatcaccaggtttagcacatatgatgctttaagataaaactgtcctcaaactgctttcatttctctgtcattatcaggggtctgaaatcctgactattttggaaagaagtgttatgctattttgcccaagccaaatgcaggcattaacggtaaagttctgggataaaatgctccatttgaactgaattgttcacataaaatggctaatttctattagccatttgggagtacttctgccacttcccagctgtcactttaagcaagatactttagcctctctgtgccttggtcttctcatctgtaagaagggggtaatactgctacctaccctgtaagatgttatgaggattaaatgaggtgatacttacaagggccacagcgcctgccaaaaagcaagcatttaatttaatttttttttttttttttgagacggagttttgttcttgtcgcccagactggagtgcagtggcgcaatcttggctcactggaacctccacctccagggttcaagtgattctcctgcttcagcctcctgagtagctgggattacaggcacgtgccaccacgcctggctaatttttatatttttcgtagagacggggtttcaccatgttggccaggctggtttcgaactcctgacctcaggtgatccacttgcctcggcctcccaaagtgctgggattacaggcgtgagccaccacacccggcctaatttaaaatatcttttagaaaactctcagccagagatgaattagggggtaagccaaccactcggtttcctggtagccaatctataaagtccccaggagatcactggaaaagtaacaagatggaaaaatgagattttcagggtgagcactcactatacatgatcgagaagagcactataaaaagccaggtgtgaggaggtaaagctcccataaggacaagatcagagataaacaaagagtctctgaactgctaaagaggcttgccagggtccctgagccacctctacaacagttttcttcctcctccgcttccccaacacaaaggttagtttctctgctaaataaatattgaatacttacataacaaatatcaatttgaaggcacataaaattatgagcctgcccaagtgtcttcttggcctaccatgctctgagctaactggggcactgagtgtaaacactctcccggctactgctttgctctttccctccctcattattcaccacattcagtgaacagaaattccagcttgagccacctgtagtcatgtggcattggtccaaagccctcactaccatgggcgccaaccctaaggggaggtatcctcagcactcactacgtgaaaacctactttgcttgggaccaagaaaagaataattcagcatgaatacgacatcactggaacttgttagtgttatttgaaagatgtggctgaagttttacatagggaatgtgtgcttccatcacaagtaacacagtgtatacaaaactaacaaagcagtttgtggccaagaggtttttgttttctaggatgaataagaagtccatgttcttgaaggaacttgaggaacaatgactacttcaagtccaccctgaaatatggacacgatggaaaagcaaaggtgggtcatccacctgggaatctctagttcaatggttagctcagtaaatcttcccaatttaccatgcagatccatctcccttaaccccataaactgggctaaagaataaacatattgcaatttgggtattaatttaatcaggcatgattttgcagagaagcccatggcaaaaaaaaaaaaaaaaaaaactttctataatgaggtccaataccaaaaatagtagtaacaataatttaaaagcagattgtttaaaatccatctcttcctctctgtttctatccataattgaggaggaagagcatttgttcagcctactgtctgccaggcatgtgccaggagcttcactcatctcttcaccccagtatattattgctgttgtatggatggagaaaccaagatttgcagagattatcacctgcccaaggctaccttcctgggaagagggagatctggatttgaaccccacctcggtctgagtccaaagcctgtgctcttcccacattgtgctgctggccatccctgaagctgccgctgtaggtggagcatactccctgagacgaaccaagggagtagtggctatatatatatatatatgtacacacacacaaagcaaacaaacaaaaacaaaataagttggcgaggatgtggacaaattgcaacccccgcatgttgttggtggaaatgtaaaatggtacagccattgtggaaaatagtttagtgattcatcaaaaagctaaacattgaattcctaaatgaccctgcaattccactcctatgcatataagaattgaaaacaggaattcaaacagatacttgtgcacaactgtttattggagcattattcacaatagccaaaaggtagaaacaatctacatgttcattgacaaatgaatggataaacaaaatgtgtggcagacataaaatggaatattattcagccatcaaagggaattaagtactgatacgtgctacaacgtggatgaaccttgaaagcattatgtcaatgaaggaagccagacacaaaggtcgcaaatatatgattccatttagatgaaacatctagaagaggtaaatccatagagacagaaagcagatcagtggttgtcagggcctaggaggacagaggaatggggagtgactctgatgagtatggggtttccttttgggtttacagaaatgtcttgactaaatagaagtgatggttgcataacattgtgaaggtacgaatcaccactgtatcgtacacattaaaatggctaatagttacttttatgctctgtgaattttgccaggattaagaaaacaaaagagtggtaaagttagaagatatttcacaagttctctattgcactgcattctttgtggatgaggaaaatgagctgtcagtctgtccagtgcggaattacatagctaaagtttgccggtgaagttggggttagaagtcaaccctctgtcaattaatttatcagagcttgcacccaggctcacactggggctctggaggaaaagaagaacaatattgagagaaataattctttctcaagtgtaactgagagcctcccagttcctgcctctttggctcaaagctcatattcctgggaagtcatcctcccttccactccagggaaaatggcttcctacttttatgtgaaaaggagccacaaagaattcagcatcatgaaacacccttagctctatcaatagagaaatttctgtcttcaagggaagtccacttgatttgcttctgcttgaagtgaagcagataacctcaatcaacatctgattacttctttaatttccagagcttgctcattaccgaagccacactgtctctagagaaggacctagagtaactcagattttaacacacctgggctgacaagttacttagcttgggctttaattgagaaatcagttattttacccattattttgctaacattatcaaaatcctgtgatactcaaggccctgaaatgacattttcctctcctttatcatttgtacatgtgactaggagaaaattatgtgtgatggacatgtcgaagatacataagttcttgaagagattctttcctacttgctctactcactgatccgtttccactgaacaaattgagtatcagcatgagaagtcacaaggcagggggttcattctttcttccctggcttggctttctaaagcgtgtgagttttatattgttgcttttcaagatgtgaagttgtgtgtaaatttgtgtgcatgtatgatgaatatttttccctgctaaaaggtacaatgaaattgatagtgaaactttgcaaaccaactctccgataagcttctagtgtttttcttttttttaggtttgccactaatcctcccagcatttctgcagattgtaactgaagctcagcttttctaggaggaaaatacctgttatggtcaacaacctaagagtcactcttgattcctctccattttcaactaaacagctgctctgtctgtgacgcctccagcatgtgctcacaccccaatggcctcggacctctcccaaggcagcatcctctcagttgagacctaagaaaactgcctcccaaatattttccttgcttttgtctttccctgaactctattctccacatcacagtcattatttgctaatggctttattgagttctagtttctacaccatacaattcacccatttgaggtttaaaattcaatgggacaatcaattttaaaacactttcatcacctcaaaaagaagccctgtagccttcagctatcaacccccaatctccccacaagcaaggagtcagtaatctattctctgactctatatatttgcctattcttgacattttacacaagtgaagtcatatactgtgtgatcttttgtgactagtttcttccacttagcataatgctttcaaggtacacatatgttgtggcatgtttcagttctccattcctttttatagccaaatggtattccactgcataagcacatcacattttgttaatccagtcatctgttgatgggcatttagattgtttcgctgttatgaatgttcaagcgcaagttttgtgtggacatgtattttcatttctgttgggtaaatacctaggagtggaatgtacatgtcatggtagctctgtctttcagtttttcaggaattgccaggctgttttccaaagctacagcaccattctacatcatccccacgagcagccacaagggttgcaatttatccatatccttgtcaacacttgttatgatctgtcttttcaagtatagccatccaaatgggtgtaaagtggtatctcaccatggttttgatttgcatttctctgatgactaaggtgttgaacatcttttcatgtgcttcttgactatttgtatatcttctttagagagagatgtattcataaactgaccatttttaaactgggctgtcatttcactttctttgtaatgtccttccattgaaacacaaatgtttttaattttgatgaggtccaatttatctactttttcttttgttgcttttgtgtttggtatcatatttaagaattcatggctaaatccaatgtcacaaaggtctaccccgtcttctctcctaaaagtttaaatgtttttgctctcacatgtagatctttgatctattttgagttaattgatgtgaagagtccaattttattattttgcatgtgcctatctagttatcccagcaccattttttttttttttttttgagacagggtctcactctgtcacccagactggagtgcagtggcacaatcacaactcactgcagcctccacctctcaggctcaagtgatcctctcatctcagcctctcaagtagctgggttcacaagcgtgtgccaccatacctggctaatgtttaaaaaagaaatttgtagagacagagtctcactatgttgcccacactggacagcatcattaattggaaaaactattctttcctcattaaatggtcttggtattattctcaaaaattagttgactataaaaactggatgtatttctggactctcaattctattccactgatctatatgtccagaatgactgtttaaaagtggaaattgcattattactctttctaaagtaatagcctaatgcccaatacaagtcattctctatcccaaggattcttcacttggggccatatacttccaagaggtccttgtgcagtactcagggagtccatgatttggaccaaaaaaattacatctttatttttattaacctctaattcaaatttggcatttcctttaattatgaatatagcaataaactgtagggagccaaaggcccatgggacatgaccaactcagcattccactggaggctatatgatcaaacagcaaactgtttatcgtgaatgcagaatgtgagcaaactcaggactgcgcatgcctccaggaggtttgctaagggccaggaggtttgctgggctccttaaagttatctactgggaaatctagtgcctattgtttgaagaatgcagtcttgcaagcctgctgtgattcaaactgctggccgacaaccacctgcccctttctcgttatctcttttacctaataaattcggaggaccgaaacagctcagggcccttgtccactagaggcgaggtgcccccaaccccttcttccaaatatactctcttgtctttgacttttattccccagttagccccactttgttcagtccaccagggatcatggcaggttacaagtggcaccccgaacagtgacagaatcaggtgttctacaataaattagaacagtattaatgacacttgtaactttttttagcaacagaaatctcagatatttacatataagattacaattgttacaggtatctcaaagtattacttatattaatcctactttaaaatgatggtggtatattagaattattgctggatcttcataaaaatgccctaatcaagaagcaagcagactttatcataatttgttttttataatctgataactgattttaacataatctattttcttataatccaatgtttttatattatgcctttataaataatatttttctgagaaaggggtcatagtcttcaccagactgccaaagaagtcctcagcacaaaacatttaagaaaccctgctttttccattaccagttttattttcttcccagcacatggcatcaactgaatttatcttatttacttgtcaacttgtttacggtctgtctctttctgatactggaatgtaagtgcttagggcttaaaatagtgtcaggcacataatagccattcaataaatatttattgagttaattacggaatcagcagcaattttctaaacaagagctaaatcattggcttaatgaaaataaagactactgataccaaattagtgacatgtaatccatactgaaaattattttacatttatgccatcatcatcattagatttaataaatgccagcatgtcctatgtgctgtattaagtgcttgatgcacagtatctcattcactattctccatactaacaaccaagaatatcattaaccatacttacagttaagggaactaagcctcagagaggttaatttctcactcaagttcacatagctaacaaatgacagagttgggatttgcaaccaagcctacctgccttcagagtattgatttttaactacaataaaacacttctaagagaggaggaattttcttcctgttcaactgagaaagctaagatcctgtgaagttaagaaatgtggcccagaacgcagagttcagcagagatttccaataaaatgttctttccactgttctccttatgagccacagcaggaaaaccccttagcagaactgggtgctatcaggttgcctcctacgagaagatgaattttggaagaagcataattaatactagcaggcattaactgaagcctgttcttttctttcctggggtccagtctgcttctctaaatattagggcttggcctcattcagggcattaaggacttcattaggctgaaatccaagttaatttgattgcacaattataaactgtccctggctggaggttgtctcatttgccaggttgcaagggggcagcatggctggatgacatgcttttgatccccagcttgaagtttcagtgctttctggctttgacctcatcaagttttacagaaaggaagttaaattggagcagggagacagatattctccttactaaagttgtcacgggcacacagaggaccattcatcaggtctgcaaagaaacaaggcacaggaaaagtcctggtcacccggaggtggcagcaaatgagatctaaccaaaggtccattatgcccaaggtcactcacccacatggcaagcatacatccaggctgacccctttcctctttcctgtgcctcattttccccttactggctaacaggttattcagcccgggtatgcagaggagccaagggaaggaataaatcgcttcgttttcaacagggattttgttgacattagtagaatctggaagcatccacttcatggagtagcattttcctctcctctgctattcatgcaagtgatcaaaggacccacttccagccttcctcaagagaggcctctcctccagccaacaaagtcccttcactgactatttttgtaaagacattaactttgcccaaagagaggcctggccttgtcctgagcttctgggaggcaatgtctaagcccttggagtgtcatgcctgataaaagtgtcttttccaggggtcttgggctggccagatagtaacagtgttattttgggtaggggctgaccatgccagaaagtctaacaatgtcatttatgatggaggctttgggttacatggtatccatccacctccaggggagcaggggactgaggctggccatgagggcagtcattcaagtttacatgatccagtcccagtaaaaactttgaactccgaggcccgggcgaactttctcgattgacagtactccttgcgtgtagtcacacattgatgctgggaggtaacacgatccatgactccacatggaggagataatgaaagcaccatatttggatctttcccagactctggcctatgtactttgtcctttggttgattttaatctgtatcttttccctgtaataaattgtaaccgtgagtataatagccttcagtgagctctgcagtcctatgcattatcgaacctgaaggtgacttggggaacgtgccaaacctgcagttgatgtcagagggaggatggtcttggggactgctcaccccatgcccctcttctgcagcatccaaattctacccatgccttgggacccaactctagcctgccatccttccttaaagttccctggattactgcaaccagcaagtatgctggcttctacactaaaagctagtgtttcttaaacgctttttagcaaattccacagtaagaaacagagtttacgtcacaaatcagtacatttatacagtatacatacgtttatacagtatatatacatttatacagtacatagatctatatatgtaatggaaacaaaagtttcataaaatcaaattgaacttctctagctatatttccatcttgggctgatcaatctcatgttttatttatttatgtatgtacttttagagacaaggtcccactctgtttcccaggctgatctcaaactcttggcctcaagccatactcttgactcagcctcctgagtagctgggattataggtaaaagccaccatgcccagctgtgtcatcttttttaaatgcttgtttttcctttcacaaaccatgaatgagttgagattgcagttttcagaagcacaggtctcgtccattattctgataaccgatctctttactgccttacaatacatcttattttgtttcttaacttcactgtgtttatatctcatctctctcaagacctgattaaaagtttcaaaacagacctcaaaaagaacaataccaataatatctaatactttttttggtcatgttcaagctgggcactgtactaagagcctttccatgcagtgtctaattgtttccacacactactatcaggtaggtattatccactatgacatctctcatcaccactttcaccccatgtgacaaaggaaagacttcatagcttggaaaggttaactggcttgcccaggacagctacaaagtagtagagccaagtaagccaagaaggtctggtctgattccaaaccctggtgttcaccactaggctccttcctccccactttctttttgcaaaattgtttttttaaagacagggtctcactctgtccctcaggctggaacacagtggtgcaaccagggctcacttctgcctcaaactcctgtgctgaagccatgctcccacctcaggctcttgagtagctgagactataggcacataccaccatgaccagctaatctttaaaacattttccagggcctcactacattgcccaggctggtcttgaactcctgggctcaagtgatcctcttacctcatgtgagccaccctgcccagctacattcccacccattttcattccccgccagagctgcccagcagacctttttgccccagagtggaaagggcacagatgacaaatatgaatatacaattctggcccagtgggctcaaagaggagggagttggcaatgtttcctcttcagccagcattcttttcaagcaaagctctgtgaccttctacccgaaggcagcgctctcaggcctgtctgttgcggttcccctcactcatctcaggagagtctccttccagaatgccaggcacccctgcctgcctccccactgcctcgccttccctgcaccaattaaactgtcacagtcggctggcttggaggcaggtgaggtcaggaagaaatctgaaggaagctgggaattcagatgagatgaggcctccttgtgctgaagctcctcttctgttttctgtcaaactggtctgaagactgattggatgagcccatagagatccctggcgactctctacactcacctcttcctctccaatggagggtgagaaatacggccttgtacagaagtggcagcttttgcatctgtttgggtacccagtggtccctagttcctggtgcaacagcagtgggtctcgggtggaatgattttggctggagattgtttgcatcctggaatcattgcctaaagaggaatttgtcctctacaaacaagtgctaacccacaatacacaagagaagcaaatcaaagagctcttaggcttggcctaatagatgcatcttgtcttacctaccccttttagtgttgtctgttattggaggaagaggtaggaagcccagggcctccctcccagagtttccttagcatcacctgtcattgttgagattttgaatgcattgcaggttaagggacacttgatcaagaagggaaaacacagcagagactttcacttagacatgttttgtatgtcatgcagggaaaagttcccagtcaacctctgcttaaccttcgggtttgaagatggccctctggcagtcacctgatcttcatggcagaagaaacaggagtgaatgagcagatgaatccatcttaagagaatagaaatccttagtttgggtttcattgaccaactatagggtacctggcaggcaaaatttttgcagctttcatccaattcccaaatgggtgtttgacccacaaaagaaccaccaccagtctacatggtaatatacatacattgccttctataattttacttgctgtagctgccaaatcttattcatacttcctccaagcataagcacatgcatgcacacagacacagccgccaaatgcaccctccttgtctactcctcagcctcacctcgtacctgataacagattgtactcaaaggcactggaagaccacatggctgcctggagcacctttcaattattaatgctgttctttaaaggccttgccttattatttctactcatgctattatgaagagggcaaactccttaatgcactcctgtgccacttcctcccactgctagaggaaaagcacatgctaggtacagtcatctaatagcatccacgttattttcaccttctctgcacactgtccctgcagttctctctggggcctcaagatcaattgtatctcaaactgggccatgggttcattttctgcattttctggcatggagtgagggtagcgggtgtatggaaattccagctctcaaattacaaggtggcaggtctctgcatgggtgtgatgagcaacatgagataggtatccttgttaaggacaactgcattctagtagattccaccatcagaggtcctggagccctacctactatttcttcctgagagtgtcctgataggtaaaaggtggtgtgagtgtcttccacggggaaaagagactgatgaggcagctctactgaaatggcagttgatattaatagggccatctacttcctactttgaaaatatctgagctataagctcagacgctacctatcactaactgccaaatttccatgaaaaagggtcagtgatgaagttgtagcctagacttgggaccatgtctcaggggaaaagtctaagtatgcctccgattttgttttggaagggacgacaccgtaagaatttcatcagtaaatattaaatacaaagttcagcaaattgtgaactttagggttcatgaaaactaaagccaggatttatccatgtcaacctgtaccttatacctacatatgctagaaactaaatcaagtttcatacaatgtgcccatttagctaagtaagtcagaggatagtttccaataattactaacacttacacacttagtataatcaactcttctttggtcaagttaatatcctggcagaacagacagatttgggcctctcttcttataaaaaaagaatctgacaatttaaggggcatatgttcacttccatttatgtcctggaaaatatgccctgtgacttagcaaccatgttttaaaagctcttgcagttcttaaacaaacagagtgtatgtttatgagcttctaacaacgttattttcagagatgatgtagagttagtgatatgtagctctggggcttacagtaagctgtagatgatttattggtgtggcatacagtatttgcctcgagaaaaatggaaatttaagcagtgtttgaaaatgtgttagatggcaaacgacccggggcaccctgagaccaaaggcttcccatcttagagagagaaggggtcctttttggcagatggaggagcaagggttaagaacgtttcctggcactcagggagcacagccaattcaagaccagaaagagagacagtttagaatagaggctgaaaacaggaggcccaaatctggcctgcagaggtgttttgcttggcctgcaagtactttaagagttttggatttgaggccaatattttaaaattggagattcaacataaaatgcagtattctgtctcctctttgaaacacaggaagatctggccactagagcctgcatttctgcataggaacaatcagctggacctgggaagccacttcaggtgaggcttcagctctcattgcagtcctcaccagatccgcctcactcatttccaatgtctgcccttccctgtccagatgaatttgcaaacatcagatgaaaaaaatgttattttgtactgttgcactctcagcgaacagatctcttaaaccagtaagactcattgtcagataaaagaatggaaaaggcacatgtttttccaaaactcgggagaaaagcaagactattaagttgtcttaaaatttttgttgtatccattgttttgaatgctgggttgctgaagttcctatttcccaaagccaagttatcagacagggcttaaaataaaatgcttattttaattttctcatttgaaacaattagaccacattgaaggggtttagtataaggcatctgtctctgagcatgttttcttatctgtgaaaatttccagaaggatggggctgttggaaagggagaaataaagtcaatttctccagcaggcagtgcaggcacagtgcctgaggccactgtacttatgggacacaaaaaagtctaaattttaacttctttaaaatcagaagaaaataaatataataataaatgacgaataataacaacgaatccaggctgggcacagtggctcacgcctgcaatgccaacactttgggaagctgaggtgggaggactgctagagcacaggagcttaaaaccagtctgggcaacacagtgagacccccccatctctacaataattttttttaattagctgggcatgatggtgcccagctgtagtcccagctactcggaaagctaaggcaggaagattacttgagccctggaggcagaggttgttgtgagccatgattgcaccactgcactccagtctgggaaacagagtgagaccctgtctcaaagaaaaaaaaaaaatttgccagccatggtggtgcattcctgtaatcccaactactcaggagactgagactgaaggatcacttgagccaaagaggtcaaggttacagtgagctatgatcatgtcagtacacttcagcctgggtgacagagtgagaccgtgtctctaaaaataatagtaataataacaacaataataaatccagcctggattatattcattcttataccaatgcagccgcaaaatataatatttaatattcttatggaagaattggctcaacaaagccaacgtacctagagtccatggaaatcacagcacggagctggaggcaaatgctggtcttcaggccaacaaccatgcccacactgtggcctgtttgcgagcagcacaagctcattttactgcagactctcctccccatcatgcccctgtgatgctctgtatgtggcaagttcgtaacaagacccctgcaaagcacgtcgcacactgacctcagtttcaaaaagatggagtggatgccattcagatgcttctggaaatttccaaataaaaatttccaaaagttttaatcatctatcattggacaacaggtattactgccactggatagagtccgcttctctgattattttatgccgtccctgaagcattctcaatccctaatctcagtagctgatttcaaggcaaggttttgcttgactttagcgtatactgaaaatcacaaagcccgagtacaggccataatgagagtcttctcttgtggactcctagagttgagggcagactgagttttctgtctattcaactcaaaatctcccctacagccaaaacatgttatagcatccagctatcttttcaactcctcaaccttcagcacttactgtgtgcaatgctcatattagtcattgatatattgcttagcgatgccttacttgttcttgttttgttatcttatttttcctttatatatggctggacttcctgccccttgtaaaaatatgtataatttaaatgtcttaatggaaaagatctagcattatacataagtactcaaaattccccagtacctagcaaaatgccttatacacagtttgtactcagtggagagctattatctgattggtacctttaaggccacaggtacacagacagctctcagcctcatctctgctactgtgatgagcctggtggccaattcccccatgctcttcttctccacttaatttttaggcaggacataattgtttcctacacacacacacacacacacacacacacacacacacacacagagtctttctctccctctctctcttttctcccaaattctatgaacaaagacatatgcatcaaaaagtcccaagggcattgttgctttgagagttctatttttaagccacaaatgactcatcaccaaccagggtctccccaaagctacatgtgtcaggctgtcaggtcaaaagacaaggggtaaaagacaaggaagagttcacatctcctccagcccatgaaccccatgataaagctgtaaaagctgccaccactccacacaccacaccacacccctaccacagttgtgttaggcacaagcactgcccttgtgtttggattaaactgttctgagctataacatttcgctccagctggctcctatcctgatctctcagcagtctctgaatgcatgtcagcctgtgactatagggaaaggcccagtgccatgtgacagggaggagatgcagccctcttgcggtataaactcaggcttgttgtagaggacagaagtaactagtgggctagtgggtctgaaagggaatgcatttcttcatttgccctgaaacaattattcttttaaaaagaataagagagggctgagagagtgccaggttgtccaaagcattctttttaagttttggagagtggcgagaagggaagaaataattcatcctaattttggaaggcaaagtagatagggatgtatagacatagttatcagatagtgtttccacaggggaaacaagtgagcaattgggcaaaatgtcctcaaaagttatgcataacaaattccaaacaggccaaaacaatgtgttcagctcttcaatgcgttcagccctgtgttacccttccacagtggagctgaactcttaactcttacccatccccaactccatgctgaaacagtacaaaaaagagagggagacagtggggagggagagagagagattagtaggagggtcataaaatcaaggaattcaaggcctctcaccagtgaggatgaaataaactaatcccacgcagccacctggctggatttgatcttttccacctgggattatctttgttctttcccatggccctaaagtttcccccatgataagggcctagaagtccagaattggcataaaaagacaatatatactttgctattcaatgagtaggttatcatgtctttgttcatttctgtatttagtagaaagaacccaggagatcaagtagaaaaggactgggagagaaaagttctatcttccagctccagctctgcccctggctggtcggatgaccttgaggaggtccctcatcctcattcctcaggaaaggatgctgaggctcagagaacagtggcaccagttgggatccaatgcctctttgactctaatactatattctacagttgtcttttgtggcagacctgaaaggttcagctcagtcctcctgtcctttcctagcatagtccctgatttccccaatgaaagccaaagataagcagttcccttaatgcttctagatgccattgcctacgatgcctaggtaccacttgtgcaatgacaaataagcaaggaagacaagatttcctcaccaatgtggaagggagaaggaggaagggtgctaatgctctgaactttgacgtaaatgaaaccaatctgtttgacaaccaaagaacagatcctgtccccaaaatctacctatatggagacaaggacatataaagaagttgactctgttccttggcatactctccacctgtcttctctaccaggctttcactcgattcctgaacaaatggcaatatggaaggtcagatgagctaggaaggctgagttagagttactctcatatcagagcaccaagtgttgctattaaagggtacattctgaagggagacaagacttcccattggagttatttacagcctctttgccctgaaggcatcttctcttccaccatccctgagtgggctcggctcctctaccatctgacattccattctttcaacagctgctggctctcctgttgtgttcccttcacagatgtgcagtgccgttctgaacatcctgcccttgaactttccctacccataattttccaaaccaaagcctggcaataaaaatgtcagtgagggatggagaaaactggggggagtattttaaaaggaaaaaaaaaaacagggaggtgctttgcacacagtgatttgtgttgacttcttcaacaaaggttaaatgcatgccgtgacttctcaaaaaagggcatgaaggcagacagctggagctaattttccagaacactacctagaaaggctgtatttcataaaggaactggttacagagtaggctggtgagcttccttttccatgtcacaggctgcccatctcatcatgctgcaggatggggtacactaaaggggatagtgaaagctggtatacacagtcctttacagtttaaaatgcgctgtcatgaatgggatgggatctgtgctgtcctcacagctctcccaggtgcctgtcttggggctgagcacaggagaggcagtgggtctacacctgtgcctagtcagtttgaacaaggctggagaaggaagccagatactttatgacatttcaaagacctccatcctatgtggctccattctttggggccaaattttcctgaagtccattagtttgataataccaactctctgggcatataaacattgcataacataatgcaaaactataacaaatcaactaattctgtaactctctaaaagagataaaagaatgtatctcatggggaaacagcatttctcatatctatttcagtatgccaaatcacaaggacagattaggtaaggataggaaggccaaagagtctttctacttggaaagacacccctaggtggtggaagctaatgaggaacaatcagctctccttgttttttgttcatttgatcctatctcattgcaaaatgctgccactccactgagataacagagaagctggtctcatcaagccattattaggaagaactgaatcaaggcccaaacagacatcagacagcacctgacccagggcagtgtcttacatggaaggcctgtgataggagcctcctacgtacccacaactgcacacttggttctcagggtgagaaatggagaaagggagaacaaaagagaaaacaagaccagtgcattggcaggatgaggtgatgcaacttcccattcttgcaacatctcattaaaccccatcagttacttacacaatctggaaatttacttcttgacacttagaagagagatggctttagaatgagccatgctggaatctaatcctggctctactgcttactagctacatagcttgggctatgcctgcagcttcagcctcctcatctgtaagtgggaatagtaatacctatcctaagaagttgttaggggaattcaatgaggttgcatgtgctatttttggtaaagtgcctagctctgtagctcacagacagtacataatcagtgaatgttagttccctccaacgacttgccctctcttcccttttgaaacagaatttctaggccaagggatgagagaccaggctatgtgaagacaggggagggagaaactactgggcaactaaaccagttctgctaaagctctggacatccccaatacatcaatggtgccagttttattttcagagactatgaaaacaatctggtcaatttctatcgcaatcttaaagatagttttccttaaccataagcaattttactgcctggaaaatattcagcattatcacatttgaagatgttacaaactaataaatgaatacaaaatgaataaatgggtgagtggatgcaaaagtaacattttaaaagactggggagaggccattttccaatcgtaaccccactgttgccttggcaattgtgcccttggatgagatgctctacaaaatttgtgctgccatttcctgctccttcctaacgtccatatccccaaaacagcagtgctgataccagaagccaagagcaaagactggcaaaatcagcaagtgcccccattgtgtgccagccattttggagcagataaagtcattaaggaaacatttaacaacgtataacctttcagctttactctgcaaacagcaggtagcttccctttcagagacaagagcctgcattgaagtcaccagtgagcaggacttgaccttcattttcagtatacgccacattaaatattcataatccgcgtaaccgtagcataagaagtagcagcgtttaaacatgaatcaaaggaataaatatcttcacacatgtgagtcatcctttcccagaatgcccctggtgaaaatgcaaatacccagagctctgggcctctgtctcttccaactttctcttgaaattctgaaagctacagggactgctgcattatgcaatccatgaatctcgctctcatgctgacactggtgggtctttgttttttttccttatctgttagataagaattgctgttcttgtgtcaaagggaggaaatagacaaggatggaagcagcaatggtgacattagcacccacagggcgtctgcaggcactcttgacttggttgtacaatttctaaaaaatctttgcttcacaaggatcagaatatgtgggaggacagggttggcgttggtgtcgggagacatcagaattaggaactaaagtgacgtgtgacataaattgggcaggagtccttttaaaaagaatgcaaaagaaagggagctttttgtacacaatccacctcgtgtggctaattggagatctttggggagatggtgtgtggagggctcaatgcttgtctgtgcttgttaaggcactaacatgatgtctgaccaaagactcagtccagaggcatcttcctctgcttgggtgtttctagagagtctactgctgggatgataaagcataattttagtaaggtttaacgtaattatctttggttttcaattccaggagctctgaggacaatctgtcttagccagatagtaatcacttgcagctacacaaatgagtcttccctcacaaccaccctaggttcattaagatcagacccaaagaaaacgccctatgctgggatctgtctttgcctaatggccaaaaatgaaaggtgtgcagctgtctttggaagtgacttatccatcacctctggatagtaaaaagagctttaaaaggttaaaaagatcataaaccaccaatgatgacctttctctgagctgtattgctaatggacagaagtaaaataactacctagcctgcttgtccacttgcacaactggagctggcctgcctcgagacatagctggtccagcagacctagggagcctgttttatacattaatcggcattccttgcacttttcaaagggctgggtgcagagagcctggaatctcaaacttgtgctacaggatagtcctcagcattctggaggggaggggcagctctggctaaaattcactgagacaagccatttcacgcatgtctgttggtttagattcacttgtgggaaagcctatagactgtcccctgattcatttatttgaagggtgtaaatactagctacaattcatctggagaattctgggtgctttttttccagggtgatgatttagtataacttccacgagaagtttaaagctgtctttccaaaatacccagatggccagccaaaccatgaatgtgtaaaactggtaacagttttgaatgaaagacatggattttaagaatgtacattctactttctcactttctttccatttgcatcttatatgtggatagaacttcatttttttttctcattcactaagctcgattataattttttaataggtttcactgtgttttattcctggaaatctatggacttaccatagagatggctttagagattctacactaattctctcccaaactaaaactgagcttgcttgccgtctttcccaaggaagatggaaaactcccttgtgctgaatccactgattgggcctgccaccggacagaatcttcggatatgctctcagaacaaaatgaagtcatgaaaatgaaaagtttctatataaataaccagaaggtcttcttataaacaaagccttgctatgccaaatcacacagtttagcaacagagaagaaaggctaaagctgggatgaggctacgacagtcctcaggcagaatgggaatagccttgtttctaaccttatgggcatttttgccaggaaaaggtgaggacaggactgaagttccatccttgggatagactatttgcaagttcataaaagaaaccagaatcagagaggactcccagtgccatcttcgccaaggcctagaaggatcacaattaaagccaaaggacattgagatggtgtaggacattaggggaagagggtgcattggggaatttcattccttttcatcttctcacacggaaacagagaacaccaggatctacagaacaaaagactgcctcatagtagactgtaaaaaaagacacaatccaaatccatctaaagagcattttatttctgagaaatacagagggacaaaaggttaaaaaaataaaaaaaataaaaaaacgaaaagggaaggaaggtgctggctgaggcatctggacttctaacccatcaacacactcacctccacattagggttttctttctctgggacatacaagcttcaagcccaaacctctttcctgagtctcagcatggaagttggcagggtctgcaccccacgacatgtaagaacacccctggagagagattggagaaataagaccaggggctttagaggatcttcagttcaatacaaataggatccagaatcattaacagtaaatatttaaaagggggcttaccttcaatgacatgccaatgggagtcttccaaacttaaacaagctcttctctttcttggctcgggagagctgatggagggagcatgtggaatcttgtctcctgacagcgtttaaaggactctccatctgagatgggtgagggcagcccagcctcgcatgtggggtgggctgaaggacctctgataggcttaaacttggctgattcccagagacaggttattaaaggagatatttgctttgttttccctgactgacattttggcctctccacccaaatgcacaaaatccttggccggtgaccagatggctctgagaaattctgagtttagctgtgcatgaaattaccaccatcccaagccacaggaaaggagcactaagctcagaattcaggcacaccagagtctgagccaacaggcacaccaagcaggtttcctagtatcaaagtctagtagccaaccatgccagggatagagtttaaagttcaaaacactcacacagtggacaataaaggcaacaagctcaaggccattgtcaccagagttgccaagttcacgccacaacagaaaatgagttagactccagcttgtttcccagatgccatcaacttcatgatttgcaatagtatagttggaacaaattatttcctcagggttggcacctgcaggaatcagggcagaactggctgcaacattgcagttctagtctgtgccctcttcatccttctgcaaggtctttatcatctgtcacccaggctcactctggagcaccagtccattcggctggcacccaaggagtctgcatgagtgtccactctagaagtcctcaaatggccagggcctccacctctgggggtcatgatgaactcctccatccatctccttaccttcacaagtcaagaagcaccagcgtgcaatgcttcagctgaatacccgattggcaggtgaaaggatagcatcatgctttctaatctgacctccagtaagatcaaagcattggaaacccaattgagaaaaggatcctacaaccatagcaagaatggctcagaccctcatctgtgggaaactgtcaccctcccagaagttgcaaattcccatcaagtcatcttaactacttgacatcttcagtgcaaatacatcattaggaaacagctctttaaaaataagtaatacccagcaagaagacttgacctcatatacctcaccctcctatgccagcagactcaaaatagccttccttctgagaactttctttcccatttagaaaatcagtacagtacagcactagcttcctccaaaatcttctgcactcagaaggtcttgcaaaggttggtgtcaaggtaaataaatggatcaatgtaaaggctcatgattgtttatgaaacgagggcaagaaagtatatttgaatactcactttgatgaatctatgaagtatattacaagtgcaccgatgctgagagcaaagactaagacaacctgtaaaagaagaggagaatgccatcacttaagagttggacctcaggatgtttgggttttttgacacataccgaagcagctttgaaatacggtgcccattgcccttggggacctgcttggaaatctcaccctcatccccagccccccattactgcttcaggtttggctcttcatacagcaatgggcagcaacctcgctccttgccaataggggtcagggtagccttttatgtctcagggcactgggtttttatctgaccctgttatctcgaagtccagcttctctgcaattgtagttgataaacttcagtgggaaaaaagcaggtgaaaatttagggtgatacaatttttaatattatatgtagtctaggatctgcaggaactccaatagaggaatatcaactttaacagcttcattgaggcataatttacataccacaatattcacccatttaaaaagtacaattcatcaatgactttagtaaatctactaagttatgcaatcatcactgtaatccagtttcagaacattttcatcatcccagtaagatccctcatgcctgttaaatcaatcccctttcccatttccaagccccagaccacactaatctactttctgtcactacataagagataccaatttgaagatcacaaatttgctcgtacaaatgtccgtgtgtgtatgtgtggacatacataaagatatattcactgcatgtatgatctatatgattagaacacttctgaaatatttaggaaagtagttccagttcaggaagtcaattaggcaatccattaggccagttatgtgacaatccttgtcctactttacactcttcactcaaaattaatctccatggatggaagacagttttggcatctccttcagtggatacctgtcatgctaaggtccatagaatgaatatgtagcagattaggctgacactgacacttctgtcctcagtacacattctactttctttaatctttcacagaggagactattaatgcaaataaaggatagtcagaaataaagaagatgctttcagccaacaattaagcctgagaataaaaagtaagcaccaccattacacacaatgcctggctgctaggtcaacctttccaggtatgctaataccctgaagagactgcaggctgaagggcattggaagtcagtctcctcagtgtccatctattgacatctctcaggccttggctggtgggtagagaggaatcccaatttatgtaaagactaagcatgatcaagctttgtgtgtgtgtgtgtgtgtgtgtgtgtgtgtgcgggcacgtgtgcctgtgtatgtatgagagacagaatctctctcttttacacccacccacacacacacacactcctgtattttttatgtgtgccaaagtggctgacagaaaatgaaatctgcatgagatactcatttaaagcattgcaaaactgcatggagctcctggggcagaatggtggcttgcacagcccagaaaatgaccattaaaaacaattggacactgtaaaaggaatatgcagtttcatagcaactgataaaatctccatataaagggaggtgctaaaacaatacaccactgaggtttatttcattctgccatttaaaaaaaaaaacaactaaaacatgctccaattgaatgctgcagtctatcagtaattatcacccgcccagcactaatccctcttagctgcctcacctcaacccctcccatcacacatattcattcatatgttcctttcaaaggtacacacaaaaacaagcaaacaaaaacatgagcaggccttcgctttttcctctattatctaaaggaggcagcaaaacaaaaagcttaagattaattttgatctgtgctgctatttctgaggcataagcagttagatcctggccctgacctcattctcaaaaagctgcaaagagaaggggtgtggccagaacccaggagaagggcctcttctccattcataaacagctgatttaagactaatccctgtccatttggctccctgtgtgtgtatctgtgaatgctgagcatctgtcagagctggctatataggcctatgccacccaaagccactgttgcagaaaaggactggaaagaagcccttgcaaatggcatctacatcattctgtaaggaactcaaaatctaagacccctgcaatggcaatgatttcgcagcatccagatggccaatgtagctgatcctaatttgctccagctgcctccacttggagtcagtgatggggactaatgcattccttatttaagcaaatcagccagtgacaggaggaggccaggaatcctgctaccctctgaagatgaaaactcaaatatcagcatctctctgatagggtaagagagggaagaaatccaggagggaaataacctccacagctccctggccctgaagactctgttgaatggacatgcatttgggtccacgtattcagctggaaggcctcctctcaatgagatacaggataggcaaactgccccatgatgtacgatgaaatgctccctggggagatgatctgcctctcagtattaaggtaactgtgcacgtagtcttgaaacttgctaaatgcctctttatcgtgtcaggcttgatcacattgtcagcccagatccaggtgctgcagaaaacacatcaatactttggatgtggccatgaaaatagaatccccatcagagacttgtcttctctaggcccctagcaaagccaccttagaagtgtcagtttagtctctctctttctctatctctctaacaaatccccattgtctgagaactctaagtttgaaaacacaaaatgattacattttagtctgcatggtaatggtattattatagagcaccccaaatagtcacctaagtatttaacatatcctatacataaggcccaagaaaaacagaagatgggaggccacttggagtcatgaaatatactcttttttttttttttttagacagatcctcgttctgtcgcccaggctggagtgcagtggcgcgatctcagttcactgcaacctctgcctcccaggttcaagcaattatcttgcctcagcctcccaagtagctgggactacaggtgcctgccaccatacccggctaattttttgtatttttagtagagagggggtttcaccatgttggccaggctggtctcaaactcctgacctcaagtgaaccacctggctcagcctccccaagtgttgggattacaggcatgagccactgcacctggcaaaatatactcttttttatagagtcattcttctgtagattaatcccatgctattatgcaattagtgataaatcatatagtacaggtttagccaatataaaatgaactattgcctagatggatcattagtaactgggtaaagatagaaaaagtagggcccttatctcaatatcctctcctttcccaaaatgtccttcctttctacatagtaccactactctaatatctcttcacgaagggctgaggccattgggaatccttttgcaagcttctatagtttcagggacaaggaggacagaagcccaagggacatggtaaaatgaggccaaggaaagcacagtaccccagaaagcaaagcatccctgccctacagcagctgagtcatagaataagacaataaccaagcatgtaacaaagcattgtcccacacaagggcttgggggcagcagtgtgatacacagataatttgagcattgcctcttagggcacttctgctagcttgcttgagagcctgtcctggttgctaaacttgccatagtctgagctcaacaaattacctcagccatcttggacagtatgaattgtcaccttctcagatttactgaaaacacccatatactgtgtggagatattgagtactcggtgtgccagattcctaaaaacaaaagcaatttgataaatgtcattggaacaatggtgtttgagtcatctattttcaaaactccaagatcaaacaagacatgtgtttgcacaaaagaatgccaggaacacacatacacggtgtatttttttttaagggcagggtgcagtggctcatgcctgtaatcccagcactttgggaggccatgacaggtggatcacttgaggccaggagttctagaccagcctgtccaacacagtgaaaccctggctctaccaaaaaatgcaaaaattagcagttgtggtggtgcacacctgtagtcccagctacttgggaagttgaaacaggagaatcacttgaaccctggaggcagaggttgcagtgagccaagagtatgccactacactccagcctggacaacgaagtgagactctgtctccaaaaaaagcaaaataaaaaaatataaaagtgggctgggcatggtggctcacacctgtaatcccagcactttgggaggccgaggtggggggatcacgaggtcaggagttcgagaccagcctggccaatatggtgaaaccctgtctctactaaaaatataaaaagttagccaggcatggtggcgctcacctgtattcccagctactcaggaggatgaggcagaagaatctcttgaacttgggaggcagaggttgcagttagccgagatggtgccattgcactccagcctgggcaacagagtgagactccatctcaaaaaaaaaaaaaaaaaaatctgtccctaacacctgatgcaaagaaggagcctggtgcaaaatggggaggagagaggggaagtccatagccatctcgctagatgaaaatcccggtggaccatgaagatctttcaaatgtctgacaaggttcatgaaagttcatgaaaatggacaatagcacagccaagcatagactattccccctcaggtgatggagcacttcaggaaaaaggcagattcagtgatgtgagtatagaggtgattgagttgggaaagctggctcttagaaatatttcctgttctagaacctggactggagttgctgcaattaggcccatatgctttcagcgggtgtgtgaggcttcacggccttgggaggcagattcagagccaaggctcacaaaggtggctaccaccagaatccagtcacctgaggagctttccttccaaagcagagatgccctcatcccaccctagggccagcaaatcatgagctgggggaggggaagtctgggcacctctttttaacaagctcctccagtgaatctgacaatgggagtcactgaattaaagccattaggagaaaccacttagctcaagtcagagattaatctacaaatgtcgccttaacaattagcccattagaacatatgtatgaggcctgcaggcttagagaatcgtgctaggagtactagaaaaagtacagagaggaggatgaattaattctctcctgagcaggttttacacattcttctcagctcacagcagaacaaatgaccctaattaatgattctgcatgtttgatcagggtttatctgcctactgaaggcagagacccttctcagaaaatggacaattttctatatatgatcccaaaggcataggactttttaaattgaagtatataatttacatataataaaatccactatattaaaaaatacactttgggaggccaaggcaggaagattgcttgagctcaggagttcgagaccagcctgggcaacatagagagaccatatctctacaaaaaaaactttaaaaaaattatccaggcatgatagcatgtgcctataatcccagctactccagagggtgagtcaggaggatcgcttgagcctgggaggtggaagctgcagttgagctgtgatcaaaccactacactccaacgtgggtgacaaggcaagaccctgtctcacacacacaaaaaagaaaaaaatagatgtgagaactcccaaggcaaaacaatctggtgacattttgttttttgagagataatatcattccaacatctaaattataatgtttttgtcctggtgaatttattaataacaatgccaacaaacatttattgaacacctatgcacaagggccagagtgagagacagagaaatgcaaaactgaaacagttaagtctggcctggcctttgccctcagggagcatgggatctagaagtttaaattactcaagagtcccttctgaatgtaagaagcgctacacatatcaacagtcatctccaggatataaaggaaggatcagatcaggcagagaagcaacaccaccctcatttcagactcccaaagtggaacggggagagaaagtgagaaatggaaaaccaaggaaaaaggaagaagaatttttgacattccaagtccacctggctgttctaggaaaggacagacaccagtgatatggtttggctgtgtccccacccaaatcttatcttgaactgtcgctctcacaattcccacgtgttgtgggagggacctggtgggaggtaattgaatcatgggggcgggtctttcccatgctgttcctgtgatagtgaataagtctcacaagatcagatggttttataaaggggagtttccctgcacaagctctctctcttccctgccaacatgtaagatgtgacttgctcctccttgccttccgccatgattgttaggcctccccagccacgtggaactgtgagtccattaaacctctttttctttataaattacacagtattgggtatgtctttatcagcagtgtgaaaacggactaatataaccaggcacacaggatgagtgatgtggagaaggaagagcacaggacacagaagacctgggtgtgaatctccactctgcccctataagcaacatgctcttaagcacgtcacctaatctctctgggtctaagtttcccaatctgtgaaataatgagattgaaacagatgattatgagatgggaccttggtaggaactaaaaacttttggcttgaaaaggtagccctcacttatgctaactgtaaaccatgtatacataagtctgattcaacatgctgacaatatgcctgtccctaaatctgtatgcaggagacttgtttcataagatcacaagaataaactccatagacactcagattcatagtttgtgtttccagcagcacaatcaattgctcatgcagaatgtcatcccacaaaactaacacaagacatagaagggccatggatcagctttctcctgagtctgggtctcagctctgccatcactacagaaaattgagtggtggtctgacccatcgcctccctctccttgcctctgtgagctttgaaaagcccatgtttttgcaggctttagccttccagaagctcagactgagtctcagtgttttcctaagggaaaaagaaaatgatttttttctctttactgtttagcaagtatagttgatatgttcttgtcattcctaagtcatgaatggttctcaatagaagaagatataggccaggtgcggtggctcatgcctataatcccaacactttgggaggctgaggcgggtggattacttgagatcaggagctcaagaccagcctggccaatacggtgaaaccccatctctactaaaaatacagaaattagctgggtgtggtggcacacacctgtaatcccagctactcaggaggctgaggcaggagaattgcttgaacccaggaaacggaggtttcagcaagccgagataacgccactgcactgcagcctgggcaacagagcgagactctgtctcaaaaaaatatatatataatatataatcttgccaccaaaaaaggatttttgttatcatacatttaaaaatatctgtaatatttctgcagagccatttaatcatccataggtcccctaaattaccaagctagcactatgaaacatcacatttgacttatggaagcacatgcacaaaaatgctgtaaattgattcactggaaaccaagactccaaacaacggattaagtagagatgtattcaagatgaaagaaaggaagaagaaagaggggctttgtagttggtatttgggattatagcattaaaataaaatgcatgggattgccagataagagtaaaactgatttgttcacatgtaaggaaacctagtaaaaatctctatgattttacaggcattaggatctggtgcttccaaaagtgcaatactatgaagccatactctgtgtgcaatggactgaattcttaggacacacatgtaaatcggagagaatccctccttaaatcacctcaaatgtcctccataacttttggtatgaagaaaaaaaaaatccttgacagagtccacaaggccctgaaagctctggtcttttcctcctctctggctttatttcacatgcttccacatctagactccaggaatctaacttgcagttattctcattctccatttgcctcctcccaccccaaccaccacagagccttcgcacaagcactttcctcctcccagaagcctcacctgctcacatgggatgcccatccttcagaaatcagctctgctgtcacttccctgcccacaggtattctgttttgtgtagcagttagcaaagcagcaattttacatgtctttgtgcaatcattttgatcaattgctctcctctttcctttgctggatggcaagttctatgaaggccgggtgtgtgtccatttttagttatcacgaaattccaagaaagtagcaaagtgtctcaatcagtatttgttaaataaataaatatgtggagaaaaggctggagaattagtttgaagactgagtgtagtggaagcaaaagagaggtgggagaaacatggattaccctcactgagtgagaccctgaagtttataacccggaataaaggtgagatgcagttccaggtaatggcagcatccaggggatccctggtgaaagtggagcaggaagaagagcaccgcggtggtagaggtcgagggtctgagacacacacagggatagcaaggacagtcctgcacacagactcaaaggggatggggggagctgaggttgagaatagaagaggacagggccatccctgaatagggggaggggcctggacttagatgggtgacagcatcaggaaggacagagagaggaaggatttggtcggatggcaggagcctggagaaaacaggtttctacaagaacagaagggcaatgaagggccagagtgtccagcactcctgggttacaaagatggcccggcatggtggctcatgtctgtaatcccagtactttgggaggtggaggcaggtgggtcacctgaggtcaggagttcaagaccagcctgggcaacatggtgaaaacccatctctactaaaagtacaaaaattagttgggcgtggtgctgtgcacctctattcccagctactggggaggctgaggcatgaaaattgcttgaaccccagtggtggaggttgcagtgagctgagatcataccactgtactccagcctgggcaacagagcgagactccatctcaaaaaacaaacaaacaaacaaaaaacaaacaaaaacagaaacagcaacctccagagagaggagtgagggaaacaactatgtctctaggaaaaacagattcaactgaggtggcagatatagggagcattacgtgaagaagcagagaattcagatttgaatcaggactaggaatctgtgaaaacagatgtcataagaaagtgagatggagaggcataaaataatggaaatgccaacgttccaataataagtgaatatatttgtgtgtatttgtatgcacacaaacacgctgcaaggggcacagagacaaactgtgattcctctaatcagaaagaccgggtctctgtcagtatttattaaccacctgggggtctctatcagtatttattaaccacctgcatgccccccagcagtttgtctctgtccattttcaaatcaggtcacttcaaagtgactataaatacatacgaaaccctgggaaacaacagggttccctcttactataagtttactataaatcatgcatccatcagtatatagacaaagttaactgcaatcatggacttttttttgagagggcagaagaaaacttgactcatgcagatagacacagtgtctgaattctcattttttaatgctccccaaagaagaatctgggacatgattactacaagccaattgcccaatctcttcccttctgaggcctgtgacataactatagggccagagttatgtgaacttctgcaggttcgtgttccccaaacatcgcaggagtgttgtcctacatcctggattttgttgatgatgttcatctcattttgcccaaattaaaaatacagaaaagttcaatatattcctcctagggcttaatttattataactgaaatgagggaaagcagttgtaacaggaagtcagaaaactttccctaaaacctgtgtccttcctgcaagccgaggtttaatgacactgaaatcttacatcattgcatcataaaacttaaaaggttgctttttgcataattttaccaatgacattaaaaccgatgcactggcaagcatgataaaatcttccatttgaggtctaaagttggaagacctttcctgtccaagtattgaaaaacctaggggaaaaagttccatctgctggtggagcgctcaagtttgcagctaatgagctttttaagaaattgtctgacttaagtgcatgtgggtttggccaactggatttttaatttaattaggtttatgagatgagaaatcttctgtagcgtagtcaggtcagaagttgccactcactgtcaccaaggactaaatttgtggctatctttgccctacttctcaaaccctgccagttgttaaattacattaaaggcaaaactggaatttaaagctgggactcaaacaaatacttatatgcccatgtttgttgcagccaaaaggtagaagcaacccaaagtgtccatggacagatgaatggataaacaagatgagatctctccatacaatggaatactattcagtgttaataaagaaggaaattctggtccatactacgacgtgaatgacccttgaagacattatgctaagtgaaataagctatacataaaaggacaaatattgtgtgaatctacctaaaggaggtaactagagtagtcacattcattgagacaggaagtagaatgatggttccttggaagtgggagagagggagaagtggggaattattgtttaatgggtacagagtttctgttttgtaagatgaaaacagttctggatatggatggtgatatggtttggatgtcttccctcctccaaatatcctgttgaaacatgacccccagtgttggaggtgaggcctgatgggaggcgttttggtcatgggggtggatccctcatgaatggcttggtgtccttccagtggtaatgagttagtgagagatatgattgtttaaaagagtctgggacctctgcacttctttcttgtccccttgctcctgctccctctcttgccatgtgatacaccagctctccctttgccttccgccatgattgtaagcttcctgaagtccttaccagaagccaagcagaagtgggtgccatgcttgtacagcctgcagaaccatgaaccaagataaatctcttttctttataaattacccatcttcaggtattcctttatggcaatgcaaataactagtacagatagtgatgatgattgcacaatgtgaatgtactaaaagccactgaattgtacccttacaaatggctgaaatggtaaatcttatgcatattttactgcaatttacaaaatggaaggaaaattctgagaacccacaagtagaattcagaagcatatgtatatttaaaaactcaaacatcataaccctcccacaggaatactgacatctctcaattcaatggcagtgggtatctccaagaaacttgtattacatgcaagtgactcttccctctctagagcattgatcttaccccctaggatgctggaatttctcctttcatttccagaatctatccccatgtagccacagagatgttatgtgtgtcccgcctttcccttgcactgcactctagtctacaaccaatgcccaaagttggctatgatttttttagagaccttattttgtctttcggtaactgtagctaaagtccaagatataattaggaactttaaaagagtgttcccttcatcctataaccactttacaaacactcaacaatttcctctggaagataatgaaacacacagagggcatctggtccctaagactaaacctcaaggtcaagcttggttgtagctcctcagtggcttaatggaacattgaaagcacccctagaaataacataaaattttcatcttctacagcaaggattttggcaccaaggtcttactttgtaaaaggcttatgtaaaaggcttatcagtgcatcccagaaagcaatgccatctaagccctatagtgtcaagggagttggccaaaattgctaaatgaccattcagctgacgatatgacaccaacatcggctgtgcaggtgcatgctcacattcctggcaccaaacatgtcacactccattttctcctctgcagaatcgaatctgaccataacaatggactgggcttgctaagaatgatactagcatgcctctttgttaagactttcagtgggttgaaatccaggtctccaaagagaaagccctaacctgtctacttctgacatctctccttcctgccctcacctcagaaataaatggtatttttgtatttacaattgaattcttacagacaaactacccttcccgaatgaagtagaaagtttcacaagatagcatccctcatgctcaataaattcccactcctacagcctggaaagttggaaggcagagtcagcagcataaacctctgcatgtgtattcgcgcaagtttcgaaagcctggcccacagcccctgattccaccttgcttcctacaatggtctcaccattctccctctcacccagtgaggactgggtgataataatgcctctgtgccccctctagcacaggggacctagagctctggctcactggagataaacagtcagaaaaccacatcctctacatgtgtggggcatttgtttgagggtgggtggatgagaatgtggtcaggtaacccaagctttccttcctccttcagcctcacacttttgcaaacaaaagagaagaaatggagtctgtctgtagaatgtcacttgttatcttctcaaggtcatttttaaaaaggaagatcatgtgtatgatgttcgagtatgcttcatagttcagcagaccaggcacaccaggtacacagtgaaagaattggcaagacaagggccagaaaatgcgtggagatctttcattgcacagttttaagagctttgacatagttatcaggaagaaatcagaattgaggtgggctcccttaagcttactgcatggtttttccatgtgtcaaatttatatgtgaggagaaccttcatcctttcagggtttacggtctcttgctgtcataacccgcctgcatatttcagcacagccccagcctgatcaccaatttccatccctcatccactccatcagaagatctttatgtgctagaataaatttctcttaacctcccacaccagcctacaagtcattcattcattcattcagtgcacaaagttgctgagtatccactacaggttcagagttgacctggcaggggacacaaaactgaagaatgccctttttttctggaactggaactggaattttcattctcgggcaaagcaggatgccagaagccagatgatgttcatagcatcaaaagactcttttttttttttcctgagacagggtttcactctattgcccaggctagagtgcagtggcacaatctcatctcactgcaacttctgcctcccaggttcaagtgattctcctgtctcagcctcccaagtacctgggattacaggtgtgcaccaccacgcccagctaagttttgtattttaagtagagacggggtttcaccatgttggccaagctggtctcaaactcctgacctcaaatgatccaaccgccttggtctcccaaagtgctgggattacaggcgtgagccactgcaccctgccagaatgtgcatttctaataagtttcaggtgatgctgatgctgctggttcagagaccacattttgagaattactgcttttaaccttatttataaaagataaaaagtttattctttcaagatattctttttctttgaacatgggtataaaaacattttaaactgtttaggtatgtgccatttggacaaaatctctttaatatatctataaaaatatactttgaaggcttccaaaggggagaaaaccggctggagctctttatcttgaattattgttcaaaatcattttcagagtctagttcattgggctggacaatgccagcaaggtgtttggtttttaattaaagttgaaatatcatctccattgaaaggtacctcatgaatttaaccatgatgccatggctgctaaaaacaaaacaaaacaaaacaaaacaaaaatacataggcttaggctgggtgctgtggctcatgcctataatcccagcactttgggaggccgagatgggcagttcacttgagctcaggagttcaagaccagcctgggcaacatggtgaaatcccatttctataaaaaatacaaaaattagccaggtgcagtggtgggcacctgtaatccctgctattcaggaggctgaggcaagagaatcccttgagcctgggaggcggaggttgcagtgagctgagatagcaccactgcactccaacctgggcaatgagagtgaaaacctgccaaaaaaaaaaaaaatacctcgtaggcttagatttctgaaaacatgcttccacccagaaccataaaacttgtaaaggtgtggctgaggagactttgggttccaaagaaagcattcagaaagcaccacaaatgaaaaataggagttcatcaatatactgtttcctttatcattagaaagaaacagtgctaaaaaagaagaatgtccacatgacttccaaaaacaaaggaacccagggtcatgactctgtctgtttttcccagctatatctaagacttagaggggagagaacagctccctttgtccaggttccacccactgcaagaactttttggcaataatatgacttctcttgtgtgctctgtgccagccaaacttcgtaagaatgctggccagcttggcgcaccctctccagcattacctatgtttgttatttgaagttgccatgctagattttactttaaatgacatttcaagtacacagggtagttgaataggtttaagtcttgttgtttcttttcttttcttctattgaataatcaatccattcaggcacagaaagatcaactcttaggcttccctaattaccctgaatctgctacttcacccaagggacctcttgaaagaccccaaggatgctttaaacaaagcacttcttactctttattgtagtcatgagttttcttctgagtctcttgtctgtgatctcctccttgaggatggaaagggtatcaatcatggctgtggccccaccattcactcattcatttattcaatcaatgtatatttattaaatgactgctgtataccaagctttgtgctaagcctgaatatgcagcagaggaccaaagagccacagcccttgccctcatgaaccttacagtctgaagtagggacagacactcaacaaatgaccccactagtgagtaaaatttgcacatgaattaggaggactctccagagaaggggcaatgagctttgcaggctgtggagtctaggggtgttccatggaaggaggatgagaaggagtgaagaagatgaagactaacattgctctcacagaacccagtgcatctaaagctccttaatgcttcccccatggatgcttgttgagtgactggatggacctaggcagagttttgcactcaatgtgacagactggggaggagctctgtgtggagcaagcgatgaagtcccactgaattcaattgagggaggacccactgtcttcaaaaaggaagaggcatctccattctaaaggtggagcaactgaggcccagagagcttaaatgccctgtataagaggcagagcttagtctcaaatccaggtcggactccctgcctttgttcttttaatccatgactccaaagctccttcctgaattggtgggtataaatcctcctgtctctcagaaacttcttctccactttcccttgtgaaactctgtttcatctcatcagctttccagagttatttggtgaaagagcatccaaggcaggaagatttttcttggatcgctgtgatggctgcaccctccaaaaatgggttcacaaagggtaagcatcggccccactcattttcccaaaccatagcaaccctctctttctctccaagaaaattttaagttgcctgcatcactgtacatattattagcatattttccaatctcatatcagaaaagtcttctaatgagtcccaatctaatgtgacaatcatccaacaatagaatggctgctgcatgtggcactgagctttcagtccctggggacatttaagttgacacaggagatcacctgccaagaataccataaaaggaattccctgttatatcagaatgctgactgatttctgatggcattttaataagccaagaatagacgcttcttgacagtagaccctgccaagtgaatatgcctaaggagactctacttcccagtttgcttgatgtcctggaataattattaagagcacctcctttccactctcacaagtgccctgagtagatgccaaagaatatggtcatccaatttaagttgcacttgggtccttggagagaggcctaatacatcctgacacactggctgccaaacatccaggagaagatggggaagcacagttgagaatctgcagtgctcctgtagccactctaggagagtttctagttctctgtttagtaacctgatataccagcaggcgaacgacaatgtctaaaacctccatagttctgtgcctacacacaggcacacacacactaaaacacacacacacagacactcatgctgttcgcagagtataggagattctccgagagaagccagtagcatttccatgctgctagtggtctgctgatgagtaagtgttgtttttttaaggccttgtctggcattgaacatgattaataaattgctggagatgatggggactgctctactgtgattgagttactggaggcttacaaggatgaaaacagggatctctagatttcagatcaaaagcagtccataaaacacagcccctcaggtcatgggaagtggcatccgcaggcttctcaagatcgcttcccggtgaaaagagtaaaccagcctctgatcccatactgaactctaactcacatggggttcgaatgtgtcatatgctctctgtacctcaagtaataaagcagggagtagtgggagcccatcgcttatggctacttttctcaggaaaacttaagaccatgcaggatgggctggctcaattttgacagagagggtgtctctgcactgctaccttagtgcgcacagtgatttaatgaatacacgcctcagtagtgactgaacaaaagcagtctccaggagacgctgcaccaatgcaaagaaacacaatccaagcatcttgtggcagaagtcccagcagtccccagcctgggaccaaaggaggcctggccaagccttgatataagctgctttcccactgcacaagggcagagtccccaagtgaagaactgccccagttctggctcaaggagttggtggtcactccttgtcttcatttcaggggcttctagaagaccccctttccccgaaaagtattctctatctaagagcctgaaatttcaccattagagattacttcctttcaattttaccttaactctctttcttggacttcttaaaaagcacaaggaataaggagcaaatccatactgagttgttaatgatttcacagggtgatgttgaaatggcagcctactgaatatccacttgggctgtaggttacaagtgcatttccaaatattctgattccaaaggtctgatgaacagcttagaactctgcattttcaacaggcaccctgcacccccatctgctgtaattctgaagcactttgagaaagttcatttcaatgcaccatatcctctcagggaaagataacttcattcagagtttttaaaacctggattgtcaggttacaccccagagcaattacatcagcatctctgtggggaagaccaggtatcagtatttttctgatgtattagaaaaagaaagctccccaagtaattccagtgtgcagtcagggccgtggccacctgaacagccaatgggtgggatcttaatgctaacacagcagagcaaatggaacatgtgactatctccagggatctgggctgcctgggactcaggtctctgcactggcgaagtgggcagctacctggtcttcaatgtccccacttgagtgaccctggaggagtcttcagttgactcagttatggaggagccccatctcccctatacaaacccacacctctccttgaaaccacggtgatagggaggctgccccaagctgtacctctgaggagatacaggtaagtagaggctgggacagagccagacccagacaatgattggccatttgctgccacttggatttcagtagcctgagttgctttggcaggctgttccctggctctgtggggtccctcaagcaagcacagccctctcacctcctgcttttgggcacctctgggaccaggtgcaggatttggccctcaagcattgtgctgggtggatagctgcttcctgccagtggcaatgcaggcctcattccttgtcaaggaacaggcaagggcagaaggcagaagtcacatatggttgagagactctctaactccaactaaatccacaccatttttgagcaaaatgggggttgtgttcatgtatgagttcccaccaatctctatccatgtggcaattccatctgcaaaacccaagaaatagtggtgcatgttggtcccggggaactgggaactggagtgagctcagcaagagcccagaagtccgggagaactggtgcttaggatgatggctcaatgtccacccaaaacacagccgttatttcctctttgttcaagctctctttctttcctttctttcctttctttcttttcttttcttttctctctctctctctttcttttttttttttccagggtcttgctctgttgcccaggctagagtgcggtagtgcaatgtcagctcactgcaacctctgcctcctgggttccagcggttctcatgccacagccactcaagtagctgggactacaggtgcacaccaccacacctagctaattttttttttttttcagtagagttggggtttcactaagtgattggcctgcctcggcctcccaaagtgctgggattacaggcgttgaggcaccgtgcctggcccaagcgctctttttagaggcttgagggtaaacttcatcccagctccctctaatagaaatattcaaagattcaagccacatttgtaattttgaatgtcccagttagccacatttcaaaaaaaagaaacatataatattagtgtgtaaagtgtttcatatttaacccaatatatccagaatatttttacttcaacatgtcattaatattaaaaattcctaatgagatactagaaatacttcatgcacctgacacccccactgaaatataacagtgtttcatgtgttgcaacaattgttgcatcttgtgaaaattagtcctaccaaaacaacaaagtattgtttaacagacaaacattttatattccttcagtttttaggtttatatttttgttaattaaagttaaacacaaattaaaaactcagttcctcagttgcactggctacactgaagtgcccaatgggcacatgttgcaagtgggtaccatactgggcagactgagaatgtttccatcagggtggaaagtccttagatcccttaaataattagaaaaggtcccaactctcattctgctggtccaggctagagacacttagaagtgtcctgagtgacatgggtgctctctcgtctcacaaaaaagaagcacaagagttaagggctagaacagcataactagaacacctcccagagatgtggcctagagcaggtaactctcaaggctcagttcctgcctctgacagaggagccgaagatgagcatctaccacaaagaggtgtaaggattgagtaagttaatatgtttgtaaaacactcaaaacagtgcctggcacatagcaagctctctagaagtaagtgctaaataaatccccagttcaatggctgccagttggttgccagacactctgacatctttcatcccagaatggccttactggaagatgcaaaaaaaatctctcattgtgaacagctcccagccttctggctgccaaaattatacattgattcacctgagccttacctgatgcaaaacaccacaaccccacaccctgggggaaaaaaaaagctcagatactctgaaatgttctagaatgtctgtccctttcctatcctccaaaccatatcttcctgaccctccaaggtgaggacagaatgccatcccttctccaggttatttctccttattcaggtctgagtccaggccagctcctcctacaaggcctttcctgactatcctttctaaagcacgactgagttgtgagcaagcaagtacatgcagttaggtgcacacagcactggcctgtcccctcacactgtttcatttccttcattggcttatcattccctgaaatcacattgttgacttacttcttacttgtctattgcttgcctaacctcaaaagaaaataaattctgtaaggacacagacctggtctgttcagtccttgctgtatctctagcacccaggtgtgagtacctagaacacagtacatgctttatatacaattgttgaatgaatgaatgaataccctccttaaagtataggttcctatttccccttgcttgatattccaaagcactttccatctttcatattttgaaggcagtcaattccataatacttgatacatacagttaactatttttgtgtatatgtcttatctccccaactagacaataagcccctttgatggtatgtcttgaatgtacatccctcctgaggtcctcttgcatcctcaatgaatacttgttgatgaatgactgggaagaataaagcacaaatcttaaattaattttcttggtcacacatactagactatttctacaaataataatttttaaaatgaagtaaatatatatatatatacacatgcatctatatatgtgtattatgtttctcatcctaattaaatgaagctatttttgcaactgttttccagtccaagtgtaaaactgtaaagaataatgctaaatgttagatcattaagttggttttctttaattatatggcagtgtttcaaaaaggctttgagtcacctttaagattccttgccaggggtacagcacactacatttaaaatggcacttatcttagtaaacacatttctattgcaaatgatttgttccaataagcaatcccttggcaaagagctgctatttcttctagaccccctaccaaaacatggacctattataagcgccagagaagagaaagcttaaaaagcttcctttatcagaagttaccaagatacattccctaaagcagaagcatctattcatctacccttttctctgatttcaaaacctatagcacttactttttgtaaatatcttctataaggtagctgtaaataagtcctcaaaacctattgtgaagtaagctatagatgtaaatatacattcatcttttttctctctctcattttctttcctcctgcctctctcttattctccctttgtttctgtttttctaaaacaaaaatcagtaggttggtcacaggcaaatacaagttcaatttctaccagaaagctgagttcttgagtgattaagcatacaaaccaatcatttgaagggaaaaaaaatccagtaaaggctaaattattttctgaagtacttattacattacatgaagagcttattatgataagctattatacttgcaagatgaattgaattcacattcaggcaactcatctattcctagagaaacacagataaaaaattttatagcaacctgaaaaggtttgtggaatggatataaaagagatcaatactataagattttaatgtcaaattgaaacaatagaaaacatggtccaaaacaaggtctcaatttccaataaaaaggaaaagaagagataactggtgagcagaggagaggacagtccttcaggcaggagtggctggggaaggacctggtggaagtgtaattaagctgtaaaggaatcatggatagaatttggagggtggaaagcagtccacctgtaagttcatttattccacgtgtatttgttgatttcttactatatgctgggcaccattcccagcacaggggctatcacagagaacacatgacaaagaccccttattcagatgatattctagtggggaaggcaccacttctagaaattagttatgaaaaagcaggcacccttttatgtttacgtgtacatacatggaaaggaggcattcatgtttttgttttctactgcccttctcttgagcctggaaggttttcctttgtactgatggctagcattcctcttagctttgtggagatttgccttgcaaacaaagagttccctctcttccctcttgccactgtttaccatggggatgcagttaaggatcatgacaagccataaaagatttctcctaactctttcaagtatgactatcctgattatagcctccagatatggccagccagaatcacacactatttataggcttaacccacaggcagaattagtcatgtatcacacatgactaaaatgcaagactctcccagacctagggtcctaaacaaatcccctctccttccctaaaccttccaaagaagggcagtgaggatgcccccacaatgttcttcctacagacatgtttatttaagatctcctccccatcccctaatcaaggaaactacacaactgagctaatcatttaaatgatgctactgagaaacgaagccattttccttgttaaaaatgtgcttgccaccctatccatttatctatttccttggcagtgctcactgttaatttattgcccaataaagcacagacactagcagagctgctgaaccatgcctagtggaagccccactatttcatcccagcaaaggcaactgacaagcccaaagcacaaacacaaacacattggatgccacaaagccgggctggctaaccccgactccatttgtcatcccagagacacagaagggagggcggtttacagccttctggagaatgtaggtgattaataactatcgattgtcagaggaaatggagtaagtttggtcggttagccaactgccatgggttttctttctattggatggtaaacctcactgccgcagaagccatctcatggtgagttttgtggggagagaaactgagaagggaagtgatgaagaccgagatggggcagccttggctggccatggtgtccaccattcgggcagattgcctcctgttgcctcctgcagctaacacacagccatcactcataaagtcccaggcagatgtgtgcttttagtgcaaaaccttggcaatcattatcttgagtgtggaggggcttttcttttcagagtctccttcatgggcaactggatcaaccacacagaaggcagatccttcttatttggacagcttagacctcagagagcctataccaactgaatatttgtgaggtaggatctgaaagcacaaccctgagcttcaggatactctttctgatgtcttgactagctccagtttgcctggaggtttaaaggaaaatgtacccagaaaacctgggctcttactccagtatctgtctaatacaggaggaggaagccttctcaaagccaaaagaacagaacaccaagaggggttccaaagattgggttcaaaaaagtcattgaatgttactttgagaaggaagcaaggtcacctagtcgtaagcctgtattttagaggagaaaactgggacccagagaggaattgacttgtccaacgccctattgtgtgttatggacagaagcaaaattaggaggatgggtgaaaaagaaggaagttccaaaagcccacagggtctgccttccattgccatagtcccaattgttgctcccctagtgagggcacagctggcctaaccactcacaggcaaaagacataagactacaacagaccccacaaaacacatgcacatcatccactcctgcaggaagttgtgagcaggttgccctgctccaccatcactgctcagcaggaggtagagaggtagatgagaggagcacaggacctgagaaccaggagaaaaggatggcaagggaggcccagccccagccaaggcccagcccagttatgtaatccaccctgggaggttatgcccgctgctttccatccacggattttgcaggatgggtcttcactaggaagatgggggaaatgtcccagagggaatcctcaccagccctgtcccatgtcaagttctttatgcctctgaaccttcctcaaacggtgtccccccttccttgcccttgccccacctctccacattcacagggcatcttaattccctaagctgagtcaacatgagtaccacagtcctctccgcttaaccaggctgctgcatctcagagtgagcctcacagacacgcacagaatcagcacctgctgggcattttcatgtaatttgatgatcacctctgtaataagactcctcaggagctgagaccatccttcgtctaccttctagcattgtgtctccattgggccattgaggccatctgctctggaagttcctgcaggggcctgctaacaggtagatgcctaggcctaatccctgacttgcaaactcagaatcttgagccagttcaggaataactgcctagagtgcctcccacagcaaagggcatactgcagacatcaggaaacactcattgatcacagagaggggcttggcgtcaggggacctaattttaaccttgctgtgtggccctgcggaagtcacttaaccctctggtattcaacttcttcacctctaaaataaatgtcagacatttgtggatcatggatgtgaagttaccaacacagatccaggctcagcaggtactcaattcgagatgtctgtattatgcgtgaggtttgttcatacacagattgacccagtaactaccctgaaccagatccccagggagtgggtttctaaaggctggggactgggcctggcttgagaatatactaatcacacaatatatttataatagccaaacacactacataacctatcatattataaatgaataatactataaaatattaatagcaaacaaaatatggtacatattttgtgccaggcactattctaaatattttacttatatttccccatttaatccccacaaaaaatttagaagatagttctattattattatccccactttatagctgaggaaactgaggcccagggctgttaggtaattctcccaatgtcctgtagccagtaaatgacacacagcggggattcttcaaactcccacaccttcctgagatgtcagctggctgtgtggttcatgccttctcttcattgtctctgccctgagatgtgctcagcaagtggtcgttgccttaagagagctttgccttcccagcatggttgggggaagctctccctccttcaagggaggagaagaaggggtgaggagccactaacagggctcacctgcaaagttttcaggaccatacctccaggccaaactctaatgagaaggagcattcctgggcctcagctccctggggttcagacttggccccttaccataaagaggtcaactaatgcaaaatgcagaggctgcaccatgatagcttttccacgatgggtctgggccaggattgagggcactgtccagcaagctgatgcatttttaaaacttccgaatcattgatactacctccccagggaaaggaagacctcagcagtttctccaacacccagtccacatgccaacctgccagagaagctgggacggaccacagcaaaagcaccagcacccaagctctgccacagacaactgactttcagggacatgaatgacctcctcactgaaaatgaccttccccagggggcttattctctgaacttctggaatcaccaatcacttctccatgtaactgactctacatcaaagtcgatgcaacagatcacatttctcaccactcccactgccccaacctggatgcaaagtgtcatggtctttcaccagattattacaataacctcctaagtggtctccctgcttctacacttgaccccaagtaccacaattggagaaggatgatctccaaagctgcctgggaagtctgcagttacgcctttggacatggactgttgggacttttcagtttctaagagttcaaagaaaaaagaatgctagagatgttttctttccatccaaacaactaaaggcttgtatctttccattaatcaataccaagagctgttcatgcagctcaaatccaaaaatgagcatgctgagtttctcaagtctgtcctctgatgatatgtatataatcagcatgctctgttgtagacctttgtgacaatctgtgtcacttagtacaagtttacccaatgtcatttgcatttaagcaaatggaaaagaattttctcagaccctactatgactctggccacctgataggtgctatagaggacaaaacagaaatataaaatatgattctctcctttaaggaatgtattttttctgatggagagacaaaataaatgcccaacagatagacaaacaaccatatcagaccatttaaccatttccatatggttaaatggaaatatcagtaggaaagatattaaacaccttgggaattcagaagcagatgatcagtttggctagaatggctgggaagataatctatcaaaagtaagaaaagtgataaatgtgtgaagtgtaaatgagttgtagtattgcatcccaacaggcaacaaatatttcgtgcactggattgaactgctgctaatactactttcctctctcctgcatttggaaaaaaacaaggtggtctccgaaatccagcctcaacccaggactatggaaatttgtaatggcagtgaagacaaaaaatattttctctgccatatgcggtcaccaaaagcaaagcaaaaattaaagcaaagtatataggatttggtatggtaaaagtgaagaatcacatgacgattcgttaaagaatataacctccacccaaggggacagttgagggatagcaaagtcattaaagcgtcacagctaaaaggaaaaataagtctttcagctactattatccatccctctgctattcagtttcatgaagtgaagctactggagtagacactgtattacatcacaaatttgttacagacattcctgtaaaagtggctttttcctcatagactgaaaatacacctgaagatcccctcatgatgaataggaatagtccattttagatgagtagattttggaagtgtttccacacttttttttgtttttaggtttttggggggtgtgttgttgttggaagctccagcattttcctcttcaccacctgcagcactgggacagcaaagctgaagaatctcattaagcttcgacaagaccaattttttatttttagccagtcttttaagacaatgtgaactctactacatttagaataattattccatcaactatttacttaaacattttagaggaaaggaaagaaactgggagatgtttaaggctttttataacagattgtttcaagggtaaatagaaaaatccaaatgcagctgctgaaaacacgtaagcccatggcagggtgcccacttgctgcagcggaagtgaatggtgagaagagatgaaagatgtggaagacaaatgtacccagggcatccaatcccagcaagcggacaaagggcagattcataacactactttgtggttaactggtaactttcatcagggaacctcaacacactttacaaataacacttattttcctgtctcacagaagcagggagataaatgccaagcccaaacgtcacacagcaagggtgtgatgattttaagaataaaatccagaccttatttcccagttggtggcctaccaggtgtcttgatatggtttggctatatccccacccagatctcatcttgaattgcagctcccacaattcccacatgtcatgggaggaacccaatgggaggtaattaaatcatggggcaggtctttcccatgctgttctcatgataaggaataagtctcatgagatctgatggttttataaggaggggtttccctgcacaagttctttcttgcctgctgccatataagacttgccttttgctttctgtcatgattgtgaggcctccccagccacatggaactgtgagtctgttaaacctctttttctttataaatttcccagtctcagttatatctttatcagcagcaagaaaacagactaacacatgcctcccttcgaacccacagtacatccccaccatttgctctttccataaaccagtttcctttgaaaacttccagatccttcctcctctaatagagaacaccaacataccaaagactacttcagacatgaaagaaatggtgtgcttatcttgaaatctcaagtggaatggtaaaaacttacctaggttcatcaatgcgctagaaacaccacaaattaccaatgcaggggaaaatgaagtatgctgctacaagggatgcattgacagactccagagaacgccactcttggtaagctgattctgaccatatagaagttattttataattctgtaaattgtacataagtgacagcaatgcaaataattcctgtccatggacatgaaaattctgtcctgtccaagagaagttccattgacttctctcctgcctttgtggaaaaaaacagttttgcctctgtttccacattcatttaaatattactgacctgtaagtgtctgttcttttcttttttgtttatgtttgtgtctttgtttcttcaagacagggtcttgctttgttgccctttgttgcccagactggagtgcagtggcacaatcatggctcactgcagcctctacctcctaggctcaagggctcctcccacctcagcctcctgagtagctgggactacagacaggcatcaccatgcctggcttttttttttttttttcaggtataggcagagtcttactatgttgcccaggctggtctcgaattcctgggctcaagtgatcctttcaccttggcatcccaaagtgctgggattacaggtgtgagccaccatgtcctgcctgtcctcaactggttataacatctgcctggtcccctcattgaataggagtagaataaaatctttaacacatattcattttgatatctgaaagtcatgattttcttcttttgtgaaaattaatttttaataccaattcaatctcagaaatgctcaacctcaaagttagaaacacagatgggaacagcaagagatgttagaactcacaagaggactgatggagaaaataggggtgtagatctccgaacacaaattggaaaagattttcttatgagaacaaatccataaatcagaaaatatctgtgattttatcctctatcttcctaccacttcaatcttgttaactcaaatataagacatgttaactggatccaggacctgagccctggcaagtgccacagacaacagcatgctatccaaaggactgcccttaggaagcccttaggaagccttgaatgcattagaaaaaaagtactctcccctctggctgacacagcaccattctggagcctctggcttagcaaaaggggtacaggttgcatttgagtgctttcttgtaccttcttcagctgggcacctttgtgcagtactcaacctatacaactgtacatggtggccatgaatggaaggaccactcatgacccaggacccaaaaccataacagggatatatagctagagaacagctgctgctaagcagggcatgagagaaactgagagggctgtgtccgggctgactttatctagaccactgagatccaatacgattgaggaaaatcactaactctatggcaccctgctccagccatgcctgggaaccggtgactgccttatgatgggatgcccttttcagggagtcaagaagtgcctgactggtaataaaaaggaatgaactactgatacctgctacaacatggaggaaccttacaatcattatgctgcatacaaaaaagccagacataaaggattacatactgtatgagttaatttgtattaaatgctcagaatagaaaaatctatagaaacctaaaaataggttcacacaaagtagattagtggtttcctacagctgcggtggttggggagcggactgaagggatttccccagacactccaatccatgtgtctgggtgttacgataaccatgataataaaagccagggagacctcagtttgggttaacagggaggttaacctcattttcatgctttgtttttcaacccttattactgactggttctgccacgatccttaaaacatgctcttagcaaattttatttttagtaactatcacttagtctttctccccagctttttcccactttcctcccatcccttagatcccatctctcacatctgtatgttttacccaacaggatggaaagagaacaatgtgtgggggcagatttggtacctgtcatggccttgacctctggcatcaggcttcctctccctaaacaccccagccaggctgcactttcctccatgactcaggtgaaccttcctctgtgccaccacgtggactttgcaaattctgtttctcctatctgcaacattctctcccattctcctcccaccagtcttctttcatcatggatgaaggatgactcttattcttcctcctaatctcaagccaagcattcttctcggaagcctttgttgatctttaatcccttggctctcatagcagaatgtgtgcagggcaggtatattagaatttctgtaggttaaactcataaactgtgggactttgttgactaggtgacatcaagggaaacagaggcaggcttcttctgtggaataattgtgcatccttcctgcccttctaggggtcctgactatctccccagcccccagcctcccaggctccaatctgcaacaacaaagagatagaagctctgataagaaacacaggtggctgggcgggtggtgtgctctgtagtcccagctactcacaaggatccccttgagcccaggagttcaaattcagccggggcaacatagcaagaccccatctctaaaacaaacaatcaaaacagaatttctttgctaattacttttgacataaaaaaacaaaagaaagaaacacaagtgattgtagcaccaggacccctgaagctagctgaatatgttcctgcctctggcagagtaaatgttctctacttttgagtcagaccagtgaaggccaaccttcgtcttaggaagaagttgtggtgccaacataagctttggagccaaacagacttagttcaactaccagcctttacctagtttttggtgctcccattgactagtctgcggcaacagatgagttaaaggagatgttgggtgtgtatcctaacacactgcacaggctgtgttgcagaatagtcagtaaatgtccattttctttcttcacatacaccttcttctttctgcaccaataatttaagtaagaactttctattttctcctctaccaatctcagaactgtctagatagaagttaaaaccacctcactctggctcgaggaggagggagaaggaggcagggtttcatttcaagatcagtcagcccattgcagctggctgtcctgcagcttcaggagaaacaccagtggtcccacagctaaccaagatggtgcctgtcaggcacaacagcttgatagggacagccgcattccctgtcagattcttgataaagtacagcacatgccaggaattctgtgggcccttcaggcacttgtgctgttgacacccctatggctcaaaatcagaagctgtctctgaatttgatgaggtggtagagttggatcctttggcattgagggaagaatggcagaacgtgggtgtttacaaacacttctgtccacttatgtatactgcagatacttaatggagtgctcatcctgtgctgggatagaactgagacaaaaaacagatagtagctgctttcagggaacttaacaatgtcagttaatgggggagacaggtatccattcataatcatccccaatgaatgtgaacccaaaatgaaataagggcatggaagaacataacacaattctagaagagctgctcacaaaagatcaaggtgaaaagaagtttctcaagaaagtcgcactggagctggcatctgaagaatgagtaggtgctatttgggtgaaaggcgtgtgctgtgggaaagggatgggaagaagaggagaaagagagaacagcatgtgcaaacagagggaacagcacatgcaaagcccagtggcaagaaagactatggcgtggtgaaaaattgggctaaagacaatatgaccagggctggacactgagggtgagagtgaaatgcagcattggggaagagaaagtcaattcctaattgttcaggaaaggtgactgggtgataggcatgaccagaagaagagaggtttcctatgaaactctgtactggaaatagagctgccacaataggcaacaagaactaaggtacctagaacaaaatgctctgtcattttgttccctgggagagtagagtaaaattcaattgaacagaggttgagacagcctattgataatttaaagaaaaaaaatttaatgggctaggtcatcatacaggcatattaaaatgtaaaacagcagaaccaaatcaaatttctctttgacaggcttgccctggttttataatccctctttcaggggagactctgttgttgttattattattattattattgctcaagatggtgtctctctatgttgcccaggctggagtgcagtggcacgatctcgactcactgcaacctccacctcccaggttcaagcgattctcttgcctcaacctcccaagtagccgggattacaggcacatggcatcacacccagctaatttttgtatttttagtagagatggggtttcaccacattggccaggctggtcgtgaactcctgacctcaggtgatcctcccaccttggcctcccaaagtgctaggattacaggtgtgaaccaccgcgcccaacgagactctgttaagctgaaaatattgagctaaatgccagtgtcattcttctgtaaatatatgtaattgccatttaaagaactctcaaattaaggttataacagctagtgataaacattccttcatttctcacaatattataatagagaagaggaccagcattaacaaactggcttttcctgttctcccgaaacagtcttaagtgatctcatttatcatgaatttctgtaagcattaacagtttgtaaaatgagttaattatgttctttggaggtttaataaaatctaccaagttaagtaatatcccgatgctcttgaaatttacccagaaaactttaaagaaagaaataaatgcattcgactgagcagaacatcatgtatatttttagaaagcatacattatctcacaatacttatgctaaatatgtaagaaaatttctgatagactctaaatcaagtctagttgtaaaaggatctctcctctaaagttttttttttaatcttcgtatcaatgtataaatattggcatctatgcaagccaaatatattccaaatccaaaagctttggcaatccaaactttgagagaaagaataataaaatctaacctttaatgagaaaaagtaggaatttcaagaacatgcatctattttctacaggcagtggtatgagagaaatagaacagacactgaaacaggtgaaaattaagatgttacatagggatggcatatgggactcattaagtttaggatggtgttttgcccttctttaaaatgtgtttttcttttcccccaccataaactcaatttgccccaggtagtaaactgaaatgactggaattttctctgattagatttctctggggctgttactgggtgttaccacatggcataggggtgaggtgccaggctctggagtcaaattgcctgtgctcaaatgctgcctctgccccttactggccatgtatttttggaaaagccagttactatctctaagttccagcttcctcatctttaaaggaagaggtttgttattatgcatacctcatgggttgttcagatgattagatgagatgtgtgaaaagtacttacttagcacagtgcctctgtaaaggacagcgatcagtattcccctggtggaaacagtggccatgtttacaagatgaaggaggaaccagtccttactgcctccctgtgtaatcaaagtagtcattatctcctattgccagggtttccttatctctatcactcatgtcctgtcctgacaacatatttataatgggactctacctacacaattaattgtgtaattttttttctttaaatctcattctttaaagttcaatttttaaattgaactttatttcactaccacaaatggaaagcccatctcacttgctataactagaaggtaattctaaacatacagcaaaaaagaaaacccagatcatttaaacgccacctcgatcttgtcaccccaacaaagactcagagcctgagagcggaggctgattgccaaagtttagagaggtgttaaagacctggtagaacctagggaagacattctctctgtgttaaagagaatgtaaaagaaaacataaccctctcctcattggagtctgtgtcatcctatgctgggtcaggccaccacctaaaattacgccatatgcccctggtaatacccatctctcacgttgttatctagagtgatttccattgtagtttatggagttttatgcataaacagacagtgttctgtgatacctaagaatacttccaaaattcccatggaaggaggctcccaattaattccagtccattcatttttaaaattgctgagtgaggcattagaattcatagaatttgcagacctgtgaattcccctagccagcagcaatcttattagcatatccgtaagtctttgcaaatttgactagggacggtgtgtgtgtgtgtgcggggggggggggggggttccattcttactttatgcatcctcatttatacaccctcctctctcttgaggttgagtttctaagctgatagatcataccttccatctctgtccataaatgcctttgacccaaatatcatgcaagtccaatggtacacatgtcctctaaaacaccctaagtggaaagcattgcctgttgaggattagagtagacatataatcacgtttcatactgagctatggccttcatccaatacaaatgccacattcacttaggaagggtgtgtatacatgggaaacagcaggggaatcaaggacaacttcctgaatcagcctgctcagcaaatccaaactcattcagccacaaacccagttcattcatgcatcagggtttgcactgctctaataagatgaatggaaatgcaaagacaacacttggagggagtcctctccgtgcactgagacccttgtctgaaaatacaagcaactgctgctgcttcacactcaaagagccaaacattttgcatggataattcagaagcagtacgtcactgccccatacacaatcctcatgttaagggagcctgcatcaggaaagcacagactatctacctacacaaagaggtcattgcaaattcctcctctccttcctgttgcattcactttagcaattttattacagaagagactgtctagtccagaagcttgctcagtgatgaaagaagccaatttgggatcctaaatttgactatagagcattcatatggacaactgggaattacctggtttgtgaactaagcaaaagccaaaactctaaacaccttctgagcatctatgaaaaagtatttccaaatcacaagcattcattttttagatgggagttggcatgaggatctcctgcaaagagagagagagaggtttcctggcatgggatggggagtgctgagcaccaagacacatgtgcaagctgaaagcacaccaagtgctcttctctgcatccagcacctcacacacattaactcaaagggctgacaagtccctggatcactcagcaggcaggcagcaaactctcagagcaaacagagttactgctgccttatcttgagctccactattaacacacttgtcatcactaagccaggttgttagtctctggaacaatttgatggaaagggcaaacaccagagaaaaacaagttgacccagatgggctggcagaggggatcaagtggcaataaactccgttatcactcctggttggcaaacaaaaagctctgcctacgcatgcattccagttaactatggacttcccctcatacatgcatggaaggccattatgcagagaaatgggcacagcaaatcacactaaacactgaaactctgctgaagtgactccagtgacttggagttgttgatctaaaaattgcttattcttgccttgacaataaaatcagagtccaagttaataaagatttctagttagcaaagtccccaagagcaaacagtttattcagatcaccagctttctgctttgcagtgtgaagagattaagggtccagggacactcctagttctggttctgcctgtgtacatcactgagcctttgtagacctcagctttattccctgtgagacttagactgatcagcagttctcaatctgaatgtgatgacagagtagcagaggtggccgaatatagaatcctcaaaattaacttacaaccaaaggctggtatctgtcagtagctttacatgtattgactaatttaatcttcacaataaacctgtgaaggaggtactattatcatccctattttaccagtggggtaaccaaggctcagaaaggctgacaacatgcaagggtcacccagccagccaggtgcagaggtgagactaggaatcatgtggtctgtctccagaaatgctgcttttaactactcaactcttcataatctagtgcctctcaataatggttaataatagctatcagtatggccaattgatggcctgattagaggagatctgaggcttgaaataaaaggctactgatactcgcattttaacaagctttttttgagagacaaagaagtggagtttcataacataacctggagtttgcatctcaaaagtgaacaccatccacaaggccaggcaagaagaaaggttggcactggctgaccacacaatgtggttggttccacctcacttagccatggagtctatgattccttggtgctatgagaaagaatgctgcaatctgctcactctcattttgggaggaccaaagccctgcctagcagcaatgacaatcctggccctaacacagctgggagcctcttgacaggcttatctcctccagctccccaggaagtctcccattggctgtcagatcaagatcaccaaacccattctcctaattagctccttggcaggcaaaccacacaggagcagttccctttccaccttgaacccagcagacagtcccactccccagcatcagccagccccaaaggcacagggctcccctaaggcctgcatgccctaagtgtctgagaggaccccatgactacagcacatgtcactaagtccctaacattccaatcatcagcaggcatctgtaactccagccggcgtccctccaggtatgcaaatgccatctgcccttacatgagggaaatggacagcagcggaagttaccaagggcccacaaggtgtcagcatctgggacagaaatgaagttccctccctatcaccaacttctcttttaaagaaccactcaaaccctgccaagcttgtacaagaggagtaaataacaaaatgacacagatgacccataaaggatgtatatttgcttaaatgaaataatagagtacttcacaagtgcctggtccatgtaagacttttgttttgttttgttttaatggctatttcaatataacactaatttaatagatatagtttaaatataagggactgtaaatagagtcttcaaaatagtacatcaaaaatttccttcatgatgaaatagatggcctactatgcttatccagagttattcttgcaaatttctacctgtagatattgttcggcaaataggcaagttcaattgattgttgattttaaataaaagttctaactgagaaaaaaaaagtaagcccataagagaaaccagtttcaaaaggccacatcctgtggattctccttatttgacattcttgaaaagataaagctatggtgatgaaaaacagatccctggctgccaggggttagagatggaaggaggcggttcgatgcggtaaaggcacagttccactgattatagtggtggttacacgcctccatacatttgtgaaaattcatagacctacacaccaaatttttttaaaaagtcaattttattttatgattacctaaaaaataaaaatgtttacaaggcccatgaattgggttgtctctaaaagatgacttttcttcatatttcttccaaattggttcatatttagagcactattgattatctaacaaaattttaaatggaaatagttgcagtggagattaaatgaaataacatattaaactgcttttgaaataaaaagggcatggaggatgtcatagaagtagcggtgcttgcagtaagaagtcagatcagactttacaaccttgttaaatgagggactgaaggcctggggtccccaccactccttcccgtgagccagtgcccttcgtactccactttccttatgtgtgaaaaggggcacctgaggaagggttgtatcttcaagcactttaatcccattacccaattattcacgtgcacagacccataattgggagttagatgttttccttcagtgctcaaaatagagcaagtttgtccctcaaaaccaaaagtactcaggtcatgaatgaaggctgaagaaattctgatctggcgggaaattccactttctgacaaccctgatggtacctctgaaaaaaacaaacacaatgactgcttttgaagggcaggagacagaaagacttaaccagtacttttcaaagggaggaaaattctgtgtcatcgtaagcttgaataaacccagtgctgtgaattgccaaaggagaggttaactgttttgaaagctgtggcatttttctcatcagtgtctcatgaggctggccaggaggggcagttggaaagaaggctcggagatttgatattcaggaagtccaccagacatgcagcattcttgacaagatgcctttcacctaatgtcatattagcaattcagacagaaacccaggaaagttagcacacacatatgccccacgctacacatgagccctcctcccaaaccacagcttcccgtgcctctcttccccatgaatttagtaccagcctccaagggtttctgccttcctttctgcaagtcaattgaagtaacttccagaaatgccttaattacaggccagtatcactgtcattagaggtttaaataaaaagtccccggattctaacctgctgagatttcttgtatgaaatgtacttacggaactttgataaagtaccagtcaactctaacacttaaatgggaaaaactgttgcagctcaaaattcaactctcatgcaaaactccagggatgaggcagcaaaggtaccacctcagcaagaagaaaaaggaagagagaaaaaagaaaaacaggtactccataaattacccacataaatcagtttaggcagactacaattttttttaacacagaaaacgcttaaaggaaaattcacagaaaatccatgattactcctttagcagggcgaaatgtcccaataagaaggagatgtattaatgggtggccaaccacctcttttgctccagtcgccttccgtggagaataatcaacagaaggaaatctaaaaatcaacatagagaggctgcggtgagctgcttcatgggtcctgggatagggggcatctgaactatttcccagcgtctgggggaaaaggagtgaacattttcaagtgcctcatatgtgctggtgctttacttgggctgtttatttcattttttcatgttctttcaaggtgttcttaattctgccttacagaccagtggaggctccagtatgttagataaattccccaggggcaccagttaaggatcactaggaatgcggaattcccctccagctcagctctgccctgaacatcttgatgccaggagtaaattcagggctctgagaagggtcccaaatgttacaaactttaaaattgaactaagggatgaaagtttaaaattgtcttcaaaggaattcctcaagtaacataaccctgcacatataaaagtgtcagcaggctcagattaaagggctcatgaaagagggttatttccagagataagaatccttcatcctcctctgggcagggcagcagagatagaaggcacagccggctgagaccccgccgggcctcaggaagtctccactgttaaacccagcctgcaaagcccttccctcttagggatccactccattagagttgacctgaaagctgactcctttggagtggtgcgttccattaattcatccatccaacaattgcttgctgaggacctagtatgtgtcaagacagctggagatagagcaaggcaccagtcatttcagtgttttcagatgaattccccacctattgcctgctctattcttaatcacaggggcggcccccactatgttttctggcactgttgccaactggatcatactggatttggccagtggaagcactgggcaaagcccagagggcggaaggaagggagaagttggaacctgtccctctcctgtctgttcttcagccatgattaggtctcctccatgataccacctcctctttttgtccttccaggccccagctcctttctcttgtcaacctccgggttgccctacagtgacctacttagccattccactcttctgatgctagggtaatagttccctacattaaatatactctcttgagccactttgttttcctggctgggttctgacctctacaagcattgaatctgactaaccagatccctgccctcttagaacttacattccagtgggcaggaatacaataagcaagtaagcattcaaatacatgaataagaacagttcctgatcatgttaggattatgaaggaaattagcatcgaggtggcaggatttggggatggagagctatatcagctggtaaggggatatctctgctgagatctgaagaacgcaatggatctacctttgaaaggccaggagaagagcatggcaggcagagggaacagtaggtcaaaggtctcccaggaagaactagcttggtgtgcttcaagagcctccagaagccaatgtggccaatgcatctgagcaatgggggatgtgtcaggggccaatgccatgggaaggagtttggaacttacaattgatttcatttacatttaaaaagatcactttggccaatgtatagggaattttcctcattgtttataaagagagacccttaatgcctcaccctgtccaggcatatccccatcttgaaggtctaagagagagctacccctcctaatgagtttgcacaacaagaatgggggggacaaccatagctcctaaagcatggttctgagggagaaacggtggttcccttgatatcagctctaccatgttctgaggccatggtacagaagaggtaaccattcatgtgcatgacagccctgactctaaggggcattgtgggttcctttcttaaccattctggaaggttcctggtgaaaggactgatgcacatccacatagccttgcattccaaggtgatccactggaccgtctagacttttatctctggaccctgggagttgcagacactgtatcagaacctccaaccttccccttggcctgccagaaagctgaaagtttccatgcctctgctttccagctctttctctgctacatcagagagcccctttctcatgtcctcaaagtgacaaatgtatgctgccaagcaaggctgagggaaagaaggaaatagaaatgcagtccccatcatgcattctttcccaaaatgcgactaatctggcatttaggttgtttgctcctttaatcagaatgccattaagaaatctctgccgggtttctgtacacagtttttctctaatgaagcatcaaatctctttcacaaacaatagctgtgtcacatccaagcaccctggccccagccggtgtggctgcagtctctgctaaatgtgctgcctctttcaggtctgttcctcccagaatagcccgccactgcggtactcaaatcaaagtctcgacactgtctagctccagcaacgtggacagacaaaagaaatcagaggttttcaagaagacatagtgctgtgtccctagaatttgacagaatagcttggaatatgatgtttaatgaatagcctttctagtgaacatgtttgtcctggcttcaactctgggcccaggtttgcagtggctcacccaatgggtgtacttatcatccttgacttaacccccaactagtgagctatttcctggagggtggaccttgtcagaggcagaactataatgagatgtccccagagctattagtgaataacatggcagagccctgctgagcatggtgtttgaccaggcccaggtgccatggtctctaagcatatgttcatatatacatcttggaaggcaatgcagcaacaactatcattatttaaggtgcacataacctgggacccaaaaatgccattcataggagtttaccccatagatacactggcacatgtgtgcaaagaccaatgtaagaatgcatttgctgttacattgtttattacagcacaagattagaaacaatgttacaatcagggccaggcacagtgactcacgcctgtaatcccagcactttggaaggctgaggtgggcgggtcatctgaggtcaggagttcgaggccaggcttgccaacatggtgaaaccttgtctctactaaaaatacaaaaactagccaggcctggtgccacacgcctgtaatcccctctacttgggaggctgaagcaggagaatctcttgaacccaggaggtggaggttgcagtcagccgagattgtgccactgcactccagcctggacaacagagcaagactctgtctcaaaaaaaagaaaagaaacaatctattgataaggggctcccaattacatatatttggatacaccaatgcaaagtaaaaatatgttgtagctgtttttaaaggcaggtatataggtctgatgtgaatagatcattaagaaatagtgtgaggccgggtgtggtggctcaggactgtaatcccagcactttgggaagccaaggtgggcagatcacctgaggacaggagttcaagaccagcctggccaacatggtgaaaccctgtctctactaaaaatacaaaaattagccagcaaggtggtgcatgcctataatcccagctactccagaggctgaagcaggagaatcacttgaatcccggaggcagaggttgcagtgagccgagatcatgccactgcactctagcctggacaacaagagtgaaactcggtctcaaaaaaaaaaaagagagtagtgtgaaagtgcaccatcattttttaaatgggaaaattatacatagacacgcatatatgtgtgcacatacgcttgtatgtgcatagattctcactgaaagtgtacactagagattgttaataaacagttttcaggccgggcgcggtggctcacgcctgtaatcccagcactttgggaggccgaggcgggtggatcatgaggtcaggagatcgagaccattctggctaacaaggtgaaaccccgtctctactaaaaatacaaaaaattagccgggcgcggtggcgggcgcctgtagtcccagctactcgggaggctgaggcaggagaatggcgtgaacccgggaggcggagcttgcagtgagccgagattgcgccactgcagtccacagtccggcctgggcgacagagcgagactccgtctcaaaaaaaaaaaaaaaaaaaaaaaaaaaaaacagttttcagctctgggaaggaaaaatggggcattagaaactggggatgaagagatattttaaagtatatgatttcaaacaaattaacttttttttatttttacaagtacatacttaatctctttaaaagtaattttgtaaaagggcaaaatgcagtgctccctgaggctctggtaaataaaccgagaaatcactgactggaagttgtggtagataaaataatgaccctcaaagatgccagtatcttaatcccaagaacccatgaatatgtgaccttacatggcaaaaggggtttgctggtgtgattaagttaaggatcttgaaatggggagattgtccttgattatccaggtgggcccactgtaatcactaggtctttataaaagggaggtagagggtcagaatcagagaagaagatgtgccaacagaagcaaaagtaagaagtgatgtgaggaaggggccatggaccaaaaagtgtaggcagtctctagaggctagaaaaggaaaggaagcagagtcttcccagagccagcctccagtcctgctgacactttgactttagcccagtgagatgatttgggattctgaccccccaaatctgtaagacaataaatttatattgttgcagccactaagtttgtggtaatttgttacagcagcaacagggaactaatatggaggtaaaccttttaaaaccaactaattcatgtgtcagaagggggaccatcagccatgcttacccaagtggaggctcatcacccttgattgatcattctgctggggacaggacagattttccataacactatcagttccaatgaaagctgatgtatgaaaaacatctcccttagttggtctgatggtagcagtctcctggatagaactgccatcccagacccacactggggtgagcttggcagccatctggcctcatcactatgctcttcacagaatgctatctccactctagcatgtgtctgtctcatttatcaagctgatgacatggcggtatgaaaaaaacagatgagaggtcctacctgccgatctgctccaaagagattataaaatctaagaggaatgcctgggtgtgtgggcgggggggcggtgggggaatgtagagaagaacaaagttccttctggagctttgggaaagccgtttgtgagcctggacttcccccagcctttgaatcattaatctggttgtacccaagacatccaacagggtgcagacttgcctcattgctccagaagctgagaccacccccgtaacttgtgaggacggaggtcctaccccctgtgaagaaggctgagacacagagaaaactgagagattaaatttataatcataaccttcctctggcttccagagaactacaaaacaaggacacattcccactgtctcttgtcccaagagtagagccaaaccaaatagcctcaccatacccaacattatgcaacttgaagcccaatcaattggctccacccacatttcatctacaggacattgttgccaaacttcttaggtatcttcaatatgagatttttaaagagctaaagatataacagaaaaagcctcaatggaaattttacggctattttcttttgcggctcagggaacataagcttttatcattttccttcattcaagtaacagctttgccctagctccatggttgtcatgcatggtccatggtgctgctttgatgatttataaccagctgagtcatcatctcactaagtcaaaagagattagtatgtgaacctatttggtaaactgtaaggcactacacacgtctggtggcaaggcttgtaaagctctaaatacacgcataattaatgtgactactccccaagacagatggtataaaggagacgacctctacctatgaaaggaaggggagaagaaaagatcaaaaccacctccttctccagccaagctatgtttgctctcccattcctctccttactcccaagatctaaacatgacaggagtggagaagggaagatgtctttaatttcctggttaatttctcctgcctggattccaagatggagacccaaagggagacctgtgtgataactggccctcaaaggagtgcacacagtagacccaggagcaacagcaaaagttgctgactaaacctggggacagcaattggtatccatccctcaggcatttactttgccttttcctcaccagtcaacttcaaggcccttgaagttgtcaagaaactggcaacctagacatttatatccaaaccagatccaagaattgtatcgtaagaatggaacaataattgaaccttgtgtcccctgctaaaccagagagagcttgtcaacaaaaaggactgagagaagaatcctggggaacgggctaatgagaaaggctacctgaaccttcagaaatacctggggagcttattttatttatttatttattttgagacagaggttcactctcaacgcccaggctggagtgcagtggtgtgatctcggctcactgcaacctccacctcctgggctcaagcgattctcctgcctcagcgtcccgagtagctgggctacaggcattcaccaccacgctcagctaatctttgtacttttagcagagacagggtttcgtcatgttggccaggctcgtctcgaactcctgacctcaggtgatccacccaacttggcctcccaaagtgctgggattacaggtgtgagccaccgtgcccaaacttgcagcttattttaaatggatgtctgggctgcactgcagatctatggtgataaggcaggagggggcaccctaactgaaaaaaaaatctccagatgattccaatacccagctgagtttaggtcctaccacattaggtgacctcccaaaggtcccctcatttgatttccctcccacttccacactgaacaccagcaagtccagagagaaatggccctcggcatccagcagagttctttccagtgcccgccagagtgatggccaccaaaccttcctccagactggctcccattgtgtgcagggcaggcaggacagtctgtaagagatcatcactgtggacaatcggggaaggagctggcctgggcagagactgccctgaacattcatgggacctgcgccccagagcatcagatgggcctctctgctgaaggaataataaatatgtcttttgaacaactgattttgttgttgttgtgtttccacacatatatgttcaccagtgctggtttcatagtagttcagtcgtactgcacaggtgagctagggggctttcttaaaagccagaagactatttaaatttagatttgcatgctgaaatggagcaacttttggcatgtgataaagatggggaaagttgaagaccacaccctgcaacgccctccctgacttactactaccacccatcatctcccattaaaagaaacaaaacaaaacatcattctaatgccagttaaacgttgcatgtattgattaagccttccctcccatctgaaattctccctaaggagtaacattttaaagcttgcagtgagggtcctaaggaggctgctgctttgacagcctgcatgagcagcagaagggaccttgctccctaggccagcatctggatttcccatctggcccacgcctgcagctgcgtaaccctctggcccccctccaacgtgcctcaaaatgttatttcacattttgggtccaaatggacactttctgagaagtcggtgtaacctatcaagctttggaaacaagtttaagttgtttttgtactttccattacccaggttgttctggaacgcagctctaagaggttcagcttgccaccacgtcaaggaatttgagaaaagggaaaaacaaagagggggaaagcctgcacaagaagaccgagggtctggaaatcagaacctggtgttttccaaaggtcctgttcagcctacactccccttttccatttctgccatgctgttggggcaaactggcatgggaagtaggggcttttgtcctaaaggcatagcatcaaggtccccagagctacaaggctctccaattccttctccctggtcccgtatcatcagacaaacccaatagagtgattctctaacatgctgtgctcagaaaggtgaaagaaccaccaggcgtggtagggaggctgtgtccactgttcagcccagtcagtgtggcttctctccctgggctgggctccatcagctcatgctgagcctctgtggcattagaaaaaataatcccttggcctcagggcctgctaagggacttcaagccagatttcattcccattcacttcctaagccaggtaccctgtgcagggcatgagagccagtggacaggacgcccctgcacttgggagattcggtaccctgattaagggaaagccacctccctggctctggggaaggtaagagacctgagaaagcaacagccttggatctcactacattttgtgggctacttctgaaaaccacactttgaattccagtcccatcactgaccagctctggactacctgtgactttgaataagctattcaatctgtgcctcaactccctcccccatacaatggggaggatgttagcatctatctcacaggtagagttgttgtgaggactaggcagagtaatccatataaggcactctatcattatgttgttagatcagtttcaagaagcacattttccaacataaaatgatttgtgaaactgagatcttataatcagtccatatgttaatacatacttaatagagttttctcccaccgcatcctccaaaacagcaggtattaaatcaatggtgcatctttctcatcaacgtatttgagttaagaaaatatggtcttttaattaccatttcatgcatagtaatggctgcaatgttaaagactcacttcttcctgggtaattttgcagcatagtctctaccagcacccctggggatgtaggtgcctaccaagccaccatctcctttcttctccagcccctctggactccttcaggtgctctcaaacctaaactcataaaatccttgccagatccttagggagcatccaacaagtggttctgagcccgagctgctcacagaaatcctagggcactcgctggccccacaggttctgattccattaatggaagtgaggcccgggcatcagcatttttaaaagctccccagatggttgtaacatgcagtggaatcaagaactctggctccagtctgtccccacctccatctgatgcctgaaatcccctcaatccctgcagctaatgagtagctggccagcctcttccaggagaatcaaaacttcactgacttaggttgcagaacaccataataaagcagaggttcttcctcaggcagtgtctttgttgttctgagataaagaaaaagaccttgaaggcaattctaagctgggaaatgagaaaacctgcctcaaatggagtccttcttcccagccatcttaagctcagatacctggaatttatttattttgaactttgtagaaatcttttgacttacaaatgacctaattctctaaactagctatgctgagaatgcaagataacttttatgctggcttgattccataagaaatagtgactcataaggatcatcatcagaaataaatttctcaaaacttttaagtaaatctgtttctaggtaaacttgatggacttttgaaggattatatttcccccttctttttcctcttgcatccataccaagctcttttctttatggcagaccttgtttcctctccatcttctactttcatagatacagtccatcaaatcatacacatgactcatttcaccaaccacgaagattctaccatgcactggagaattagtgagttggcttcaactgcacttcaattgacgccccggaggtgggtaagcatacatttccacatgtatgcagatagaaaaatatctgattgggcactaaatgtttaattctctgagaaattggcaatccagtgagaaagctacgctaggcatcctagatgcttttagatcacagtaatggaagcatctcacaacagcctaatgttttcaacccatcagaaagcagagtcccagagagcctatggggactcaaaacaaacccaactaaagccaggtggagtgacctctcatctcagactccaaggcttgggagtaggaatgggcaaagtggagacaagctgccaaatattaggggtgcgccatgtcctacatgttggatgggccctttacacatgccatctcctttaacttccttctcacagtaagtggggagacagagattagaatcaggctcgcataaggtcacaaagatagtaaacagcagacctaggacttagccctggtccctctgatttccaagcttccttccaccaaatggtggagtaacttgctcccaatccatggatccagacctgggaaaggggctgcttctctgagctccaggagctattggttgagaatcctctcttttttgcatccctgggttgctgcccacccccatactgctccttaagcacttaattaatggtgtcctgtggccagtcctgatgatgcagtttttcttggtcactctgtgggccacagacttgcagctgccaattccccctacaagcattgctcgggtccaggcccactgtaggagacaccctgactactccggtgcagatctcacagctaccatgactgtttgttcagcccccacattctccagggtcccaatttcttgtcccacattcaaaaagaatgaggttatgctgccagccagtgggtgagcaaggtgaaaagttttattaactgatgaaacagctgtcagcagagaggggacgtgagaattgtctaccacccaaagtcaggtagtctctgtgtcccagtgtggctgagtccagggtttttatgggctcagaaaggggatggatactgattggtctgtgagtatgcaaaaaaaggcaacagtgtaaaaaccaattggggaagggtgggtataggtgaagaggtgggggttaatcagaggaaagcatgccaaatgggaagagaggttctcaatccagtctgtggatttatccaagacttgtagcttggctttcagactttaaactggctttggtttgcaggggggggtttcactggggactcacctgtgtttgcctagggatttgtctacctcctgctgtatcactgagttcaaatccccattctaccacttgccagctgtgtagccttgggaaaattactaacctctctggcctcagtttctccatgtttgaggtggaaataataatacctactctgctctgaacactaaatgagctcatttacgatggcatttagaagagtggacagaagtgaatgttccttctcccattattcatattgactccaccagtactgtctcacagggtcactgtatcatggcatccatctttccatgggtacatgtcttgtatagtccttaggggaaggtcttgttcttctctcctctcctcagggtccactcacttatgcattatctcataaaggatactgaagcccattgagggcatttcctaatctgaaggggcctctgatagacttctactacttaagtctcccatcactttcccacccttaaccccattctagaaaaacccataggtaaacagagtatacctgattttctaatacccattgaatattttatatttgtttttatactttgcaatgaagaatgtttcagtaaatttcctaaaggaaacaaaaaactcatagatgatataagtaagccatgtcacccctgggcttcctccaccttccactgtgtactacaggcagcacagtccctcccatgctgtgctctgaccttgcctgaccttgccaccctgagtgtgacctgcagaccagcagcatcagcatacccaggaagtcagttagaaatgtgaattcttgggccacagacttaaagactcagaatttgagcccatggattcttgcttcagggtctgtgctcttcgccaccacactacactgtttctctttatcagcaatgaaattgagaacagactcattgcaagacgctcattgtcagctccgtcctctactgacttcaaaacatcatcagcttttcacattaaatttgtttatcacccgtctcagatactatctttgatatcagaggtaagactggcattgtggacagatgttttcatgccttgacccaaaagggtaacaaacatggatactgcaggccaacacgaaggaattgtgttgatgggccataagaaccacaatgggtcccttaaaccacacctcagctacctgatttcctgcacatagggccagaaatatactaaggggaaaatggtagaagggaaaatgagaacaagaaagaatgagataccctgcaggtgtcttcctctactagggaggcccctgagaaatgactgaatgtttttagcaaaagattagaagaataatattatcttgccatctgttattgcttatagagagccaataagtgtgtcttagagattctgagttccagggatgatcccactcaggttccctgacccactgtgagtcatacctccatagcagaggggcccctaaccccaggatttccatgccttctgcaagctggtcttttagatttcatcagcagtcagtcctgtggccatggaacggggaatgatcgatgacagcccactgaaggaggaccttcttcttgtttgcttggttctggggaatgcatctcctaggcaggagcaacacgtgccataatggtaaaataatttgggaaaaaatggcaaaaaatatttgcttttgccttaaatctaccaaaagtggatcacaggttgaaaactgcctgatcttggtcgttcgaagcccctgagtggctcagtatttgaactcagtgcagccctgagcaaccaattaatatttgcccagtgggcaggattgacttcagttacctaaagatgttactactgctcttctggttgcccagagattcccacaccccgtgtgcagcacagatccagcagagactccttgccaaaggccattgcggtccaagaccccaaagaggaaggctccagaggtgactgctgcttgggaagtcaatatcggacatgagtgctagaaccaaggtaatgcttcccagacttcactatgcccaccagagacctggagagcttgttaaaattttgactgctgggccaagagagctggggctgaacctgagaatctacatttctaacaagtctccaggggatggtggtcgatggaccacactgagaagcaccatgtctgaaaatcttttgagccaaacattttatttcaccaatgaagaatttgggaccagagaggctaactagtatgtccaaaatcacccagcacatcagtgacagggttgggaccaggtgccctgactcctagtttccactgtgttcccactctatcagcttaccttaaaacagcaatcgtcatagtcattttatgaactataactcattttgagtaccaaatgcttttcctatttcctcttctttatctttataatcaccctttgaggttgagggcatgggtctcaacttatagagaaagaaacgaaggttgaaaaaagtaacaacaacaatgaaaattggctctagatcacaagccaaggagtagagctggattctacccagttctctctgaccttgtgctgttcctctttacatctcttcaggttctcagaggggagctctctctaccaaaggtttaatgcaagacccacatagtcacctagcttacggaaaggacaggcctgaagactagggtaaaattaagatgataaaacagtgaacaaatattttaaaactatgtccaggaggaaagctagaggaaagagccctaagccccagctgctccataggctacctgtcattctctttccaaaacctttcaggggtttaagacctagaaccacgtgtctgacaccacagccctgtaaattctgtccccaagagtcctgaggctctgcgcaaacaaaattaatagcctgcaaactctaaatgggtgattacaatctataaagcagcccataaaatgacatcatggggattcatatttattttctcccactgatttccactataaatttgcttggtttatgagtagaaacagtttcttctgctacgtgcctgggcataaagctcacctaaagatggaaacctaaagatgtctggggctcacttcacccccagtggtgctctggtcaatgggacacacagaagaaacctcccaaggaagctctggaaaccccaaagcagccactgcctctacaaacatgccctgagagcctgctgagctgcaggcttctgtgctaggtcttgagcagtagccaacaaaatgggggtggtctctgccctcagggaccttgcaagggtccctgaaagggaaagaggagacagacactaaacagaaaactacatggataacacatgggggttcattagggaatgcaaagggaaagtacagcaagctatgagctgtggaacaggagcagctaacctgatctggtaggggtgatgcccaagaaggatgagtaagtggaggctaagcaaaaggtggggaaagggagaagaggagagacattccaagtagagggatccacatgggtagagcccagctgtttgctgctgttgcagttgagccacatgagtatcaaataaagaatgacaaaaattctgggtcagacaacacatataggatataataagattaggttttcttccaagtgcaatagaaataaatgaagagttttaagaaaagaattaacatgatcagaaaaccatcttagaaagattctaccagccgcagttagaagaatggatttgacagagagggggtgtttaggagggaatgtcagcagatttgtaggacactattgcagttgtctacacaagaagtgatggtggcctgaactaggtaagaataaatgggccacagtgctatctaggaggtaggaccgattagggctgtcagacccagcttacgcaaaaagggcagggcatttaggaggtgcacagtagataatggtgatcactgacctactggcacttgcaaatgctttgaatccaatctcattagccaaggtcaatacctggaagccactcagaagccagtattggtacgaggtcaagtgaccacctcaccagtgcaacatagcacacgcagctcaagtcatccccagaccagttgacactctcaacttgcaaaagaacacatgaggtagaatccctttcctttaatttaacccaagctctactactgcctcagttcaaaggtcatcaattgcaagatcagcagaaggggcatggctccctgaatcccaacaaggctacaagggttttggttttacatagctcatccaaagccagtctcttctggccttcagaaatttctccctcttccaagctccaagggcatttatatcatccctgtacatgcagacacagtccccaacttacaatggctcaacttatgattttttgagtttacaatactccaaaagcaatgggtattcagaagaagctgtacttcaagtacccatacgaccattttgtttcctactttaagtgcaatattcaataaattacatgcaatgttcaacgcttatcacaaaataggtgttgggttagataattttgcccaactatgagctaatgtaagtgttctgagcacatttaaggtttaaggctaggctaagccatgatgttcagtagatggagtctcgttccgtcacccaggctggagtgcagtggcgcgatcttggctcactgcaagctccacctcccaggttcaggccattctcctgcctcagcctcccaagtagctgggactacaggcgcgcaccaccacgcccagctaatttttttgtatttttttagtagagacggggtttcaccgtgttagccaggatggtctcgatctcctgacctcgtgatccaccctcctcggcctcccaaagggctgggattacaggcatgagccactgcacccggcctaaacacatttttaacttatgatattttcaacttatgatgggctatcaggatgtaacaccattgtacgttgagaagcatctcattctaccttgcttagattcaatttggaatcacaacttaggctgccattgttgtctaataattgcatgttcattaacctgttttccaaaaagactttaagccaccttaagataagcacagcatacccagcgacaaggtgctgtagatgagcacctactaaatatcagagaaagaagtgaattgactgggcccagaagagaggaaaatgccagtctggtgatgccagaccaacagagaggagtgagtgggaggacaggctcagcactgaactatctagagttgcccttgagtcctagccaagatggctgtcactccccaggtgcccagagatggtggctttcttgagcaattgatctgaaaataggtcccctaagcagaccttgtcactgaagttcacacactgcccaagctgagtgccatgctgagcatagcccagatgaaatgattgctcatcttgagggcaacatcccagacaaaccagtcccttttatgtctcactcactatggagggaaagcccctgctctcttgccctcaaacattagatgggcttacagaaatgcattcccatttcataatgcctgctgtgattccaggtaattcctctaagtgcactattaaatcccagcagctgttccagataacagcaaagtcgacaattccagctgccgccttgtcaggaaatgaagcaaagcagctgtaagtttcctaacactgagacatgaccaaaatggcagcatgagggatcactcatgtgcaggtttctccaccgccatgcagataatgtgtgtccaccatcacacatacattacctgccctgagtctactctgatgtctgaggctggaggactcaaaactgtgggccatattcccctgagatacccagctacagttatctttgagatcctcatgagaaagaatcccaaattaacactgagcccctacccataaagcatgctcaaggtgctggagaattgcttaaggccacacagctaaaatggccgccaagtcaggatttgaactctgatcctgtgagctccaaagcatcaagcttctctatccttcactgttccctactgctcttaaagccctgtatttcccttacccaaaggagcccggccatctcaacagtattttcgccatctgggccaaccacgtgccggcagagtgcataaataccacttttgtgaccaaaactgtatttcctcggttgatccaacatcagcatctttgcacctgcaactttccttaagaagaatttttccatgatgtgatgacagaatttgcagccagcaaaggggatcatagacatacatgtacacacgagcccacaaccatctacttcaaagcctcccagcctgaagtacgctctccagatgtctctatataccaggtgcttcgaggctggccagcatctccctgacagcagaacaagttagtataaggaatttctatttaaaagccaagttctacaaaagctaagccaagcaaggttctaataaacagtaaaaccgccacgttgtgacacatggcttaaagttggtcactcacctaggtgggtcagaaagacaccaatgcttttcattttccccagcacctcaaccctggttagtgctagggtgggatccctggtgggagactccacccacactgaacctggctggcttcacttttccagactggtgtgttctccaggcaaatatatattttccccctacccacctccctccgtgtgactcagcaagcaagtgctgggtaggaggagtgctggtagggtgggggacgactctgttctcattccaggctcaaggaacagcctcagtcatggacaagaagtataggcagagagtcaggagaccaaggctctagacctgttgttgatgactaagatggcctgggatgagtcccacagcctctctggtctcagttcctcatctataatttgcaggttgaatgatacctgaggctctgtgattgcttgagtcagccaacagctcaatcagccacacagaaacaacctctcctcttctctcttccagcctggataaagcttgtggggcatgagatttatgggtttggtgctgaattgcatcatgtatgaggcagaatttgagttggattttcatgggttgggaggatttgtaaaggcattgaaggcatggggggacatgagtggcataaacaaagaagtggagtcaggaatgtgcttagcgtctttgaaggaaccactagggatgataatttagacagcgtgcactagtacaactaaaccagtctctcaaatattgaaaccttttgtaccggctggtaaacagccaatggccttgacttaggagtgccccctcagctgcccctgctgctgcagtgcctatcccccatcccaaccccatgatccaacaaccaaagggttaatttctgagatctcgatccaaaaggtgcccataccatggtgatcctagtcagcccaaagccacaccacacatctaacaagcattcctgtgtgccagataccatcttaggcacattaacatatgttactttttctccccttcacactaacctcttcagattaaggaactgaggcttggagcagttatgtgacttgttcaaggatgcaataacagtatttgaacaaagaccattaaatccaagtccagagctcacttcttaaaaccccagctgcctctgagcagccttggcccgcagacagacgagctttggaggaaataggaggaatttctccctgctatggagattgttttaagatcatgaattgttagcggaacaagttgtcgtggcagcttatgaaatcaccctcttctgcgatttttataagtaagaggggttagaataggcccagagacagagggagagatgaaatgacctaataaaaccctttccaaccctggaacacttcagccccacatgaacagaaaagtctatttattttcaaagccccattttaactcctgaagtacttaggagacttaaatatgtctgaaggcaaaacaagttccctctttttcctcttttcctaccactccaactcttcattgcagattttcttcctgcaggtctgacaaacaccatttttggccacagctgctgtcagttcaaaagtttggctctggggtctgaagaccaaagtctgtccaaggctgatcaccttctgagaaagactcttaaattctgtgaagagtctccagcagaggagaaattggtttaaaaaagcaagaagaatcaccacaatgcatgcccactccacattaccaagcctgcacaactcatgttaggggatgtctgctgctcctccagctttctcccctggcaaatacagtggtggtccctgagtccccattagggcccaacagcaggaccagtagcagcccctgtcagagaaaccacagccagttggggagagcgaactcatactataggcttgtttccatggcaacagatgctccctcctccctgcttctcggcaccagggaaggacaaggaaacccatgagaagacagtggcaactagggggaggaggaatggcagcaagtcccctttctttgaaacccaggcagctgctgccccacatgttgatggttacagctctcagtgaccttggacaagttatgccccagctctgaactttgtttttatcatttaaaaaaataaataaataaaaaagatcaagagattgagagagagagcaagcgagctgggccagagatgatccaataaagctatttcagctctgatgtcccagaatccaatgatttgtctaacctggccagtgattgggaatgggttcacctcttcttgcagccctctgcaggagcatgacattccgcaaggctggagtggatctgcctctcagggacctaagccttatccattcccccagtcatgctgcctccctcacaatggtctgctgtcatttctctgaaatcatctcaggagatctatcccatgctttcctaagggtgcacgggtttcctggggctcacacaagccatccaacatgacaggtgagccagaatgtcatggcaccgcacccagccacttgcctcccacctcactgatgttgttggattcaacctgcaattcagatgcacacagcccactaggcgctagcctgctatgactgcgcaagcgaaggaactccagggagaacacccagaaaggtcattttgtttggtatgaagagtgctagggtgaggtgaggggcagggagtgggacagaagcttcccaggaaaaggggaaaccatgcacagcagccaggagccatggactccaataccccaaggtttggaaaagtacttgtaattttggctgattgaccaaaagtggaaagaggagtgtagcatgagagaagggaagagaggaaggacagaaaagtggacaaagaattccaggagatggccggccgcggtggctcatgcccgtaatcccagcactttgggaggccaaggcaggcggatcacctgaggtcaggagttcgagaccagcctggccaacatggtgaaaccccatctctactaaagatacaaaaaataactgggaatggtgatgcacatttgtaatcccagctacttgggaggctgagagaggaggactgcttgaacttgggagacggagattgtagtgagctgaaatcgtgacactgcactccagtttgggcaacagagcgagattctgtctcaaaaaataaagaatgccaagaggcataaaaacacggcaatgcttccagggctggatttaggggagaaaagggagtactcattgttggaagtacaagccacatgcccagtgctagcttttatgggagtagcaggggatagctgagggccaggttagtcactgagccctccacatgagcctggtgggggtgtacttgtttccattgtatgcatgaagaagcagcaactcagaactacagcatgatttcacctagtaggtcagctaccccttttctggagtatacaatcttgctgggggacaaaataaacaatcatggacaaattaccacatgatttaaaaattgacacacggccactctcacaaccatcctcagaaatccagaagttcagggaggaacaacaacaaattggacttctgaggacttcctgttgccagtggactttaagaaacgttcagcctctccagcgcaattcacccctaacctatcagactccgcgttggtctgtgatggctcatctctggctcggaaatggttaaacagttcatttctgtgcttgaatcaggagcttccttaaacgctagcataaagctggtctacacataagaaatctgattagctcccagcattgggcaatcccaattattatgccctgcaagttgctctgcaggattagcggtctgcggaagaaaggaatcaatatacaacagtaattagggctcctgatgccggtaagaggagcacttctcttccccttaagccactcacgacagagtccatgaggggacagggccttcacagcactgccagtctctgttttctagcatatgttcattttgactttggtttttatttactgaaggatgtgaaattctctgctactgggccaagactttagggctacatacgtcacccaagaacagcgaacaggatgtgtcatgcatgggaccttccttccaaggaaactcagggaaagcagatgctaggatcctggcaaccccaggaaacctaatcagtgtccctgtaaccaagagctctttgagaacaggggctgtgtcttatttaccttatatcaatgtggcctagcacagtacctggcacatggtaagtaatgaacgggatggatgaggaagtgaatcaatgagtaagtgaattaataacacatggttttcagtttgtcaaaaactttatctgtgagcctgctgtgcacagaattttgtaccctaatactgtagtagcaatttacattggactcacaggatttgggggttaaagggaatttgaatataacccaatctggtatttttaaaatcacaggttgcaacctattagtggaccatgagatcagtttcatgagtcctgaccgtcattttataaatgaaatgagaatggaatgaaatgaagtggagtggagtgggatggaatgagatggaactagcaggaaataatagaatattccagaatagaaactatcaaagtacatcacatgtagtaaaggtgagtacaggaaaattaggcttgtacttgcagggcatgagtgtgtgtctattgggtgtacagtgtcttaaggccaaaagccactgatgaatctaaccattcatccagtgattttcactgccctcagaggccacatcagggacaaataattttcctttttgatcccctcttgttacaggaaatgaatttcatccagaagcagcctgtttcacttacagactgtctggctgcaggaattagggcaaatcagagatgttatagaaagaaaaagaaaatgtttcctagatcaaaacacccatctaagtgctggggccatagagatgagatcgattccattttccacatgacaaacattcaaagattttagaatgtcaattgcgcccctgctgaatggcttggagaagagcaggaatagttctagttatcctaacaattgctcctaagatgttgctttgtacctgctcgttatccatcttgattgtgtttatgtaagttccagcccattcatgacccctggtgtgtggcatgaagaccatcacatttgagtctggtctgaagcttgtctgggtgatggctgaggtgaacccatgttagctcctggtgctcaccaactctcttcctaaaagctctcacattatctgttcaaaagcctgcatccacctagcagggtaatttcatcatccctgccctctcgtctgtgaataaacagcttgaactaatagtatttttcaaatgtttttgaccacaaccctcaggaagaaatgtactttacaacatggttcagaagacaccaccacacccccaacacacacacacacacacacacacacacacacacacacacacacgaagcaatgtttacctttactatatataatgggatgtactatgatgttttattctattctgcttcatttcttatgatgttggtgatgacccattaaatagatttcacaagctactgatggaccatgacccacagtgacactgaactagatagtacctaataatctgaaaaggcagggaagggcatctgggaagaatttcacaccaagcccatttcttttcattatgtttatttagccatgtgcctacgtttggttgtgtgtaaaggaagacaatggcttagtgagctgcagccaggctgttttggggactcacaaaggaatggtcacagtttcctgcctgtctcttattgccccccaggcaagctcattgagaaaagacagtgtgagtctcgtacagagcatgctgataactattacagatacgtgattattctcggttctgttgatgataacaacatagctgccatcttgtgtttgtttcctcttaggattagaaagcaaaagcaatctgaagattgaaagtcagaagcaaagttagaatggtgatttttttcccccaacccaacttggaagaatttgtctttggagaaccaacctaatcaaataaagtagcatcaatttactggagacataatccaacttgcataattgtcctggctggtttacaccacagctgttcatatgacatggttcattaaataataaagtcttcatcaggctctcctgcactgggctgcaattcttttcccccacaccaccaaagaagtgctgcctttattagaatgcagtgccacccattggcagtgggataatcaggggatttgtttttatgtgacattctattaaccaaacatcataaactgcatcaagtaaaagccactgcattttccccagtggaggatcccatcaccacataatcattctagactgtgggttctctgtgggcagggaccacatcccttcatctttatattcccagtgctaagcaaagtactcagcattggtgggcgcaagataaacatctattgaattaagaggaaaatatctccagtgtgggattcagaagagcaatgcttagaaacctggaggctccctggttgcaatgagcatttagtgtcttgaatactgtgtccctttcctttctggtttattaattttccacttgactggaccaaattttccaagtccacgtgatagcagacaggactctcaaaatcccctctggccaacagaaggttcaacaacaccaattttgctgtcttcaagctcaggagccctgctgggcagcagggaacctgtgccaatctcagtcttcctaaagaatcccacagttaaaagaggccacctgaaaatgggctgctgagaggtaacgatgaccttggaaatgtcctcaggtttgggaagtcagcaatttggtttacaaagcatgaaaaggaagactcgttgtaaaatacagaagatttaccagcttaagtagtttagaccaactcaaacttgagcttgagcctgcacgggactctcctggagggattgttcaagcacagagggttggcttcaccctcagagtttctgattcaggaatctgcacctctaagatccaggtaacgctgctcctccaggcaccccactttgagaagcattggtttagcctgcttattacaagcaaggctctagagctggctatctatgctggaaccctgaacccaccacctcagccaataattttaggcaagtcatttaaactttcccatccccaagatgcaagtgtcaaaccaaagcaccaagaggatctttctcacgagattgttatgaaggtcaaaggaggacacccactgcttaggggtgtgcttggtaggtagaaagagcttaattaaagttaaccacataaaggaaagtagggatatggtctgggggaaagactgctggtcagagaagccagatatgcattctagctctagccctgcgaccctgacttgctgtgtgaccctggacaagtgacttctttctgggtcatgccctcattcataaaatggggacactggacattctataatggactgaaggtgccttggcgctagaagcttccaaagctccttgctcctgactctatcacacagcgtcacgtacctgtagtgccttcccaatcaccccctaccacttagactgccaactgccaggccccagcaggataactcaagactgccttgaagacattgtctggttccttggccttgaagggtctttccacttggccacaggtgaccacctgactcaccgaatgtagtctaaggaacccacttccacctgggaagtgcaacctgggatccttcttgctgaaaccctattgcactccaccaagattttgttcacgtttcatttgtagccagctccactcatgcctctcattgatattcttttgtggttacattccagactggaagataagggaattcattgaagtgtttagaagggacaagtgtggtttcatcgggagtgttatgctcagatgagtattggaggattagttggggagagaatccacactcgcagagggagatgaggttctgaaatttattatcatagcctggttgtggggaagggagcctcaggaggagggttggaagcccaaattcctaattgaagatgcgaagcccattttcatcttatatttttattagccccatagcagcccactgcactggctttctgctaacagccgatggcagggagaggatgcttgttggcacaaggccgctgtacatttcatttttgtcagatgctggcaaaatttcctcatcagggaagataaattcgaggtgatattaataaacctctgaatgcagcaatcagatctggctggcactcttaatgattccaccagcagtgagccatttccagcctgaggagcttagagattcacggttttgtttaaggcatcccaaaaactagaaattgtttgcttgactcctgggttgagcccgcatcttcaacctggatactcccaggtgccccaagtgaggcagtagtgatggaagagaggcatttacaaaataaagtcttgggtaaatgttactcactattgttttgtacccagaaagtgctaagtgtctcatactatctcgtgtaattaccataggctcagtgatggaggtactatttttaggtgaggtcactccaacttagaaaggttatcattaacaatattggcatcatcatattgcaatattgactgacactaagtgctttctatgtgactgagcttaggattttacctgcattttcacttttcatttgcacaacaagttatcaattaagcactgtgatcgccaatttacagagttgaaaatagaggcttagagaggttaaacgtgaggctcaagatcagactcaagatgcatagccagtgatggaatccatgtgtgttggattctgaagctcatgccgccatggactgtgcttgttacggctcacaccaccatggactctactgtggaggcacaaccagagggccccatgggtctccacttgtagaaggcggttcacctatcatcctaccttctagtatgaaagcagcttgcactcataggcaagcttacagaagggtgcagccccagctcttgacatagaaccaagcacctggtaggcaccctttcaatgtttgataaataaatgaattgatggtcagtccctactcacgtcctagaagatttgtgaaaggacagttgaaattagtctcctatgctgctgtccacctcttggtatcttggtggacctattcaccaagggccaaatgtccctaagcacaggtgagaagagttgaggaaggtttttgtatcctactctgagagcagttggagacttcgttccttggcttagaagtcaagattggatgcagaactaggcaagttgcttttctgagcaaagagagtgctggcccaccccacatcctcccctggctgctggcccgctgcaagccttggcacacaagagaaggaggcagaagtgcatttgtttattcattcacccacaaacatgcctcaagcaattgagcacctactgaggccagagtagttttgggctctgcggagaacatacatataaataagaaaccatccttgaccttgaggaatttataagctaggaggaaaaataacaggtacattaactcaggtgtcagctgtctctggcttctccagtgcctaggcccatgtatacagcatcttgttttgccctgaataactttcatcctgaaggttacacttttttgagcttctccctcttgtccctcatcccaccccatcaccaccccatgccattgctccagatacaagcaaaaaggaacaacacagactgttgaagatttcacaggtaaggcagaaaaggaatttaaatcacatatctcatggcaaatgctctaacagattttgagtttgccttagttccttccaggccaaagcacaaccaaggatttccttccctgaccttttcccacagagttccttgaggtagaaaggtggctccaagaagcccaagtccttcactcgccctccaaaagcctcaccttttcactagagcagtcttcaccccttgtagatgtcattaaggatattcacaaatactcctattacgtcctctttctgggcaattgtaggattgcactttctagtttcctaaagttaagtgtggctgagtgctgagtggtttgctctagccaatgtaacatgagccacatgatgcgtgacacttctggatggaagctcttagccagagcagttcaccactgcctcctgccaagacggtgctggaagcaaagaccaagaggaagtttccatcaatctggtttgctgagtgactctgatgaacagcctccaccctcctactggcctcctaccttcatgactgatatatactgtattgagcaagaaataaacctttcttgtgttatgccactgtgggggctgtctgttactgtagcagagcatggcctcacttgactgatactgccctcttcgaagcagaacaattctgctttgctctgacctacagtcagactttcacactaaaccaaggtgggcactcaccaaacaaaagattctccaggtaacacaatctacactctgtggatggaaagttatggcatcttttgatggtggagcattttccttgaggtcttaccccttactccatgagactcatcaacatattttttctaaacaaaatggtggagaagaattctggggaaagaattctggggaaagagtgtctggcacaaaagaaatatgctctgggaagtgcatgaaaaaggtaagtgtcaaaacagtggagacacaggaaatagtagcattaatttggacataagatgtcttcaagaagaaagtgaagtcccccaaactttcatgcaggtttctctgcaaggaaggaaggggctactcccctaagaacctaattggaatgtggctctgggtgccaaagctgaggctgagaccctaggcacactcaaagaaggaagagggagcttctgtggctctcggtgctctgcttctctgggtcaaacccttcttgccacacaggtgtgggagcctgagcaggccagtccactcctgccctcctttcagcccactccctgggccaggatgcacacaggtatgtattccccaatttgagccctgcctcacttcttcctcgttgttacctgccagcaccaccacacttgagaacagcagacacattgaactaaatatgatatgatgtaactctagcctaggagttacagaaaaaaacccaagcacatttctaaaatattcgagaatcctgtgttgaatgttaaagaaaccaaccacataggatctttataacacaccaaggcaggcactcacggcctgtcctgaacaaatccaaatcttttatccctggaacctacgtcattgtccacctccaggaatctgtgctgttgagctgacggctcctccactacaatgttctgctcattcaagactctgtcctcagtggttcatctccctcattcacatcccccatcaaaatatgtctgacttgtatcctattctttcagggcctttctaagaaaattccaaatgtactctagcagcttaatattttgccttccctaggcaagatgtttatatttaatcaaacaacttctgggaatgatgtatgtttagtgtaaagatatgcattactcagagtggaaattttcagtatgcaacagatcataatggacagaaggctctttgtggagtccgtggcttcaccctacatgccattctataatatataccacatgtgccaaataaatcccctaaatacagctccaaaaataacatatcagtatccattctcaagtaagcgacttctgccatacccagaggagaaagcatcagattaggtaactctgcttagtggtaacattctctaaagatgaaagcacttttcccactgacagaagcatggctccaagaagcccaagtcctgaggatattgtcagtaaaaccacacacacaggtcacagcttgttattaatcaattaattctcagcttgctttgtcccaagtcatccagcagacagaacaagaagagatttacaagctgtgtgcatttaaattaatatttttaaatggcatgagtgtgcaattaatactttcgaagaacatgtccacaccagatcaggcagtgtcggtttttttttcccctgtccatatgagtctatttttaattcctttcttggggaaagacaacagtcctagatttgttttgttttgtgtttttcttctgagactcaaaataaccatgttctttctgcttcagtaaatcattactgcagcttgaaagggttcctagaaagttctagttccattcagtttttaggaggaaaagcaacccaaacacgccaagaactagaagctttatccacaagggagtacgcttcaggatgataccaactgcattaatcaggatagacaaggttatgctgcagtaacaactaaaacctaaaattccaaaggcataacacttaaacatttacttctcactcaggaaaagtcactttgggtctggtgactctccaacacagcttcctttaaagagatgactcagggattcaagctgattgtatcttgtggtctacaatctcaatgcatggcctctgcaatcaccatgaaaggccaagggagagcatggagaagcaggtagaggcattttactgactcggactaggagggacatatattatttctgtgcacaatccactcaacaacaaggggccttggaagcatgggagagtccacaagtatttgatggttattaaatctctctttacacgggttatctcatagtgatgttaagagacttcatgatgttgttactctacttagaaactcttggatttcagcccttgaagaccatgctccaacttcatcatcaaatcctcaccagaaaagacaagaggatacagaacactgagcaactcacaagatgtgtgctgcagatgtgtttatcagaactcaaaagtttcctctcttttctctgtcctatgactattccaggagtgccagacagaactagttcttacgctctgcgaagaaaagagtggactggaggtgggtcacattgacattttggtaagagccctactccttagaaacagaatgaaagttgtcaatgaggggaagggagtaaggactggctaagagtagccatgctgggaagatttcattgcaaattttcctctacctgggagctggcagataaaccagatcattgttcccaaacactggaaggaggaccgactgttaaaaaaaaaatacccatgctggagcctaaatactctatgctagagcctggctattgacatattagcaagcatccctgggcaatccaatgcacagtcatattttgcagtcattgcactaaaggaatatccaaggtccccaccaacactaggatttcacaatttatgagcattttgaaagaatttacccctgaggattgacttattcagcatttaaatgggaactaagaccacgtaattgactgggaccaaaccaagatcagaattcataacctcacagctgttcctcatgtcaactctttctattctaacacactgccatcctcattttaaaaaagggaatgtggccttgatattcccatagattgctggatgcatacttccctgtcaccttccagtagggacacaggcattctattagctcagcagaatacagggctcccatccacatctgatggaaggcaaaggagatgaaactggtctccatgttgaggacagactggtacattaaagaagcaataggtcccctcatttgtacaccaagactcaagagttgaatctttcctttagtgacaagtggaagtccatggaagaatatttacaggcatggaagagtgagtttgaagtggggggcaaattctaaagagtaaagcctttaccaatggtaaactgtgccctttctatccatgccagcttgggaacccagttgagagtctgaaggagcaggacttagctttggacctgtgagatttcctctgtccccatcccaactgtgctcaggcccatcactttgcaggagcataattttatggcaagaggttcaccacatacctattgagctgcaagaggagtgatatcaatgtgcatatagttagggagagcaaagagtgctaatttagtaactgaagataagttacattgtatatgagatgtatttatatgcattttctacttctctctcctgcctcctgtatcactataaaccctagcagtcaagttccatgtcaggcctgttggatctttttcctgccatagagggagggacctgggagatggggagggattcagggatgacagtgttccagagtttgaactgggcataaagatatagaaccatccactggccaaggctgtcataggtaaatcctgcctggaggcaatttctagacagaacattctgtgagcttctaaatgatcctgaggtcggtatgcagatgctgacttaccagatctaatttgggaaaaagaagagggtaagaagttatatcttctgtggggattctggtggtaaggatgggcacagaagcaaaagagtgtttcctccttctccagaacatctggcttcattgcaagccactgtgggctactggagtagatggagagcagacagcatggcaccaactgaacactgtgcccactctccagacctgtccatgcaacccacagtagtggagtggccactccagggtcaggtagatatggcttccttcccagctctgccaattcccagctgaaaacattcttaaacttttccagtgtcctgtaaaatgggaaaaccagacctgtcccattgtatcctagtgagaattacatgatgtcatgccattaaagtacccagtaccaagcctggtacattataaacatccaagagcctaggtcttagcttcttcacctagcatgacacctctcccacccagcttactataccactgtgagatgataaaagcacacaagccctgtcaatgctaaaatatttatgaagctatagagaatatttttttaaattttcaacctgaatgtctgatttttttcttctgtatagagacagggtatcactatgctgcccagactggactcaaactcccataattctccaaccttagcctccagagtagctgggtgccaccatgcccagcttgtgtaagagcttttctgtcacgttctcagcattcctagatgcatgcatcaggacttcaattcatgcttcttcttgcctacaagtgggttctgttggtagctggaaagccaggctatggtggaggcaacagaaggaatacaggggtcccctttccaaacctccaagttatctgggttgggatactacaattttaagagtatcaaggaaggagctggagagaggaacttctggacactcagtatagctctagactctctctctctctctctctctctctctctctgtgtgtgtgtgtgtgtgtgtgtgtgtgtgtgtgtgtgtgtcagagaaagagagtgagattgattttttattttgaactgactaggtgccaccccttcattaccatgctgatttaaactgtcaagactgcagcctggcctgaccactgaggagcaaagacaataggaaaacagaaggcgactcaggatgcaaatgcctcattgttacagaacaataaacagattcacccttttgctaaatgtcaggttaatatcctcttggcaccagctgtgcctctcccctccttccctgccacagtgagtccaggctcctggaagtctgcccttcaccagccacctaggctcagcactgggcgtcgaggagagcaggtgtggctggcacagtaaatgcaaacacaaccagtccaaccgcaaagtggaatcagcctttgcatggagtgatatcctgggacagcctcaagctctgactttggggagctctgggctttgggctacagcttgggtagctgactaagccaggggatggcactaacacatgttctccgtgtacttactcacaagccaagaacaggtaggcaaggagggaggatgaccttcaaggccagttaccaacaggctccaaatgcatttcccatggatgcccactgggcccatccccattcctccctccaccaagtccctatccattctaacttctcatgatcgcttctttctgccttatctctgcattgacattgacactgttgttgctggggggctttgctgtgcttgcctctgctgccccaacaggtctccttgtcgccataccattctccacagtatctgcagagtctccccagttagatgatctggccaggtcactccttaactcagaatacttctgtagctccctctggcttttaatgtaaagccaaacccttagcaagccactgaggaatgagtttgaccccattcctctgaactcacatggtcctttgagtttaccctttgcccaacccttattatccaggatgggggttgactgttttggtttcttcccccccatttctaaggacaggaaccatgcctcttacctctgcacaccctgtgccttacatggggtatggaacaggaaatgtgctcagtagtgattggaagccattcattccttactcagacctctctacaaattgtccctgagtctaacccacaacttccctcactgcaaaaatccttcagattgctcctgacaggactgtcttcctcatctcatctgttttctctgtcctaatcactctctggagcttagctcaggttcccccacaagtctcaccaccatgaagcctctacactgttttgtcttctctaactgcatcccccacgtggaacttcataacggtaggctttgtaatagttactttacacctctgaacctcatctacaaggatggttcacaatagatttgccataaattttaaattatgatgcaatataaataaagcacatagcacagaatctggcacacagtaagtgctgaaaatagatttgtctgatggtgaggacgagcgtggtggtggtggtggtggtggtgacagtgataatgatgatgatatctctgttttatattgcaagacccagaatgtcaattccttctttgagggaaagggccactgcttatagtggtcttgacaaacttcaaaacatatggcccaatgcttatttctggtggaagctttactgaccatattaatgctattgataatattttcatgttattggtattaatcacgttaccagggaaagagcattggattcaaagtcaaatgcagactttcagtcctgtttttccactttgggcctcagcttccttagctataaataaatgagttttccagagttttccagaatgatctgtagtcctttctagcaatgataattacgtggttattagtgagactagtccacaccaaagtgagcctacactccatccatatgggtcatccctccccagtatacctgggccccaaaatgcaagcacaccatggggaaatggaagaaattgggacttatgtcatccaaccaacagaacgccagtcctcacttcaacacacaaatgttttctgttttaaaatctactccagcagcactacaattggcattccccctcctagcagtgggttagcagcagatgttacagcaaaatgatccagactgggggtgattattaacccttctgcacagcatacccatttttgcttctgggtccacacttgcacacctaagacaagttcacccgccatccctgtcatcaagagcttcaccaccttcttgtctagacaagcttgaatcccaagcagaagaggagactgagcaccatatctttgctgctgtttttgttgttattgttgttgttgttgtttgagatggagtctcgctctgtcacacccaggctggaatgcagtggtgcaatctcagctcactgcaacctctgcctcctgggttcaagcgattctcctacctcagcctcctaggtagctgagattacaggtgcccaccatcacatcctgctaatgttttatatttttagtagagatggggtttcaccatattagccaggctggtctcgaactcttgacctcaggtgatctgcctgcctcagcctctcaaagtgctaggattacaggtgtgagccacctcgcctgaccagtatcaaatcttatcaagtatcaaccacatcctcctataaggtgagaaaccagaccccactgtaaggtaggactgcccacaatggtgtaaagagccatctgggaaataaatagtaaatagcccactgcaaaaaaaaaaagtttcaagacagacaaacctggcttctctatgtatagtctgtgcgatcttaggtaagccacttaaatgctctctcagtttcctctactataaagtggggatttttatgtcaacacaaccccaggaaataggctttgagtataataatattcacaaagcacacaaataggcactctgaagaggtcagcccctccctttccaccctgaggaccttgtgggagtgcacacaacgtgacctcaaggtaaagtgggactctgctccactgtttatgacataactgggttgtcttgcacattttaaatatctgtctgtgtctcattttcttcatctaaaactattcatatccccaagatttgttgttgggaattaaacaaaacaatacatgcaaaacagtacttggcgcacagtaagcactcaataaatatgtaattgtcatcacccatgttatcattatcatttaatgatgctgaagaacaagtaagtgcttatcacttcctttaaatcttggcaccaaccacactaaaatctcaggcaggcaggtcaaactgcaagtcagagggccagtactgtcaagtcccaacgaggccacaggaccagttacccatccgcagattatccttggaaaatgtttaaagcatcatccactctgatgtcagcaggtgtgtgctcaggcagtgctagtgtgacatcctataaaagtcagaaaaaaggcctcaaagaagataacctgagccaagaacacaggcgtagcttaactaaaatgtttgtctactcagacaccttggcccctgtccgtggtcctgaaagagacaagtggacaaagactgacgggtggtcatgacttttctttttcccttttgcaaatagttgaagacctcttctgatgcaaatggtatcaacaaaagataacagaagaaaacatatatgggaggtcatgacttctgagacatttccaaggagaaaacagaaagactcttcgacatcaagttcaaataaacaaaattattgagaataaatatatatctatattttttgtttttgtttttgttttattttgtttttttaagatggagtcttgcactgtcacccaggctggagtgcagtggcatgatctcggctcactgcaagcttcacctcctcagttcatgccattctcctgcctcagcctcccgagtagctgggactacaggcgcctgccaccatgcccggctaattttttgtatttttagtatggacagggtttcaccatgttaaccaggatggtctcgatctcctgaccttgtgatccccctgcctcggcctcccaaagtgctggaattacaggtgtgagccactgcgcccggtcaatatatatctatatttttagtcattgggcttccccacctcttataccctgactctaaaatcatcaaaaaacccttcataatgcataccagaaataacacaaatcacttgtgtggtctttggctactgctatggtctgaatgttttgtcccctcaaaatccatatattgaaatcctgtcatccaatgtgatattaggaggcaaagcctttggaagctaactaggtcatgagaaggatctctcatgaatgagactactgtctttaaaaaagagattccagagggccctcttgtttcttctgccaggtgaggacacagtcagaggactgccatctatgaaccagaaagcaggccatcaccaggcatggcatcagttagcaccttgatcttggattgcccagttttcagaactgtaaaaagtgtttttgtgtcaaccacacagtctaggtatttttgttacagcagctcaaatgaactaaaacacctcccctctgttggtctggataataagaaattgaacaacacgaatgtcctatcctgaaaataatttaattcttctattccctcatttattgcaaagacatgacagaaaatatttagtaggagcaaggctctgagatttcaatcctaacctctgattccagtcctaaatccatcactaatcaggataagaccttgggcaaattgcttcacctctttgtccctcagtttattcatctataaaaatgataacaaaaataatacttagttcataaggttattataaaaattaaatgagataatgcacccgaatagcttaaaaagtgcttgccacattgtacaaccccagtaaggataaatgttaatattataattagttttattgttattattattgttgttgttccaaattagacgtaaccacatattggtttgcacaggtgccctttctttgtactgtttctaatatctaaccccttctatcctctgcctgagaaaactgtggacatatcacgtaagatctgaagaaagtttgttcactcacccacccacccactgagttcaccataaaaagaattcagaaatttcttacaatgggagatagtaaaaacataatggccacaattcccaaaaagctgcagagagcttatacaccctcagtccacatcacaacagagccactctccactcccttacccagccatgcttggggccactcctactcacttcctcatcattctgtcaattttagaggagcccacggggctcacacaagctgtgcagatcaccaaggttagtatctccattgccttgctccttggaagaatgttcaatattagttcagtgttcccagcccacaacctaaagcctccaggagtcaggatgaaatacaaacaatggcaatgacccctccttatctggaactcacaataatttcgtaaatactgctatgcaccttggttccttcaatcttcttaacatccctccaaagcaggcggttagtgatctcccgattatacagaaaggtagctgaggcctagagattgacatgacttgctaaaattcacacagctatcagtgaatggcaaaatcagaacagcccaggatggctcttcaggcagcaaagtttagtgggaaaagcagccagggagaactcaagttcaagggagaacttgaatcttaacacttattacctatatgacctcaataaagtcacttaacctgtgaggactcagtttcctcacatgtaaaatgaaaatagtattttccattcaggatgctggggcatgcaataatgtgggagagcactgagccaagtgtttggcacagagatgggattaaataggagggtcctattgttattattactatggttaggggagccccattccctctccaacgtacagagccacacggaatctaaactaaggaggccataaaacacactggctccagtctaagtccagtgtctttctccctgccccccatgtacctgccagccacatgcctgaacagcagagagagagctcaatcatcacatgtggcttatctagagaacttttaaatcccacgctggcctgacccaccccagctggcatactctcaggcctctgacactggcagcaggtctgagcatgaggaatacagtatctaatctgagcaataacttgcttatccttatatttaatttatacaaaagtgctttatgatatatggcatgatggcaaccatgggtcagtgaaacatatgaatttccattaaacatatccacttccataaacaaccattcctgttttgagtaggtagagccagtaaggatgaaatgatgctgaagaggaaggcagtggagggtattttataaatatcaatattcaaataccacttaagtcctcatatttacttaataaatatgacaatgggccaggcacagtggctcacacctgtaatcccagaactttggaaggccaaggcaggaagatcacttgagcccaggagttcaagaccagcatgggcctgtctctacaaaacctttaaaaaaaaaaaaaaaatcagctgggtatggtggtgcatgcctgtggttccagctgcttgggatgctgagatgtgaagatcccttgagtccgggaggtcgaggctgcagggagctatgattgcacctctatactccagcctgggcaacagagccagacctcatctctaatatatgtatatatatataaaataggtaacctgtcccctgtcccaaattgccctggggagcactgcaaagccttaaagaaatacattggggattatctgcttgtttggttacccaagctgctacttcctttttgtctataattaatgaaattagaccatgcacatagatgagatccactcaagtctacaaatattgacagcactagatatacattttgaggccatgaaaatgcaatgaggaacaagacacaacccctgttgttacgagggcacagcccattgtgggagacagattacatagcatttacagtacgataggctgagtacgcaggggtaagggaacacagaggaggaacatgtttcctgaatttggggcccaaagctgagacctaaagcgtgcacaggagttggccaggggatgagagggaaaaaaaggagagagagttgctctgagttaaggaaacatttgagcaaaaaatccatttgtaaacagagcttggggacctcagtgctgccactgagtgacaattcataaatgcagcaactctcagccacccacccaacattattctgtgcttgatcaagagctgaagcagcctccagctgctgccaccttctgccagcagtgttagttccatgagggctgttctgcccatggatcattgatgatctgttgtcccctgcatgcacagaccagaaaccccacctccccacctgctgctgttaccctagttgacctcctgcctcactgggtggcagaatggacagccctgccatctgcttccctccccagagcaccaggcatggaacactggggatttatggggtcaccaggcagagctaggagggttttgcagtggtagggaactagcagtacacttgaacacatccatgggatcacagcaaggaggccaaatgagataggatagggattcaaaggagaaaaacagaaccacagaagtacacagctctcagatgaaagccacttaatcagcctcatcccattttccaaaattcagacaaatgcagagaaacactgggcttatttagcagtatctatactctaacacacacatacatgcacctgtgtgttaatctaattagacagcttttctagttctaaaggtgaaatgcacgaagagcaagttcttaggttattttctctttaagcaagggggactcttacatccaacacatgcaacagctatttagtaaaacaaacacatgttttcattctgcttcctgcttggagctccagaatggcctcatctggtcaaggaaggtctcggttctgccagcccattcgagaaggcaaatagcaatggtatagatggcatagagcaggatgtgagtcctataccttggattgccctggacagagggcctattgtctcctctatttttggaccaaatgggtgagaaacagcttatatcaagaatggcctggcacatgcctgtaagtccagtactttgggaggattgaacccaggagtttgagaccagcctgtgcaacatagagagacccatgtctaccaaaaaaaaaaaaaagaaaaaagaaagaaagagagaaagaaagaaagaaagaaaagaaaagaaaagaaaagaaagagaagaaaagaaaagagaagaaaagaaaagaaaaggaaaaagaatggcctggcaaataacccaaagtcctctcaaagctacattactataaacgagtcgcatgcttataattcaaaaataacatttgtgcctaaattcaaactaacacattttaatggaatggcaacatttttaggcctcaactcattctgggctcaaaataataactagaacttcatagcatttgcttgtggaacccatattccttgagcagtatctccctaggcaacagctccagtatatcctgcattagaggatatttcagatgagatgcacttgtgttgcctcagactactacggagtgactccgcagctgctgaagtgttgcctaattgaggatctactttagaaacgatgtgagtgtgatgggtaattggcacgttttcctgcttctgagagtaagctgtgcgctccttgggaggtgaaacccacttccttgtctcaccatggcttgaatgacataataggatttcagtatatgcaattgttgagtgaataaatgaataaagaaacatattagctgaattattgaaacaataagatcaagtaagcccacatagatttgttcaccttcttcacatgccccctgcctgccccaaccacacctcctttcctttgccttgtttgattttccaccaggctgcttattatactatcggacatgtaagcactttacttggaaatgtgtttattttcacatgctgtgtaaagtccaaagggcatggatttttatctcattcgctcaccgctctactcccaccacctagaactggtccctagcaagagttcactgagcattttgtgggggagttcattgtaagactctttaagaatcactctatctctaaacagaaatgatggaagatgtttttgttctgtgtatcaagggtctttatatatgtaaattaatcaaaaattaaggtgtatttgagggcgcttggtcttaaaaatgtaaccattccaccttgcactgttttcttacaaaaatctttgtaatttggccccaacataccatttgagctttattacatcatcttcttcattaccacaatcatcactaccatcactgttatcattcacaattacagaaaacatttaccaactgcctgctgagtacaaggcattttgaaaataggtgtttgggggccagaaaatgaatgggatgctgaggtctctgttctcaaactgcccatctaatgcaagcgttgagacatatttacacatgaaacatacactcagtgtcaaacaacgggttgaaccagttctgtctgacagaaatataataatgagagctatatagctaatttaaatttgtctattactcatattaaaaaatgaaaaataaacaagtaaagttaattttgatactattttgcataacccaatatatgtaatatattataatttcaacatgtatccaatatttttaaagttttattaatgagattatttttcttacttagttttggaacatgtatgacacagcacatctcaattcaggctagccatattcaagtgtctaacagccatatgtggctactggccacatattggaccctcagggttagactaaaggattttcagagtacagaggaggggacacatctcagcaggcacaggagtgtggagaaggtcccatgagaaaagcctctccccttccctccttttcctgctctttccttccccatcttcctcctcctcccgtcctcatccttatggaagcacaagcggtatagttgcaggggtaaataggtgtcccaagatgaaaacaaagggaaaccttgggcttacccactgagagtccctgttccacactgcctcttcttctctttctcctaggcacagccaaggaaggttaaatcccattccatcactaatgagagatctgcccacaagcactaaaataagattcctctgatcttaaaagaaaagtgtttttggactttaggcaaccctggggacttagagttgttctcaaccctagcatccatcagactcacctagagaaaattttaaaagtaaagatgccacaagtatacactcccagattctgatttaattggtctagagtgaggcctagggatgtttgcaccttttttaaaggctcctaggtgattctaatgtgtaactagacctgagaactgctgggctggggtgcagaaattgcagagtggaggagaggaaagagtggccagttggctatgatgccattaaccacagcactcagcatcactttatgtaccctttctcgttggatccatatgataaccctgtgtgacaggtaccactaacctcattttgcaagtgagaaaaccaaggctctaggaggttaagcaacttttccagggtcacacagttagcaactgggaaaggaagaaactcaagcccggtcaggtctgactccaagacccatgctcctcacttcatatcaccccttgtccctcctcttcatcaaccttgccctccatttccactccaccaatcttggttcaaggtgagaaactgggatgggaatgagaggatgaagaaaactaggtaagatgcagggacaggttgggaaaaaatagtaatgcatacagcagatgcagggggaagttgggaaaaaaatagtaatggacacagcagcaagggagaaacctccttcatagatggccagcatctcccagatatttttttaagtgctagatagattaagtgttgaaaggacacatgcaggggagggtgctgatattgactacgagacttgtttggcatcatgacaaggaagaagtgatgagaaaaggtgtcccagaaaattaaccattacctagcttccacagaggatcctgccctaaccaacagataggctagaaagaaggctacagaacagaagacaaagaataaaagagctgtacacaaagatatgttctttttctgaggtttcatacactgtgaaatttccaagtagtgaaaaattaactcaatgcttaaaaaaaaaaaagaagatgaatgcaaagaaagaaaaaaaaaagaaaaatctggcaatgttggaagagaaatcagtcttgcctgacagtatttaaattgaatgtctgtgagcatggcccacaatttttagtgaaagtagaagctattaaaaagtcgatgcacaagattaaaatttagaatgctattttaataataccaaattctactcaatttcaaatggctgtcatttttaagctccaccaatttgataacacttgactgatggcattgggagctgagtgatgggaagattgaattcggcaggtccagctcagctgacacagccagagagatgaatactcatcctcaaagaactaagcagaccaggctgatggacctcttagaatctgttttcccatctgtaaaatgggactaacaatatctgccctactgaaaggaacaagtgtgatggagggtgaatgaaccattgtcaaaagcattgtgaaggtcaagaatgcattgtgctcccgctgtgggtagagcctgtgctaggtcacaggtcacctctttctggaagcttcccacatctcccaattctaacttagagaatcaacaagtagttggactagtcagtgctgggatgagaacatgctcaggatgttccagaactcggagacaagtcatctgtcacgtcattagatccaccaccttgtaggactgggagtttgctctgtgtacctagcactgtgcctggtatacagtgagtggatcctcaataagtatttgtagttccctcattcaacaggatcttgtccctaatgttttgactttagatgggaagacaaatatttaccaagcataatataagtactgatgcagagaccatcagagcattacagaggaagaagaaacactaggccgggcatggtggctcatgcctgtaatcccagcactttgagaggcccaatgccaaggctaaggcaggcgggtcatttgaggtcgagttccagacctgcatgggcaacatagtgaaaccccttctctactaaaaaatacaaaaattagctgggtgtggtgctgcacacctgaaatcccagctactcgggaggttgaggcaggagactcgcttgagcccgagaggcggaggttgtagtgagccaagattgcaccactgcactccagcctgggtgacagagtgagactctgtgtcaaaaaaagaaaagaaacagaaaaatcatttcaactggatattgaaaaatcatttattataatcactgtggtcatgtttaatgctgttgacaaatatttcctgctcttcacatcctaggcatgcagcaggattacattaccctgcaccctctgaagttaggctaagccatgggtcctacactggccaatgaaacatcagcagaagtggcatatgtcccattttggcagaaactttaggagctgtgcagttctccatgttttcttcctgcagtatggcaaatggaaggacatgttaaaatgaagaatcttgggggaaaatggctccagaagcaggggtttcagtacaacctatacagaacatgaaggacaagcaagaaatacacctttgttgcagaatccgactgagatttgggggccatttgttattggcgcctctctttactaatacaatcatgtcaggaggagctccagcaaagtatctgtaagggaaggggtgagtgagcctgaaggctcttgagagtgaaaaggaaacaggactcaagcctctctttggtcacagactcagctaccttctttcggagatttcctccacagggatacactgaaaatgccactcaggtttcagaagcctctgagtgaggagccccagactcctgccttttatatacccatctcccgccctcatgccttctggaaatggtgctaagtatagctgggttggatccctggctcaattactacatcacaaccagagactgaggaataaacatgccagggtggggctttttctctttgcccgggatggctctgcctccatctctctcagctctcagcgaaaatcctcccctgcagccagaggcccttacagaccctaagcctctgctcctgctcttctccagcaggtgctgcctccccttctcatctctgcatctgtctgtcctgcagagctcagttcacaccccatctcctccagggaggaccactacagactccagcctattctgtgctcatcctacgagctttgaacccatctgacactcaaccatgccctgtcatcagaatagtgctagcttgttcatctgggcaggttggatctcttcaaaggagggaggaacccctaaatcttgatgatgtcatttgtgaaatgaggcccctgctctgaccactcagaactgccattgggcatcaggtgagttgtcagatctaaagcccctgtcttggtgccaaatacctaacaggtgctcaagaaatgtaagactcttctcaattccctttgtctacaagacagtttgacaaagtgggaccagctcttctcctcccacagtaagcccagatgcgtctctagagatgtgtctcatgcatgtattctcaatgggggcaaagtctcctccaggaaggcagacattgaaaagtgaaaaaacaacctttatgtataaacacagatacatacagagtacacacacagatatacagtgtatctgtggtattaaaatctcatggggagggggtaaggaagtgtttttttaatgcttagaaaagctccataggtatgcaataaaggaaaaaaaaaaggcaggctcttccatgcccatctcagctgagcctcttatcacttgtctcttatatttcctctcttgtgtctcttccaaatcaataaagtgatattttagaaaattctgccaaacccacatttctccctcctccaccgccttcccagcctctctgctcctgtgctcatctaatctgctgcctttcctgggatgtcagccttgcaattggctacagggaaagcaggcactggagagctgagagactccagtcttggttttccagacatagcagatgtgactgtgtttgtatctacccccagcaacaccatggggaagcagagctaggcactcctgcctcaccccacctccccaccacccagcttgactcagaatggtgcctcaagtcaaagacctgcctgcaactcccaagagaactaaatgtttccctccactaggggagggttactggtgggtttgggcttaggctggtttgttggaaggtggctgacactgcagtttggctcacccaaggtggagtccaaccttgcctgtcctcgaagatggaaagctgaataatcaccttccagcctcccttgcagctataggtggccacgccacatattctgcaggggaagatgtctgataaaaagcaggagggaacagcttaacctgatattgcccttcccccttttctttctaccttgaaatggacccaaagtctgaagctctccatctctcttgcagccatgagtgaaaagccaagggaatcctgacatcctacagacactatcttgacatgatgtagcagcagcactagtgccagaaacccctacatctagacttctacttgtaggaaaaactgcttttctctctgttacatgaagcccaaggaatcctaactaacacagaagtcaagagtgacaggcacagacacatgaaaaaatgctcatcatcactggccatcagagaaatgcaaatcaaaaccacaatgagataccatctcacaccagttagaatggtgatcattcaaaagtcaggaaacaacaggtgctggagaggatgtggagaaataggaacacttttacactgttggtgggactgtaaactagttcaaccattgtggaagacagtgtggcaattcttcaagcatctagaactagaaataccatttgacccagccatcccattactgtatatatacccaaaggattataaattatgctgctattaagacacatgcacatgtatgtttattgtggcactaatcacaatagcacggacttggaaccaacccaaacgtccatcaatgatagactggattaagaaaatgtgcacatatacaccatggaacactatgcagccataaaaaaaggatgagttcatgtcctttgtagggacatggatgaagctggaaaccgtcattctcagcaaactatcgcaaggacaaaaaccaaacactgcatgttctcactcataggtgggaattgaacaatgagaacacttggacacaggaaagggaacatcacacactggggcctgtcgtggggtcggggggagggggcagggatagcattaggagatatacctaatgtaaatgatgagttaatgggtgcagcacaccaacacggcacatgtatacatatgtaacaaacctgcatgttgtgcacatgtaccctagaacttaaagtataatttaaaaaatgccaaaaaaaaaaaaaagagtgacaggcataatccttacccatctgacttccctggagtctctttataaacacatctgtactacaaaacagaatgactagtgcttctcaatgtccagagtgcagggagactcagagatgctctgccatgctttaggtcccagggtcatggcctctctgcagggggttaagcacatgggctttgcactcaaattgacctggattctagtcctaactcctccacaaaagctgtgtgatcttagacacctcaccgttctgtatgtccgttgttttcactgtagaatgaagttgacaacagcacttatctcatagaattgttgcaaagattaaatgagatatatcacacactaatctcagtgcctggcacatactgtcttctcaatacgtgttagctgtcaagataattttccactttccctttctgggtctaagtccttctatgagcttgtctgtctcatttcccaattatttctcagtgttttctcatttccttatctctgtagctctttccttctcctttctctgtttctccatctctctgcatgtgtctccatttttgtctggctttttctccctcctccctcattcccattcaggtttacagtggagaaacacagcaatttgcctaattttccctctcccaggtcaagagaaagcccttcccaggctctcagtcacagttccttagacgtgggtcccccagatccccttgtgttctgaaatgcctgtgatgggaaggggaggggatggtgatgtggtctcctgccaggaaaagttgctgaaggttggggctggtgaagggggtagtgagagaggggcctgctgccctgcctcaggaatcacgtccacttcatgactggctttagcagctgagtctaaaagctttggaaggaaacgctgggtccaccactggctccattcctgcctccctttctggcctaccccaggattccttggcagaacttggaatttggtatagtcagggacaaactcttctctcagatgcttactgtcccaaatggaaagcaagacctaagtgcataatcctaacccaccatggacagacccctctggctccacagcacccaaaagacccctctggtgaggggagcaagtcaccaataataacccacaacacttgccctgcactgatgctgcttcaaaggcctttcctgtgccaacctactgacatccttgcagctgcaccaaggaacagactcctctttccccattttacaaatgtcatggcacatgggggctaagtgatatgttcaaggtcacacagttataaatagcaaagacatgttccaatctaagcaataacaacagcaataataacagcaacagcaaaataatattaagataattttaatgataaaaacacaatgtagcatttattatatgccaggcacatgcaagggctttgcatctattagctcattaaatctgacgcctaccctgtgagataactactatcattgtccccattttacaggtggaagggaaggtcaagggaaattcagtcatttgcccaaggcctcgataccataagagtgtggattcagggatgtgcatgctgcagtggccaaggcccacaatcttatgggacagctgaccacccaacccccagccagattcctacaagccccaggagtaaacactcccatgaagaatcagctcaagctcacctccaggctgagacaaagggtcaccaaggactggccaccacacgaatgcttctccttggtcttacaaaacatgaaaggtgctattatcagaagccatgcctgcttgcaaactacagaggtgacacgaggtaaattcatttccttcctgtcaagagaaactcaacaagggtataatcagaagctaatgtgtgtactgtgattgggcccatcacggggtggcacataattgaacaagttctccatgcctggaggagcagagccgagccccatcactgggaagtgtcactcatctggccagcacacattggtttttaataacattatggaaataatgctgcagggctgtggaaaggacagaagcttgaggggcagggcctcatcaggtctccgagagctttgaccttgagaaagaaccttctggccccatccagaatagccactttcctcagggatctctcctgtaggctttgtggatttatgtctcctgggcttaaggaacagggcttggtgtggctgaaccttcttgctgaatggatcccaggggaccccaggtgagcattgaggccgggttctcaagagactgaagggggtcggggggttaccagagagaggacaggccctttgcttccccagtaactgttgacaatggtaatacctccatggcccctactatgaatcagataattttctgaggactttatgtatattaactcatttaaactgaaaaacaatccatgtgataggtattgccattgtcctgattgtatagataaagaaattgaggcacagagaggtgaatttatctaagatcacacaggtgggaagttgtgtttgagcccgggcagtccatcatcctaaccatactccctactgcctcaatgagctgacacagcccagccctgataaagggggtggcagaggggagggggatgaggtgccttcctggctgttggcattcatttcattcacatttttatcaggcacccctttcaaccagatactgctgtaggcactgaggatacagtggagtataaatagataagagttatattctagcgaggagacacaaatcccatataaatgtacaaataagacaatttcagagaatgccaaatacaatcaagaaaataaaaccaagaggtcatagtgtccgtggcaggaaaaggtaagtaagttattttagagaggaggaaaaggtaactttaagaaccagagacaactgtttaggagaaggcctagccaagactgaataattcatgtgttaagaggttttcaatcacctaccaaatacaggaaggaaccagtcattgaggctattgagaagtcaagaagttagagacctatgaagacaaaggcagcctgggctctgctccacctgcccactcatgggcctaggcatcagaagctccgccatcttgcactgcaaccctggaagccacagtctcttcagtgccatcagggaagacagcaactgcaccaccacacacaggcatcccctgccccagcccagaagtgatgcacatcccttagtgcctcatgtcctgcctaacagtggatgctggaaatttacaggagcaactggaatattcataagcctaactgcctcggccaccagcccacaagggacactaatggagacagcagagttgcgtgagggctcacgagctaagaggtggaacccagccaggctgagtagaaagtaagccatcgacaagcagggagttaataggtttttccaaatgaacggtccttaatttcaattcattgagaggtgagggatcaggtgaaggaagcaaggtgaaaaggaggattaatccatccatcaaggaccttgggtactgaaaacatgaaaagatgaatgcatttgtgagacatactgattcactaccatgagaaataattatcttgaagcttatttggtcccagaatcaatctttatttaaccgtacttatttttggtggctcatcctgcttgcctctcttggaaactcaagaaatgctttctctatttttttttttgggtaaattccaaagacttgcatatttcatatttttcaacaggatgatctttgtgtagactgactgtcttccctcttcactagtcctctctatcattggacctcacccgtagtaatcactcactccacaatcatcttctcttgtttcctgcatcactcatcactaccttaaagtattatttattgatttattatttttttataatctgactcttctattgtaatataaggtgggtaaagacggagacctttcctgtctccgttggccacatccccaacaccacaccaatcaagcaacagactaaggacacagctaaataaatgaacaaaaagataataataacaatcatgtgttagtcttcataacaatcttcatttattctttttgattattcccatgttacaaatgaagaaatggaggcacagagaataattaagtaacttgctcaaggttatacagatattgtaaaacagccaggatttgaaaccagagagtttggctagaggttccatgctttgttggtataaatatttaagaaatatttgttgattgaatgaataataaataaatgaatggcttccttgtgtttcctgccttctttaccagggttatttgccttcaactttcactggaccctctatgtatcaggcatggtcttaaattctcttcacacattattcagttgagggtagtcccatctaccatatctccatagaatcggtcccaagcctggtacttagaactgccctgcattgtcaggctccccctttgccaggtggtgcctccctaatctgaaatcatggactgagtaccttcaaaagaaaaattaaaccaaagatcaggaggagatgcttctgacttagtgagtctagaagaccctggcctcccttgcccactctgcccagaaactgaatcccagagagatgaagttatgggtttcatacctgtgtctgcccatcaacccaagggggacaaatgccaacatagaatgacagagagggaaggaagaaagtgtttttcctaattaattggctctaaaagtggagaggaaccaagttgggttattatagaagcatcagcgtccgacacaggtcttcaactgccatgcaaataccccctactctgcaccatgcagttcccatggtttactctgttgtgatgtaactgtgcatgtttctacctgaacccattgaacacggctttgtgcttgaaccttgaacaatgcctgggacacagttggtgctcaataaataatgatgggataaatgaatgagggatccccattctcctacctaccttggccttgtcatcatctctcacttttgcgactgccagataacacctagctctatccccttgagccatccaagtctcagacacattcatatactgactgaccttgaatacatactcccttcctgaaagagatgcttcccaggaccctgcatcatggaaaataggaatatcatggtaaacgttgctttaattgaacagtggaatctatgctagtcttcatgacgaaccttgaaacacaagagtgctgcagtaaccatcattcctgaattgtggaacttcacagactcaggttagccccaagtgatgctttgctgagcaatttaaaacccagtcatgcaaagccaagtgctttcatgtttgagaaacaaaaacatttcaactgctcagcacatctaaatcagtactcccttaacaacccaccttggttcttccccttgattctgaaagccaatttagtaagaaaagcatattaataatcttgccctctcactggccttccctccctccctcctattccagcatcttgcagctggtaccttgggtcatttgttttgtttttgtcccttaggctgaagtgcgtccacagttttgaaactgctaactagagtttatatggaaaattcagattagaaacaaattcaaatgcactctctcattttcctgtaatacactgggtttcttcccccaatcagctagaagacttgctgggtacctcctcattgtgtcctgttggaaagtgtctcttctggtcaccttgactgttaaataagtaaacagactcattggggttgctgtgtcctgtgacattggcacagactctcaccccagccaagcatgcacatatcaatgggccaccatctgtggcagaattaccagacccaagatggaatttgatgcatctgtcctggtgaaatggcattatacttctgccatattcttctggttcaagaacattgtcctcaagcccaagggacagccctgtccagcataaacatgattaaaatgcccattgcccgactgccctgctgaccaagaaacatggccaagcacagagtctgcaagcagcctgcatgtgggtctaaagaagaggaagggggaaagtgtttccagaaagtaaggttgccaagatttgaatctcaatgtcacaatctggctttatgaccttgggtgagtcccttaatcccacagagcctcagtttccccatctgtaaaatgaagagtaccaatatcctgatgtgttgtgaggattacatgagatcattttcgtaaagcaccctagcacagagcctgatacagtgtcattgggagctaagatttaccagcactcatcatataccaggccttgtgcatgaaccccacctacattatgtcattaagcatcactgcatgcataagaaatgggtgttaccatccctatgttacaacagagaagactgatggtcagaaaagttaagtaacctgcacaaaggcaaggaggtagagacgagtgaacttaggattggaactcaggactctcttaaccacatgaagagaatccaagtggaaggtgcctcctaccaacgctgagatgaggttcgtgtctgtgggcccctgtctgaggctggttgacaagaagctttagagagacgcttggggatggcaggcttgcagccagaggccagggtttgactcctgtatgggctgtgtgaccaggggcctctttaccgctcgggtgtgcttcacctccttcctccataagacaaggacaactgcatcttccctgtaagactattgggaataaaacaatagggctttgtgacctttgacctaaggtaggattcttatactaccccatgctctatgacatgataagaagacagtaccaacactcagcacagtgttaaaagattccagcaaataataatggatactaacataataatagctaccatatatagaatacattatatttcagaaactgtactaaaaccttaattaaagcacttaatcctcaatgcaaccctgtgaagtagatgctttttattatccccttttacagatgaggaaactgaggcatgtaatgattaggtgacttgctcaaggtcacaaaactaagtgctgaaaacttgggattcacatggttgcatcaaaactttattgaaaggattggtcaatccaagtgaacaacacatctggactgtgccccatagaaacaagcattttagtttcactagaatcaccgggataaacagaggcaagctaacccctttactacaggacatctatggtctttaacttgtaaatacgaggaaaccatcaagagggagatagagtatgcagcctttcctgagctttgaggggcaacagtgtgctctgacatacgattcgagatgtaccaagtctgagtcatttaccctaaatagaacagccttccattggctgttggaaacacaaagtaaaacccaaagaagagagaaagcaaaagtgaagaggccattgtcctcgatcctttatcttttgttctctgattcagatcaggagaggtgtgtatgcctgcagacctggacacccgcaagccacatgctgaatgaaggcccacagaagtcccaaaaaaagatggaaccagggaaaggaggtcagcctggaacagtcctgggaagctgagacccagcccagaacctgctggaatcaatagtctttaacacaactgtgacattagcttgggctgctgggatccgtcttgaaagaagaagctttgtatatttctgctcttattccccacaggatccagaaatatatttctgtaattcttttagctgataagtatgaaaaacagaattttaaatattccagtagggacctgacagaacagggccatcttcattagctgctgaatttcccaatgactcctagaaattgacacaattagacaaaattaagtgcttctgtcctgaggataggccgccactgttctttagggcatatctttgcaaaggaaggtgctggaattcctcacaaaagccacatccctctctctctcacactctttctctgagcaaatctaaaatctagtgccaaattccttggagctaattctaaaaccaggaaagctttttgtaagattataaagattgtattggactttgaagatgagtccctttgctcagcaacttactttcttaatgcaatccctgaattctccttgctatgctctgaatgtttatgcctgcccacccccaattcatacgttgaaacctcatcaccaatgtaattatattaagagatgaagcctttgggaggtgataacgtcatggagacagagctctcatgaatgagattcatgcccttataaaagagcctccagagagctgccttgccccttccaccatgtgaggacacagcaagaaagtgccatctatgaaccagacagcgggccctcaccagacaccaaatctgctggtgtcttgaccttgaactttccagcctccagaactgtgagaaataaatgtgcttatcagccccccaagtttatggtatcttgttacagcaggccaaacagactaagacattcctccatcctcccatcgactgggcaaaaggataatattacttccatttctatggtgattatggaaactcagacccagcaagtggctcccaacccactgggtgagtaagcagggaaactgaggttaggaaatgaactcagttccttttctccccatcatcttttctcccctataagaaacttatcagcagttcttttgcatgtagagtcaatcagaaaatcattagccaaggtcagacaagaaaccacagctttggtttctttgatttcaaggttagaataagagcaatggaactttaaagagcatggatggtagtaactgtctctgagaagccagccactcaaactttccaggcccagaatcaacatttatttggaaaaactttttgttgtccatttttttaaagagctctaaacttccagtgagtcttatgtagatctatttatatgcccatttcttcttttattttttgagacagagtctcgctctgtcacccagcctggagtatagtggtacgatctcggcttggctcaccgcaacctctgcctcccaggctcaagcgattctcctgcttcagcctcccgagtagctgggactacaggcgcctgccaccacacccggctaatttttgtatttttaatagagatggggtttcaccatgttggccaggccagtcacaaactcctcacctcaggtgatccaccagccacggcctcccaaagtgctgggattataagcatgatccactgtgcccagcctacatgcccatttcataggcaagaatactgatgcatagggcacaccacactttacaggcacaagaatgaacaagtctttagagggtaactatttcttgtgcaagaatcaaatgcaactgctgacacttacagttttatcactggtgacagcatgagtggctgagtgagcaggatgaatcttgagcctggggtgtagaccagagcaggggcttccaggtgctcacacctctggaaagcaagaggaactggaacagttggagttcagaataggctaaaaaatctcctgccagtcttcacagcagaatctctgagtggagcacacagccattttgaagttggcctacttggatgccagggctcaaaaattctaatgtggccaaagaaaccttcagagaactacagcaaattcaactgataaatttgttctactctagaaaagacactgccaaaattccagtccctatctatcagggaccttggataagtcccttcccctgcatgcatatcatcacagaccatcctcatatgggggtggggagggtgtctctctcccctcttcagctgccttcctacctccaggggtgcaccaattcactgtgatgacctcacaatcatgcctggtgattatgaggacttagtgggatgatgctctgggcaaccacagggattgctcaccggtgactcagtggttgactcaaaggctagagggtggtttgggggtggaggcagaggtccagtgagctgggctccaccctttctctccctgcagtcccaactccatttttatctgtgctatatgttggagtctagccaagatgtcatttgaacaaagattctgaaagatcaaagaaaaaagtttgaaaaccaccaggacaatgctttcaggggactttatccaaaagactgcaacaatgtaaagagatacgattgcttttattactgtgatatgtttaaagtattataaattttttaagagctttgtaagtgacagaagtgaagacatgctcattttaatgttaccagtcaactctgagaagactaaaggtcaagggacaatgaaaatgtgacccttaccaacgacagaaactcccaggaagccacaattaactcaagaccaccaggatatttggggaagtttatccttctggaaaccagaatttctgatttgtggaaaattctatagatattctctgccagactccagcctatttggtaagctggccacagatgatttagaacacaatgaccctgatactcactagagctctgagtgtggctggataagcccatttcagcagcatgtcagcccctccctgaactaggctctgtcactcagatctcagatcttagggcagctgtagtctgccccttgctttcttattaccccagataaccaatgttatcctctgtttttccttcctcccagggggaaaagaattcagaaccctagtctgagtatatgaattagactctgcaaattgtttatatgagtcattctcaaaactaggtctggagggtccccaagagatccacaaatttcttgcaatattcatgtaacaatgttcatctctttagatctattaccattgagtaacccattgatatttaacaacaaaacaacagcaaacaccatcctgatagctttaaaagcaaccctgttcttctaattgtttctagtgcatgctttttgaagctaaactagtagactggattgtcctcaagtagactggctcaccaaaggtgtccacaacaagaacatttcaagttcagattggacaggaatatttatgagggtttgaccagtgctagacttgccagacaatgtgcctgaatagtctccctgaacttctctcttaaacacaaacaagatcctatgctggctttctggccacacctgtgccagccacaaatgggctaaaacacgtgaaatgtgctgtccgcgtgcagggttcaaatcagataacaaaatacacattgacggttctctatagaatgaaaaatatcctactttcattgcatgctggtgttgggtcagaaaacaacagtttcttatttctcctggttagtggtcctttggaaatcacagaggaaatacatgcagagagttaagaggactacttcacatctgttgtcccgtgatgctacttaactgaacactacactcatgtgcccattcccgttccctttcccctttatggtaaatgttgtcccatatgactttgtgattgatggaaatgttctctatctgtgctgcccaatatggtagccactaaccacacatggctattgagtactcaaaaggtggctaatgcaaagagaaactgaacctgtaatttcatttaaacttaaacaaccactcgtgtctagtggctaccatataaaacagtgaactaagtctaaaatttaggatcttgcagtacagggtgtgtgtgtgtgtgtgtgtgtgtgtgtttgtgtgtgtgtgttaacaaaacaaacactgctccttctgtagtgagcactggcctatggccagggtctaaggaatatgcaaaagaaagtgactggaagttttaagcttttaaggttttatcaaaagacatttcttaccactccctctgggcagtactgtagaacatctactagggagaggatgatatgaagatagagaagcaacaaaagtacagacacattagaggcaaaatatagatgccaccttgtaaactggttgataattcagaaaatgacagctctccccgacttagttggaaaggcaaaggccaaatgggaaacatcagtctcttcacgtccatggaagacaatcccctgaatgcaaaattagaacttggtggctatttcctgatccagccccttgtatttttcatgaagcttaaaggagattaatgggacaatcaggatattacagatgagaagcacaggcatttcaaatgaggctgtgacaaatggctgggaggcctttagaatgggggaagagaggatgtggaacaagccctggactgggaagctcctcactatgattcacaccctggtcctgctaatgaccacctggccaggagaccctggagaggcatccaacccttccctgagagccactggacagaggaataggagccccatcactgagtggttgtagggctcaagaaggatcatattggcagcaagaactccagaaactataaagctctatttagatgaatcacattattattaaacagttcaatcaacataataattattaataatagctaagatttattcagtgtctgctattgccagacaatatatatgcaaagtctctagggcttacagcaaccctataagatatgtctatctatccacatcattcgtgcttactagatgctgttacaagtgttttccatatatatgaaggtatatataatatatacatatataatgcataaaatttgtaaatgagttaaatgaggattaatccttacaacaacctataatgtggacattacttgtatcaatattttacagatgaaacaattgaggccaaagagataaagtgacagccaccatcatcccaactaagttggaaggccaaatgacaaaaggaaacataagaacgcaattacctgaatgacagattagaactcagggattatttcttgatccaggcttagtcaatggaagagctgggacatgaacgcaggcacagttggtgaacagtagagccaggattcagactcaggcagcctggctacagggcctgttttcttcaaccccatggcatcctgcctctttttttgggggggggggtggtgggggtggaggggtggggatggagtcttgttctgtcacccaggctggagttcagtgagtggtgcaatctcggctaactgcaacctccgcctcctgggttcaagcgattctcctgcctcagcctcccaagtagctgggactacagatgcgtgccaccacacccagctaatttttgtatttttagtagagacagggtttcaccatgttggccatgatggcacgatggtctcgatctcttgacctcgtgatctgcctgcctcagcatcccaaagtgctgaaagtgacagggtaaggatttgaaactcaggcctgcctgcctgtctccaaccactcagtcttttcttcagccaccctgcgtccgttacaattcacacactgtttgtcaccactggctaatggctttggatatttcttcctcttatcagtgtgagacatctggggaggctcccctttttttcaccatttgaggactgaaagtaaatttagcttcctcagcagaaagaaaagaagctgttttggaggttgggaagagctttagaaaatgcggcatcacgtctgttgccccatttgaagaaagcagctctggaaaaggcctaggacattagttgctacaaagttctagatcattctgtgtggtaagtatgccatcatgcccatagcactcttctctgtccacaaaattcgtcatatactaataaagaatgggtgtctttggacaaagtcaaagcaagtttgtccagagtactaactaagaagagactacagagggaagcaaaaggtagttcagtggctgaattatccaaggaaaggcctagaatttgagttgtcatagactgagcatcaaagattatgtcttggagctatatagaacctttactgcccaaaaaagagagactatggaaacttcagtgctctggtaaacatttctttgatgccttaccaaaacatatgccttctgagcatttgatatggtttggctctgtgtccccacccaaatctcatcttgaattgtattcccataattcccacgtattgtgggagggattccgtgggagataatctgaatcacggggtggtttcccccatactgttctcgtggtagcgaataaatctcatgagatctgatggttttatcaggggtttccacttttgcatcctcctcatttttatcttgctgctgtcaggtaaagaagtgcctttcacctcccactgtgattctgaggcctccccagccatgtggaactgtaagtccaatttaacctctttttcttcacagtctcaggtatgtctttatcagcagtgtgaaaacggactaatatagcatccgttgtccacttcctccttccatcagtctgcaaaattccatttggggatccatgtggcttcagggaaatcaactttatcaatgttctctgttccgtggcagcagtgatgggttcagggatgggcatgtgacctaagccagtccaatcagagtgactctcaggtcttgctgaaagtgcctggaaacgatgccatttccttcctgttgggcatgatgaaggaagcatctagccccaggagctccttcagtcatattagggcctaaaaggtgccagcctttgataaagacaccaaaggatatgaaagatagcataagacagaacggagagatggaaagaagccagatccttggtgatattgttgagccaacagatcaagtttggccttaagtcagccctaattctgtgcttttcaattagataagacaatacatgccctttattatttaagcctatttgtgttaggagttctagtctttgcaaatgaaagcacctaactaatactaatgtagatctctgtggccatccttctggtaaaaggagaaggcagagtcaagggtgacattacatttcctgaaactggcagctccatctcatagaaaactcacgcattactcagtgaaaaaacgaccccctgtacacaatatccacgtgggaaactcctactcactcatcaagacccatctctaatgtcccttctgtctcctagactacatttacgtaaaattaatcacttccttctgttttacttccatagaggcatattactcattcttttatgtaactataaacacagagcaattacatacagctcaagggcagagaatgtcttattcatccctaaatgcatcaaacccagcacaagcacatagatgctggattctccaggttgcatggcctttaacaagttctctaccattctgaccctgttttctctcctgtaaaatagggctaattgtatatgtcagaggattgttgtgaaaaatatcaataacggaagctacaggaatttcactaaaatgtgtttaattatagtaaaattaaattgatacataattttgtaaatcttcaatagtctttagctcaatattgatagccaaaaattaagcctggaggatagaaataacttcttaactctacagttggaaaagtgtgggcatagaacttgtctttgccttctagatcaggtctgtgttggtaaattagacaccgtgtggcctttcaacatccaggagcaagatggcaggagaatcatgccaacaactgaggtaccttgcaggaaatcaaacaggaagaaatcacccaatgggatcagctgggcaaacatgggtcaccccaggtctggtccctcaagtctacccaaccaaaccatatcatagtggatagctattatctttacctgactagcattcattgccccttctggtatgccctattccccactctcaatccctctgttttaagaatgcgcccacctccaccttccatctccaggagtgatatccacccaggtttgctcagtaagactatgagacctatcttcctggctgtggtgattggttcagaagcaacatgccaaccaacctgatccaatgagagtgagttctaggacttttgctggaactactgtatgtctatatataaaagagaatctatctttctattgaaagccaaaggtaagaagccaatatgatatgcatttgattctgttacggaaatccacataaaagaaggctgcccaagtataaaaccaacacagaagaaagcagaggtaagagatggaaaaagaaatgagtgaaccagtgacagcaagagactgaagaacatcatttgattgcctggaatcagctaagcctgaagagaagcctaaccctaagcttttcagttacccaagccatcaaattcccatccccatttttttggttcttaagcagcttgaaccatagttgtctcacttgcatgcaagagatccctgaagatacatgcagttcctcaggtgaagattgccatcagttaacagatcctggcacccatggaccctgggacagtcattctggtagcatcctctggtagagaataacatagtcaaatctgacagtcagagagtatctgccagcctctgcttagatatagcccactgaaagggagagatgattaatttagccttgatttcaaaaccttgtcttgtatattccattcagcactttttatcttcctgtattcccctggttcctctctagctgaataaagaacaatttttaaagcaaacatcttcactgtgtatctagcaaagctttctgcttcattggaatatgtgatttatttaaaaaattaaatttcccatgagacgcaataatttaaattaagagaaaagcttgtctttcttaaacttcagtttctacatacaaattgatgttttatagattccagaaactttcactgttatgaagatggctctcagttttcctgctggattcagattctcttcatgacttaaaacaacatgaggaggatgagtcacaactgtaagctggtgaaatgcagaaagaaccacctaggaattcaaatgtcagcttaagaaagacagaatggcttaaaaatcaaagatgagatgaagtggactgggggtctcgggaacaccaagtcacaaaatcagcttacagtcagagggaacttgcaaatgatctgattcaagatacaaagaaaggttttagttcttgaggactttttccagataaatatttgagccaaagcacaatataagaaaaagatgcaagtggaacagctccttcaagcagtgggggatgttaaggaaaagcagggaaaatcagctgagaatcctccgtcccacccccaagactcctgcaacctagctgagagccacagaactggtcctctctctccggctgttctccaacatcccagagccttaggtggggctacactaagaggaagtcctccaaggaaactctcaggattagaccagtctttttctgctagtggtctttgataagcctacatggtaaagagtgggattcactgacttatctgtagtagatattattaaatatgtctcaaagcatctcccccaccttctcacacccacccattagaacaggatgttatctacaggctgatacctccccactccctccacctcccttctaatacatggcaccaagacactgcctaggacctaacaagtgattggcccctccttctccaagacattcccctcttcctttttctcttttaagcccagagggcctgaccctctaacgcctgtcccagaccactctctccctccaggagcctgccaagttgaacacaaagtcctaccacccctgccctcaacacagacttctccaaaacaagtccacaaacaccattcaggatgattcctgctaagacccacagggtgggagtgataaaatttccagtaacatctaccatgatattacttacaatcctaaaagaggaaatgttctgtattacataaaacatgtccaaggtcctcctacaagtacgagtgaatccgtgcctggttcttctttgtcttcggatcctgccacctcatccctgtcgtcatctgtctaagttttgctttagaagccaccctcggtcaaaccttcactctcttacacaatgagctgggcatcctcagtttccccttcatgctaaaagtaagccccatgttttgtgcatgtgcccacaccatttcctcaagttcttgctcctaaaggtaacagggcctgggtaaggcacttcctgcagagatcaaaggagactcgttcacacccaggaggaggaatattcttcctgttctaccccatttaaccctgtcccctcaacccagaggtgtcctcactgtccagcaagtgcttcaggcctgcagttctgctgttaccctattttgaatctcataggtgtggaagcatgtgttggcggggaggggcaggaaggtttgtccgccaggaagaagaaacgagtgtgtcggtatgtgtgtgtgagcgccgcaatgacagtgctgccaccgctgctgctgcatgtgctgggtctttgaatgtggcatctgtcgggctcagtgaggatgacagatgtctctctgctttatgaacaaacaacacaggcctgtggggtgacaaaaacagcctcagcccaaccagagcggagaggtgcagttctctgggaataatcagaagacagcagcgtaggagtccagagtctaccacacacctgctcccctaaaaaagcatgttctcattatgaaaccttagaaggcagctcccacgccagggacaagtataagggagcctgtgtggcctcattcattaccagatgaaccactcattcagggaagtcttgaggcatgtccaggaaatggcgccccaaagacccagttaacccacagggtgagtgcccacggagatgggagctctgggggtgacactgttgagccagtggatcaagcttcaccctgagtcaaccctaattctgtgtttttcaaataaataagccaatcaattttcctgttcatttctgtatccccagcacctagaacagtgcctggcacacagtaggtgcccagtggacattcgctgaaagaacaaacgaatgccaaggcagaaaatgggggtgagaggcaaagatgtataaaaaaagaactaagcagagcaaagcgataagaagaatattaataatatgaaccacaaagacaggaaagtcatctgatttcaatacacaagagtataaactcattatggatgctgaattacactagtgatagtttaaatatttcttggaactgaatatgcacataagaagagcccatcccaggcttgaatgagtgcacattcttgtcttggagaaaaggaagaaaaatatataaagcaataggtacaatacaatgcaacagatgttctagaacaaaggcctggagctatgattccagggcagcctgcaaagatctcccagtggagctgatgattagcaggccttgaagcaaggatggaagcctggcaagaggcaggtcagtcatcacaggcagggatgacagcttccaagaactatgtcgtctgtgagcccaggggccagagagctgctgggtttcccagtctttccaggctatggccaaactgatgaagccatccttgtttcagtctctgattccttcagagaagaagaaagagttgagtctagcagagtctcactctgcctggacgcctgctgtaccaggagagcactccctccacatgccactctaaacagaaatactccccggagcacctgggacgaccggcatcctctgcacttccaaggccttcactcttcccagttttgcttacttcttctcatcttcccattcacttcccagatgtgtttctcgggtctccaaagggaaactcaggggagaaactgagtcaagctactttaaatctcctttcctacctggccctttccacagcactcagcccagaagaggtgctctgggtgaaacaaagcagcagtcggaatctctgcaggccacagggagggagggacgggtagaatcaaggagtggggcactagcacggaggcctgagcctcctcactgccaggatgagggagccgcaatgatctggggtactggcagctctgggagcctctgaatagtgaccctggggctctcagaagtactaggtcaaggtgtcccggtgggcacagctgggcttagtcatcaagacatgggtacaaacctcagctcagtcaccatccagctgtttgagtctgaaagttacttaatctctctaagcacagatgttctcatctatgaaaggactataatgcttgtcttgcggggatgttgttagaattacatgtgatgaggtctaaattgctcctagtacagaataggcaattggtaactcttaactactattagtgtagtattatcatgatcgtcatcgtcatcatcatcatcattggggcagacaaatctcagaccaggcctgagaattcccaactctgaattcagagccttttgctccagcaacagaaatgagaaggtaaggcctaaagtagaacaagactagaggaggccctgaacagtgctgggcgcccaaacagggacttcctcccaggaggcctctgtgccactggcctggggtctcatcatcaccgccagcaacagggtgactggctgccccctggattttctgcaagcaaagaacaggagggcagagcagaaaagcccgggaactaatgagattcagagagctcgaaaattagaggtgcacgaaaggagtttccgcctaattgctctgacacctcccactcccactgccgagtcactgcaaggagcaggcgagtgcaggagcaagaggggatccataggtctgctggtccaggtcactgctctctccaggagcactggctccagttgggagtggcccagggcctttctgcggcctggcaggacagggtggccactgcccgtggctggcccagaagagtccaccttgtgggtcaagagctgcccaggctgatatgtgccttaaaaagcgggaacgaaagcaaggcagcacacagcaagcccaggcacctcctcagccttgcaaatgggagctggtgatatgggctcaggaactgccatttctgacccagcccagacaaatgtggcccaattctctgttcccttggagctgagcccatttgtagccatgccaggcccagggtctccctcagtggctgctggcagttgatagcagctgtccttagagcctcagctgcctctcctgcgctgtgtcctccctaaggggcttccagatcggttgtctcacgcgaggctcccagcaggctggaggagggcaggctggcaaggcagccacactgcccctgcatcacagaggagaggagggtggcccactgacaggccagaggcaaactgagacccttccgatccattgtcccttccctgcacccccaagaacaatgacttagccccaggacacatccttaagaagagggcatccctaaataccaccagcccccaccccctatccccccccaccccccccaccccacacacacacacacacgatgctgggataggctgtgagacaatatggaaacagccagaaagatttgcattcaaatccaggttgtgtcacttcctgcccatatgtctttgggtgctttatgtaacccctctgagcctcaactgctccatccataaagcggagcatgactgggagggataaatggaatggcaagaggaaaacacagtgcccagaggacagcaggctttcaataaatgtgaaatgctctcagcatggccctgcctgacgtcctgcctcagaccccgccgtccagctcacaggacaagccacagccttgtaggacactagaattgctgccagtctgccttcagttccctttgttgtttaggagtctcccctggactatcagcttataagaagacatgtatccatcacaagggcctctgataaatctcttcacggaccgcttgcttatatcaagaggcagaacatttagaaaagacatagtgcctgctgctgtctgggccaagccatcccacaagcaggctgaagtgtgagagaggcagatacattccctttcaaaatgtctatggtcccctggtccatgatataataggagagatgcacagctggcttagcttgcgccgtctcccaatgcggacaggcacctgggagagccaagatcgttagccctccaggcaaaccattcaagtcctcgtgctgtcaaggtgacttacaatattgagagtagtttgagattgttaagaattattattattttttttttctgaaaaatacacagtgagtttctcaactccagtttactccagctaacaccacagctttactgttcctcttccaatcaatagtggaatgaaatgatccagttggaattccagttcaggccacagagctgacatcttctggattcccactcctggggattctcagacccaaaggcaaaatgggccctggtcatgggaaagtccatggctttagatgggcagaatctgcagccactgaggctgcagcacacagcagggaccaaagccaggaacagccaaggacactcaatgccactcctgccttatgccagccctcagggtgagtgcataagctcttcccataaaaatggcatttgcacccttagtaaccttttattcaattcaacttcatctagtcctagtaaatagaattacattacttccttgcttaaaacacttccatggtgcctatgcaaaaatgtaaaatactttctctggcacacaaagcccacatgctcttgccctcctctccagcctccttcatgccagtcactggcttggccatccaattcagactccctggcttcacttctccttccttgactgtgcgtagctctttcttgctttgtagtgagacatacactcctccccgtctttgtccagttaattcctgctcccttttctggtctcagctcaaatgttgcctcctcaagaaaaactcccctgactgcttcccagtacaatttattcccactcctgcccccttctctcctatagttccctgttctttttaaaatggacttgtcaatatgcatgacgatatgtttttgtgtttattgtcctcgctctctgaccatgtaaactctatgaagccagagagaatatcttattctctcgaccagtttgcacaatgcctgacacctagcagatcctcaacaacctttgttgaataaatgtgtccatttattcagttctccaatgtctgacttcattcaatcacttataattaaaatgccaatttttataatctccatgaaccataaattaagaaatcactgtgcggccgggcgcagtggctcacacctgtaatcccagcactttgggaggtcaaggtgggcggactacctgagatcaggagttcaagaccagcctggccaacatagcaaaaccctgtctctactaaaaatacaaaaattagccaggtatggtggtgtgtgcctgtagtctcagctacttgggaggctgaggcaggacaatctcttgaaccccagaggcagaggctgcagtgagccaagatcgtgccactgcactccagcttgggtaacagagcaaagctccatctcaaaaaaaagaaagaaaaaagaaaagaaaaaaagagaaagaaaacactgtcttccaagctgtgactggaggcttacattaactcatttatatttgtagttagtaacatcaccatttttaaatgagtgaaccctgaccccaagaagctaagtaaccttataagtcatagaatcagtaagtggcaaaaccataattgaaacctctggctcataacttctcacttttcctaccaaatgacacaagtggctacaacctgagtggccaggcctgaatgggtagccagtctagaactgccttggtccccagccccacagcacctgggacaagacccagagtggcatcctcctcctccacagcagaggagactacttaggcaatgagatgaaattggcacgtttacctgcctctgattaaacagagtttttactggacagcagttgttgaaataatttgggctataaataaataggaaccgggctagaatctgaacctgcttacaaagctagtccttttccatttgagtcataacaaatccaatccactcggggaaaaattaggaaacaagggggaaaagctttcagtttctgtagcattttaatgaaggattgattgaggttttatgcagcaagaagggcacagctggggagtaattgccaagaaaattgaggtgcaagagccatttacatagaagaatcaactaaggttcctcaccagtgctcaactgaaagcagtagcaattggaccaaatgacaagcatcacaatctcactctctagcaccccaccctaggaaacaaagccaccttgtcactgtctccttcaaaagtaccacaacccaacccaagacaggcaatggcaattcatgtgcatcctccactcccaagccttcagcaacctagatactttgtctggggaccttctgaagaggaggctttagttgacttcttcaagatcacttactaccatagacgatggctaaagcaggactgaattccagatgttatgatcctagagagtctctcaatcaatggtagaactctcatgcacaatcttctttggttgggggcagaggaggggtaacttggagcaggtgatagtgtggctcccgacaggctagccactttacaaggattcaccttctgtcccttcactatgtatcagaagctacactttatggccacgttttgtttcctcttttcttcctcttcctctttactgtacctccatccatccttttatagtgccgctttcaccttggtgtgtgaacttgccgctgacttcccaaatgagttctgagaaccgatttcctgtgctttgtgctctgtgatggttcagcccactcatcacacctctcatggagatctctggcactttggtgggccctacttagaaaccatcttcctccttgatccttcactaacaagttctataatcttaacctcccagggtctcagttatactacctgcaagatgggcagaagaattccagcctagatccccacacaaatgtaggaaatccaaagacaataatatataagggcttggagaaaagaataaaactcagactgcagtgaggtgaataattcagtgcatcctccttatgcagctggagttaattccaaggaagcactttgcaaattctcaggtactatgcatgttctttctttctttctttttcttttcttctctctctctctctttctctttctttctttcttccttcctttctttctatttttgagatcacgtttctgtcttgtcacccatgctggagtgcaatggcacgatctcagctcactgccacctccgcctcccaggttcaagtaattctcctgtctcagcccctggagtagttgagattacaggtgcctgccaccatgcccagctaatttttgtatctttattagagacagggtttcaccttgttgaccaggctggtctcaaactcctgaccttaggtgatccgcccacctcagcctcccaaagtgctgggattacaggcatgagccaccacgcccggccacatgtgctttttaacatttttattatttcatttttggagtcattattatttttgttacaccacacaaattgcaataacattaagagattgagatgatgatggtatgagggtggtgttggtgatgacagtgatgatgacagcaatgttgctgatgttccatagtggtaatggtgaagatgatggtgatactggggagatatgatggtggtggtgatggaagtgatgcttacattacaagtccactctacacacacatgttctttacaaatgtggatgaaccctatctcctgcatggagtgggcagcacagattgtggaggaagctgttttccttccctggcatcttctgttcttggaaatcaatgaatgtccttcattattttccccatagttcctaagaggatactttcctgcttctgaaacattcactatttctataaagtcagtttgtcttcattctgtaagctcctcagcaaccctcactatttgccatgatgctggtcaccgggcctacaagacatagatcttgtctttgaaaagcctgtgttcctagggagagaaacatctgaaaagtgaaagaacatgagagcaaaatagcatgcatactgcattagaaggtgcaccctcattccgcacgggtgtgtcagggactggcagggtcggggatggcttccctgggaaggtgcctttcaagctggccagtgactaaggggtcactcatcctccagggaatgggtggatagagagcactctaggccacaaacaaagcagagaatatacactgctgtagggtatgatctgagggatatgggagatttcaggggaaagagcttactttaagttttttgaagtgataaaatatttgaattttatcttggaagaactatggatccgttaaaggtctctcagcgtaggaatgaaatgagctgaatctgcatgttacgatgtttcctctgtagagcctaaccccctccacttgtgttcccaagagccccagcatcactcaggagcttataagaaatgcagagtcccaggccccattgctaaacctcttgaataagaatctgcacttttcaaaagtttcattttctaaattactatacagtaaatttaattttttatttttggtgtaaagttctacgaatgttagtatatgtgtcaatttgtatagccaccaccataatcaagatacagaacaactctgccccaaaaactatcttgcattatcctttatgatcacacctatcacccctacccactaataaccactaatctgtcctctgtcactacagttttacctatccaaggaagtaacataaatgaaattgatataatatgtaacctattaacgctggcttttttaattgagcaaaatgttgttgagattcatccaagttgttgcttttatcaatagttcattcttttttgctactgcatgtattcatggtaaggatgtatcacagttgttttagccattcacccactgagattcttcctagttttgggtaattatgaatagagatgctacaaacatgtatatgaatgttttttctgtaaacttaagttttcatttccctagggtaaatatctagacattgaatttctggtaatatgctaagtatatgcttaattttataagaaaacttctaaactgttttcctgaatagcaacattgttttgcattcccattagtaatgtctgagagttccagttgccccccatcctcatcactacttggtattgttggtatttttatttcagccattataataggtgtgttcacatctcatcattgcttacacttgcatttccctaatggctaaagatgctgatgttctttttctgagcttatttgccatccaaatatcctctttgatcatgtgtctattcaagtcttttgcccattttccagttgggtagcttgttctcttcctgttgaattttgagagttctttatatatcctggctataaagccttctgtaatatatgtgatttttaagtattctctcccattatgtagcttatcttttcattctcataatagtatctttcacagaataatagtttctaattttgacgtgtctaagtgatccatttttcttttgtgaatcatctttttggggtcatgtctaacttacctaagttcagatcagaaagattttctcctatgtgtttttatcaaagctttatagttttacacttatatctgtgatccactttgagtcaatttttgtataagacatgaagtttaggttgagctttttgttttgttttgtttcatttgcccttggatgtccaattgttccaagaccattgtagaaaagactccttctccattgaattgtctttgtacctctatcaaagcaattgaccatatttgttgtaggtctatttttggactctagtctactccattgatctatgtgtctatccctttgccaatatgacactgtcttgattactatagctttatagcaagtgttaaaatcaggtagggcgattggtgatttcttcaaatatacacttctttttcaaaattattttacctattctagttgctttgccttttcacataaattttagaaattggtttgtttatatctgcaaacagtcctgcttagattttggttggagttacattaaatctgtagagaaatctgggggtgagctggcaccattactaggatgagtcttccagtccatgaacatggtatgtcttgccatttctctaggtcctcagaatctgcatcttaacaagaatcccaggtaatttccctgtacattagagtctgggaagcacagctctagagtggaaatgacagtgaagtcatctgggaggatttacaaaatatggaagcctagacctcactcagaccaactgaataagaatctctgaagggggacctaggtgctggaattttttctatgtcttgtaggtgattctaactggcagccatgtgtgaacctctactctaaacccagtctgggctcttgtggctctggccctatgctcattaaatcaatctgattaaggccatcagttcattccttttcaaccctagatgtatattggaatcctttgaggatagaggttacttcaatgagaattttcaagaaaaaattctagttgacagattcaccaaacttcctctgaggccccacctatatttgaggattacctttccctgcccaaccccaggagctagaacaacattccagaagttttaactctcaactctaaaaacctgctctctttttggaagtctctctacaagttactgaggcaggaggagacagaggagagagggaacatgtgtgcacacaagagaaatgtccaattgaatgagtctgatcaataagatctatgactcaaaaatacttgcttcatggcaagggaacatcttttgctttcatatccatctcacatacctgctgagtcaaggaaacagctccatatttaggagaaaaatcctcttctaatctctaaatgcaatcgaaggttttctatgtctttttctgtggctccttggaaatgttaaaggcatgtctcagctacagcaaggtggggcatgacatattgccccccaaaatatgaaccaattgaatgtcgtctgaagtcagctctgtttctgttatcttttaatggattttaggtaaagaagtgttgatgtagataaaatagatataaaaccaaattcttctgctttggatgtgcaccaaccccagcaggctaaaaatagattcaactgcatcaataatatttctctttaaagttgcaggtcctttgggggtttggaaacattcagagaggataaaaggggagaaagatatgaaaacagcagaagctgcagtctaagcctccaggtgggggccttggggacagccatgctggaatgcctgatttttacatgtccaagtacctatttcctaccaaaaaaaaagcccttccacatatgataagaacacatcttttcttgcagggctgtcaagttcattctaaacacccctgccgctgcctgtttgagattgatgcctctccaatctctagctctttgtttgaaattaaacatccaaagacctttagaataaaaaaagtcaacatacaaatgaaatgcatttcaacatgcatctcaactgcagaaccacagcatgttgagactggaccaagcaaaccctgaagaagtttcccctcttgctcctctgtggtagatgacctatccaagttcacacaacaggtaacatggagcatgtggagagactcagcataggccagtgcagtagcggggtctactggaaaagacttggcctttgaagtctcattccaatcccagccttgcattgaccaactctgtgaccttgaccttgaaaaagtagagtcacagtgccctctacttcacagggttgtttggagaattactgaaaatgtgcacaaaatacctgatacacagtggggcactcagctaacaccagtcattcctgtaatccaggtctcccaacttctagtccagtgctctttgcacaacaacaccatatgaagactctgagctatccaaataagtgcacttgaaccacaggttaaatccccttcctctcatcagaaatacaggctagcaccgcccagcgttctttaaagacagccaggaaaacaaaccaaattcatactacttacccaacactgaacgagacacgctggctccctttcctttattttgtttcccttctatttgtcctgggtttgtggttctcgggcaaggtgaactctgctcagtatgatatgtgacccctggccacagttgcatatggccctgcctcagttgctgcctgctccttacttgattctccaggtccacactcctttcctgtgccatcttcccctgtggcacctgtgtgtaggaatcttcaacagctgcaccgccaacagagaagccacaagctggagccccacaagtttccccccaggccccatgcatgggtcagcagtcttgacccctgggctgattttaatattttaattaaattgacaacatgtaaaaaatctggagatttcacaacaatgcagatttctgacttcttttgacaaattacaaactggccaaatgtccacagctggccagagctgtgaggcagctgctcccttcatctggaaagactcttgctccactggtcaaagtccccaccggtcccctcattgcaacctcaccattccctatcaacctctgagttttccacccctgttatgatatgcacttccagttctccagctggacactcaagatgtgtcaccacatggcccactgcacttattcaatctcttctcctgggaaccctggaaaatctctctgcttctaggctctgctgggagcaattcccctcctacaatgtcctccttgctcttttatttatccaacccaatcaagagtatctctgcttaaaaaattcttgctgaccacccaagccacaaagagctctcctttccttaaagcatggagtcaacagttatcttacctaccttcacatagttggttcttcctgtttgcacatcctgtttccctagctaaattgtaaacttcttgagttcacatttgtttgccttccccagaaggcagccacagactttccaaagggaaagttctgaacaaagattaattgtttggtcaggagctatcaaccatatcatcactcagtgcaagaccagtctctccagcctcttttgcctccactccacttcccttgttcccctctcaaatccacccaaacccccatcctcctggaatcactccaaaaggactagaatttgtttcctgttttgcccacgattgttcccatcgctgccactccccagggctaaacacagaacctgccacataacaaaagctcagcatatgcacattaaatggaaagtgccttactttttagtccctatatcttaacatctgcagttcaccaggctgaccatgcccttctcccttttcaccaacagatctacgggtcttggaaatcccagttcagtgttcctctctcaatctttttctcttcctttactcagccaagtcactcctctctctaggcgccgcagtcctttgctcttgcctgccacagccattgccaaatgttggtgcaattgtttgcccacacctgtttttcccttggatgccaaggtcttccggatccaggattgtgtgatcttcttccatgcgcttgcctggttccccaagtcataactggacataattagtctggtggagaaggcaagtattatggccctcatttttccaatgagaaaatggaagcaaggcaccaggctccctgcatgcagcagagagatggaagaggaagagaggagcagcttgggtgagaagacttggttctattagcaggggtcaagcaatggaatggaaatgtgtcatgtcctttcaaggtcatctgtggagcaatgtttaacagcctgcccaagaaatatttaattacctagaggaaagtaagtacctttgttgacttgatatttgctaccaactaaatagccagattatgtgaagttacacattaatgtgtaggattttgcctagtagaaatacaaatgttttctgttcaggagaaaagataatctcaaagtttattaattgactcccgtgtaggacattaaccagttttgtttctaatttagcaatctcattccaacactcttcctccagtgcctatgtaaactcatgctgccatcttgttggtttcctcattaatgagctaaatgcatttttgacatgtccacattctagatttgtatgagtcacaattttaactttttgaaaattatactttgccacccaggtgccaccaactctgggagtgtgagcaagtccctccctcccctcttctggactcagtttcttcaacagtaacatgagggcgtaggtctgcatgggaaattacaagccccaggaatatttgattttaagcctgaatcttaaaaagaataatttcctcatagggttgaacatcttacggagttattttccaaaataacaacaataatgggacagtgcttcatacctggggctaagtattttaattctcacataatgagatggggctattgttcctagctctattacaggtgaggttaggaaagctgaaacagtattttttttaacgaggagacactatgtttgtccttccactcatgtttccttccattcttcttttcacctgtctggtcatccatgtttccagtcatccatcccactgatgcaaaaagaaggtggtttccattttcactctggatctatctaattgactatttaattgatgtggactttagtagaggcagtgattgcttccagttggtgggcccaggaagactgtgaaaaaggtaccactttcagcttgaccctgaaggttcaagcagaattatttagggataggttgaagaagcatctttgcctgaaggaaccatggcagggacaccagaagacaaaggagggagacatgcacagtgaccagtgggtggttatggctgtgggaagggtggataatgggagatgagatgaaaaagattgattggtcttggcatatgtcaatggctgattgagaatcttaagtttccttgatctgaagccctgtccacaatcacccagactctgagtacttcatgtggtagtaagaggcagagacaaacccttccccaggtgccctgatctggccaagcctgggcgctctgactaccagagtcctgaactcttagaagggagagctgcaaacaaccatggcgggaatctactccagcctcccttcccgaacatgtgggcctgagctaatttaagctagtctgagctcactttgcaagcagttgtcacaaggtgctacatcaaaagactcccaaggcccaaatatttaacaaccagaacactccctccatccatcagtttggtaattctatccacacaaaaaaactattggggtttcatttctggcctgctcatttcttataaacatgccagggccatttacagctcacaactcactgctctctaaacatttacacatttctccctcttaacacatccttggctatttgattaagtagtagatcacaggggatggaaggcaaggccttggcatctttgggttttctccaaacctatcttgacatgggttcaatgccagcctccccttccagtaaacacaaggattattgcactcctgggcacagacttgctgatgccttggtcttttctatcccttctcttgcagtttctttaggtaggagggaatacaaaccccaaaaacaaacagacatgagtccattttaccagctgggtttaatgggaaagctggtagggttccccatgacccctaggactgaatgagtgcccacatttcacaacaccctgattccagacaggaagcttggagaagtatctatatttgggggaaggaagctgccccagacacagcttcctggactgttagcaaaggaatctcacacaaggcctaaaccagtttccatacaacttccttgccttttgggaaggtgcaatctcacaggactggtgggacttacccaatgcagtcatccaaaaacagttatggccaacacctaagtgctgagaaaagtcaagaggaagaggaagccccaagggcagagaaagtggtgaaggtcacagaaaaggcatggagctgtggcaccattggcgggggacagctagagtccaggcacagagctaaaactgggtatgagcaagggtaggagaggggacactgctgaacacccacaatggtcctgctcctgttggctctgccttcaatctcaaaggcaattatgaataaaggaaagcacactgccttcagagtccgacctaagtttgaatcctggcatctttcccagctggccgtattacccctaggagctactcaacacttcagaacctcactttcttcttcagcaaaacagaggtgcaggtatatatctcctaggagtgacaagggaattcacgcggctgttaatgacctggtgcctgcctggggctaccaagcagccaccacaagagtcctccataatagcatccaccgcactgcagtcagggcaacagcactgcaagcacttcatggacagagaccaagcctttccaacttgatctgccatgtttcaacacagtgcctcagccattgagaaaatcctgtgacaggcacagacccccttcaagaaggacttgctgctcagctcgtgagagggttgtcagcagcttcttcagggcttgctcagttgcagagagctacctggccagaggtcatgcccttcaggggcagcccacctcctctgagtgatgggagtgatggaataaaggcccatgtcagcccatcccagcactcattccagcacaatgctggcaggccatcttggtgctcttggggctggctgtggctgcatccagcctgcatcacgactcaacctctgcacagtcctgctgccttcccctcctcccgtgggtatgagcctccagcacactcaacttcgtgtcagagcttaccttccaagaaccctacctgcaatgaacttggtatttgttgatgagtaaatgtctgaaacaagatccccaatcttctaaatccagagttaaaactcagacaggccacggtccttggtcattctaggtccaagaggctcttgctgctggcatggccaagagatacaggtaagtaaaacagtatactgtggtgctatgaccacccagggggctgccgtgtcccactcaggaaaatcaggtacctagttggcttccaaaagaggctggggaaattttaagttgaggttgggctctgtagaccttctccaccactaaagcccccaggtttatcatttcccgggagaataggtcctgggggagagggggagataacaatggaacacaccaaaagggaaccctgtaatggaacagtgcccactaatgtttattttatcccaggagtcacagaaggcctggaatggctgcgatggagataaaggatgaagggtagtcccctcagggtgttatccaaaaagtcaccttggaagaggaagaaactcctaccaatatcagaagagcaacaaacatttttttttctagaagataagtggctaatttcaaaataattattttatcaactgccacataagtttttttttttttaattcattaaaaaaaaaaaatgaggccgggcacagtggctcatgcctgtaatcccagcactttgggaggccaaggtgggtggatcacctgaggtcaggtattcaagaccagcttggtcaacatggtgaaaccccatctctactaaaaatacaaaaattagccaggagtcgtggcgcatgcctgtaatcccagctactcaggaggctgaggtgggagaatcacttgaacccaagaggcagaggttgtagtgagccgagatcgtgccactgcactccagcctgggtgacagagcaagattccctctcaaaataaataaatacatacatacatacatacatacatacatacatacataaaaatgaaatgcttcccttttcaaatgaggagtgggaacacttagattacagtgctaagttctttttgtctgtgaggtaaggagaagagcctgcgcctaggtgaccttggcctggtcagagatgctgggacagcctggacgtgggaaagaagggatctacgcaggtctgtccacagcacattccagggcagcttcctcccgggctgcttctgtgccagaacctgctggcctcaggagccccagctcacctttcactgaccttcagcccacaggagaacagcatttcctacctcccccacctgctgacaaggcctctctctttcccacgccaaggacaaagatgacctctgggggattccttttagctggctcataaaaggaagagagatgggccaaagagaaagagctgctgggtccttccccaactagaacatgggaaatgatgattttccagtagggaagtggtggccaggcaggcaggcgtcgactagatgggtccctctggggtgtggtggaaatgacctcaacttcaaagagacagacttccagagaaggctggcattagcatcctgatctgctctactgagaatcccaagggttttgcggaactcttgctgggccatgaggatacagtctcctcctgaccccaatcctctaaccaaagcagctaggtttcagttagtgtacacagagctccaggcctctaagagtgtgaaagccactgcctcaggagatatcccttgctggagatcctgggaagtagaggctatggaggcagaccacttaatagctgtgcaaccctcagcaagtcattcatccactctgagcccgagttccctcctgtgtaaaacagcagttatcacagtgcctagctcctagtctgggtgtgagagttcaaggtgaggccaaccagttgcttcactccgtgcctggctcatagtgagacctcagtaaatgtgagctattttctttcaatgaatatttgccctttccagcatcacaaatacatgagcttccaattctagggatacaaagacagaggggctttatttctttcaatgagttcagagaagtccctagcacttaaactgctatacactgagagagtaagccatagttctgaaaatgctctgtgtgctcattcacctgaagcagcactgggggtcactgcagcctcaggtgccaccgagccgacaggccatgaaaagaacacccactgactcactcatctgggtggaatggtttcatggggacccaggtgaggtggtgaggttgctgcttttttatgtattggctttttctgcctccccaatgccccacttccgtcgcaaaagtgtctgagttctggagcaaaggctcagctaggaaaagtttcagatattttctttgtcttaacccttcagggagaggaaggaaaatctgtctcttgccagggtgagggccaccaagcgggttagctcactctgccacattctgcattttctaccttcaacacaatggacagtgggatgtctctctcttgccatatgcattcaagagaaaagccctggtttgggtggggctctggtttgggtggggtttgcattgggtctacagccactagcaacttgctgtagtcaaggcaaatgacataagctctctgatcctcagcttcctcattgtaaagagagctcttagctccaggtctcattactttcagggtatttaggatgtttagatgccaaataagacagcagaaggcagagcaccttgacaagcataaagcactgtatgcaaacataaagcatggtgcaatctcacaggactggtgggacttacccaattataaacaaatttataatcacatggcaggaagggtggaatttcaagatagaattattattcattgtaagatgacttgtgtaatattgtaaatgactgctcttcaccccatcctctgattcaaattaaaatcctcattccatggcccctacatgtacgctcattttcactgttcagttacaagcaacaagatgagacattttgacgcccttggtaattgtctggtttctagaagttcttggttcacaggcctaagcatgtttcatttgatgtttggcaccatagaaaacagtgtatgtttaatgatttctgtgttaaactgaataatgaataaccaggaaagacaacagaccaaatagcaacttcttgatacacctgcttgacggaattctgagcctttttcccactctatcaaggacaactgcctaatggagagtcagaatatttttctaatacaaataaagtaaaaaagcaatgtaatgttattatcttttaaagacagaaatactattaaatcctcaaccatttttaaattaaagcataaaaccctcttctacccaataagcaataagaactcacttgaattccttttcacaggcatttaagggatactaatgggtacagacagaagagggaaaagtacagaaaggaaaacagcagataaatatatagaagcagaaaacaagagtaacagaagagaagcagaagagactaaggaaggcatctaggatgcagttgtgaagagaaaatcagacatatgtaggcagaaaagaaaacaatcaaacaaacaacaataataaaattagaactaaagagaaactttcttaaaggaacccataattttggaagcttatcagtagattttaaaagtagactacagatttatgactacaggagtaaagggtgtgttactcttagtaattgtttccttaatgacataaaatcacatcaagactatatccagctcatgggccagcagctccccatccctgccccataatgctgcactgtattatgtttcaatacaaaacatttggtgtccacttgggtcagcacctccatcagactgccatcactaagggaactgagccagcctcccacgtcagtttcctcccctatgggctccactgaatggggatgaatgcggtacctactctcatagtagggatatgaggattaatgaggtgatgtagaaaaatcacctggtattgtaggtggcatttagtaaatccttcataaacactagtgttcattattagttggggttacaaatagttactctcagagggggaaaaatgaatgaaagtgtgtgaacaggttaaacaaaatattttggaaattttatgttgtcgtctgaaagttctttcatgtgcatctaaaggcatcacactcactgtcaccctcttcacatggtgggtatcaatataaagaacattcttcaatttctgcttgactgctacatctcatttctgtctctaggtttccactgagccctccagctcaaggggcctccctccgcatgagtcgtctttaggaagcccagcctggtctctaattttgagaagcatttcccttatttcaggtcttcattcagccagtggttcaaccactgaaccacttcagtttccttccttcattttattcacaaaggaatcctttcatctacagcccctagctgggctcctttgaagagactttctcttcttgcattattttcttggtcagccttccttaggaaggaattaagacacatttcaggaaacgggcagaaaatgttaatccttctctccctcattgtcctactcataaacgcttactccctcaaatgcacccataaataagctgtagatccacatctggttctgagcccagcacatagtaggagctcagatgaatgatcacgcctgacttctcagccttgcttctgccatcccttcccctgaaaaatctgctcctctctacttaacctagtagaaccctcatgaaagctgttgtccctgttgaaggaatgatgccccaagcatccagcgtgtctgctgtttacttcatgcaccttagtggatgtggtgaaatgaaatgacttttccatttccaaagagaaagtgcaaagtctccaaacttatgacctctttctcagaatgccaatatttacagcttagccctgggcaaccctgtgcttttctgaccttagattcccatttggagtggaaatggcttttctatttctccccaaggttctctgaattagatgaccaaaggagaacttacttctaccaagatgggtctatgagacccattcaggctctcatccattcgttcaacagattcattcattcagcccctactgtgttccaggaaataagtgtcaaccatacaggagtgacccagacaaaaagccctgcttttatggagttagtttggattttagtggagacaggggaagatagatgataagtaaaataaataaagtatatatagtatattagagaattataaggtttataaagaaaaaatgaaagatacaattagtagggaatggggataatttaaaatagggggaaatttataaacataatggaaaatatgcatgtaagtaaaattccttccaaaaaatggaatatttaacactaacttgcggtgtaaacatgaacacatcatgggctccctccaggcctcggtttccttctcggcagtataaggtggaactacaaggtatctctatggtagcttctggcactgaaattctctttctctacccaatagatagcaatttgaattaacactagagcctgttgggacccagtgattgtggtctaagtttcaatgactttttttttaaatccctacattccttggggttcccagcaatgtctccagtgggctgctggtccaaattaattgtgagagcaaccacaaattcccttgtttatatttttgaattgttgacttagaatcagttttaaatctgagcccttcttccccacagatactctcaaaacagcctcctgataggcactaacccctaagaaggtcatcaagtggggctctgagagcaaggatgctgggcaacccggcttccaatgccacttatcctagccacatgagtactcataacaggcttgacgtcaattaaatcatactggccctgagaggcgccacccaacaaactgtttcttcttcgtggactttttgttccctctttatttattttccactgagctacaacaaggctcaggaggaggcccttcatctaggaagagtcatcttgggaccatctagggaggaaaaggcatccatcaggcactcatcagccacctctgatgaaaagcttcctttggggtaatttctctgcaccaccgagtaagccttctgcctgctggaggagctgtggtgagcatgtgaagggaggttctgaaggcttcagcagcagccaccagtccccctgcagcccctaatgagaggtgatccttgttcaactcctgctatgtgctagacacattctaagcactttacatgtattaactaacaagtctatgaaacaggtgttatcattattcccattttacagatgaagcaagtgagacacagtgaagcagcttgtccaagatgacagtttgtaattggaggagaagagcccctatcagcatcgctgtccagaagaaacataagacaaaccacacaggtcattctaaattttctagaaggcacatttctttgacacttattttatttacaactctatgcaaatttaaagacaaataatattccaagtggggccgggcatggtggctcatacctgtaatcccagcactttgggaggccaaggcgggtggatcacctgaggtcaggagtttgagaacagcttggccaacatggtaaaaccctgtctctactaaaaatacaaaaattagctcggtgtggtggtgggtgcctgtaatcccagctactcaggagcctgaggcaggagaatcacttgaacccagaaggtggaggttgcagtaagccgagatcacaccattgcattccagcctgggagacaagagcaaagctccgtctcaaaaaaaaaaaaaaaaaaaaatatatatatatatatatacacacacacacacacatacatatatatacatatatacacatatacatatatatacgtgtgtgtgtgtgtgtgtgtgtgtgtgtgtgtgtgtatatatatatatatatatatatatatatatatattccaagtggaggaaagaagttttcagattgctctcacttgtaactcccatacattaattttcttgtacatttttctttaagattataatgttgattgcctcctaacagtcatttccatccccctccctcattcagagaaccctgattttgttcaggggtgcaggtacctcaccaaaactgatgctggccccactcctgggcagacctcgattagtctgagcaagccctggtgctctcattcttatgccaacaattggcttaggaccgacctgtgactggttcttgacctgtgaaataaatgtgcaggtgtgctgggggcttctagaaatgtgggccagactgctgaagaagaggcctggagagatggttgcttaacctcgagatttttttttttttttgctttctttttagtatgataaaatatacataagataaaatttaccatttaagtaatttttaagtatacagctcagtggtattaagtacattcacatggtcgctcagccatcaccattatccatctagaaagcatattttttaaaagtaaaaagaaaaaagtgaaattaattttaataatggagtttaatctatacaaaatattatcaataagtaatcaatataaacattataataaggtttttttacagtctttttttgtactaaatttccacttacagcattgttgcttttttagagacagggtctctctggagtgcactggcatgatcatagctcactgcacagtccttgaactcctggcctcaagcgattctcctgcctcacctccaaagtagttgggactacaggtgtgcactactactcccagctttacagcacacagcaattcatatttcagatgctcactgaccaccggtgttggactgcccaggtttaaagtttctcaggcttgtgcgtgctcagccagctcatgggcatctccaagggacagcagcatgctgtatgtttatgaaagatttgtgcgtcaccatcagctctctggggcagtttgcgattcaccgcaggaccctagatggtgtctgactctaatggttctagatcagcctctctaacccccgcggagatcactggcatcacgctgatggacaatacaagatctgaagcctaaatgagagcttttcctggtggagcaaataccgtgcctccatcacccagctgtgatttcatctcccagttgagaacatgacctcaatggcagaggtagggacaacacctatgcagctgcacaggcactcccaggttggaccaataataaataaacacattcctacttggaaagagggcagcatgtgtgcagggttgaggcaagccgtggttgccatggaaaccagccagcatcactccagactttttccctggtgctcggatcattggtggctgacgaagcccagtggagaggcattgttcctgtacttatggaaaccttccaaataggcccattatgatgaaagcacatcaaagagggaatgatgacgtacctttaccatccatcgtcacatccactgtttgtcctgggtaatacccaaaagagaagaaaataaagccactcttgccacagagggaaataactggagagcactgaggtatgacactaggggtagcaaggtggtccccaaaggggaggcaatgaaactgccccatctcaccaccatagtgaatgctcgactggacaaatggttatggcttcagggatttgctacctgcccaagctgacttacaactcactttctatggcaagcctctggtttgctctctttctggagccacgtatgtttgagatcttcccattcattcattctttcctatgcccattcattccttcactcattcttgaatgagaagcaccatggtaacatgaaaacagcctgggtcatcgagtcatgagatcccagatttaaatctcagttcagatgcttattggatgtgtgatctcacctaagctattaaagattctctgagccttggttttctcacctgtaacatggggacaagagaagaataatgtttgccacttgtcttctacacagtcatactcaatgtgtttatacatgatttatatctcattccattttgatcaacaattacccaacagagagcctggtctctccagatactcaataagattattgaattattgattattgaataaaaatatgacaatgtgctttcacatatatttcttctctctctctctcttcaaatttcattttcacagcaatctggttcaaggttgtttcagcccagcacaggacaaagaggattataaaattaaaccacatgtttctgactctcagtgaacttacagtttactatgttttattaacaatgtatacaacacttagtctgccccagctactgtactaagtactttataaatattaggtcatgtaatctgcataataaccctatgaggtaagtactacgattgtcttctgtcactggctcagggtcacactagtacatggcagaacaaaggtcaaactcagccagtctggctctatagcctgtgctcttaaccactcagcctcattgcctttagagtggataagtcacattcacaagtgtatgcgaatactctccaagactgatggattcagaggaggaaacactatgcactgcatcttaaagatgaggtaggatttgaacacatggagtgcatggaggagagcagaagaaggacaggttggaaagaggataggggccctgaccatttgcttgaagtgtttgggctttagaccttggaaagccactgaaggtctctgagccatggggaaacctaagcaaagctggctttggggaaaattcatctggcaatagcatgaaagatggactgaagcggggagatgggacaaatgaggagagtgacatgtagctgctataatgagtgaaggaaggggtcacagggcttaagccaggacaatggaaaaagaagcatcaagggcaaatccataggacgtgcctcctaccaggatgtaatatgtctccccgagtttcccaccaaaactttcacatcagaaacaagttccaaggagcactcactgggcactttcgtggccatccagagtggcacatgggtgctctatagcactgctttcctcaaaggaaacatggggtcatcttgagcagctggaaacactggctgagcctttcctagttgcatgcagccatttactgaggccaagggggcaaaatctaatcctgacaaagaatcctggccacctcaaatgcaaaagatagccaagtacaacgaaccatagtcccgtttgttataatgtcctataaatcacagcctaggccttacagttaatagggctttctattccaattcccattatgctggaaggggaagaggaagaattgaggaacgaatgaggagtctgagagtgagttacggcccaagaatatgacttgtcagccgtcttccaagctctaccaattgcctgaaattctctatccagtcgtaggtttgcataaattcctggagaaggctttgtctgataccacagtgaaacagatgccagggtgcaggcacaacaggtagactcataaaactggtaaagagaactttgctttgacaaaagctggagttttccttgttatttatctttcctatttgaagccttgaaatcccattttcatcttgatggagatgataaactcttagaaaacttttatggctcccaggatgaaactgaggactctgcctctgctccccactgcaattctggcaggcttttaaattcaagtcagggcagaaactgtttttggtcagaggcaaaatgtatttatctctgtaagcacagccattaagatgtgagcatgaatagctaagagaaagaacattaagggagaaacaggaagaaatagaaggtgaggctatgatggaaggaaatgatgacgcatcaacccccaccaaaagctttttacagtgccgggggagtggggcacagggaaaggcatctgcagcgattgggagaaagaacccgggagtgggctgaggggaaggctttgcagtgggagggctgtgatcagcgtgtgcttcatgcaaagagaattttgagagtggacataacaaacaggaaaattgtgcttgcatttctgtttgtctgtagaatcactgtggctctgaaatccaccccctctgctctccaaacactaaagaaagtctccagatggaaaaatctgaagtcaggctgcaatatgaaaaaagaaaagaaaaagaaggctgctacaggaagctgacaaatttgctgtttctctgaggtctaacctatgcagctggggtatcaaatactagacagggtcaggagacatgtctgaaactgaccaaatgaccttggacaagccccactttaatcacacataatgtaaactttagggaatgtgacctagaacaggtagctaaggcacaaataacactagtactaccaccctccaagctggcactcatggcaggcatcattagtcagtcatggaattgttcttttcttttcttttcttttcttttctttttcttttcttttcttttttttcttttctcttttcttttcttttcttttctttcttttcttttcttttcttttctttttagatggaatcttgctctgtcacccaggttggagtccagtagcgtgatctcggctcactgcaacctctcactcccaggttcaagtgattctcctgcctcagcctcccaagtagctgagactacaggtgcctgccagcatgctcagctaatttttacatttttagttgagacagggttttagcatgttggccaggctggtcttaaactcctgacctcaagtgatccacctgccttggcctcccaaagtgctgggattacagacgtgagccactgcacccagccctcggaattctttagagcagagccattatgactgtttgctgctgaaccttaaatctttggccaaatattctctgtagctgctactgatcaatcagaatgaacccagaagatgaaagctgatgaaagatgatgaaagttcaccattgctagacttgatctcttctaatccttaaacactagagccagataagattgcatgtcatgtgtaatctcattatagacatccttaactaagtcctaccttggttttcttttctctttggccttctttccaagtcttagcagccaaggctgtgaaataagaactggtatgaaggctcttcattcaactccacatctgaagctctgaaagtgaccttgtgcacttttcttgagcctctttactttacgttcccccattctgccacaaagctcctggtggggctggtgtctcctctactctcctgctgatttcatcaaggtaaagaattctattccttttcaaatgctttgagatcatgggatagaagacagcctggggaagttcaaagacgtttaatcattagcctcagttcttttgaaaattattaaagagcccagaattagaaattcagatttcctccaaatccctgagaacaaacaactctcttgtaaatggcttaatgtgtctgtttaatgtacacaaaattatctttcaggaaagtggattgttttttatatcattttgcatctctaaaatataccacctatggcaaaaggattgggattcaaagtctgacaaaatctacagcagaaataattagcaccagaggctgtttctgagagttaaatgaaagagaaactggttatttatttatttcttttctctctatctgtatctctccatctcagccccgggaagaggaattgtatctcttggtgctagaagggtggcttgctgaattgcctttacaaggtttttttctgtaagacaacaactgagcccccaacacacaactccctgtgggccgcagtgctatggaaacagctgcagtgctccaactctggggaaaacaaccagataaacccactggtttgcaaactaggcacaagggcagaggaatagtgatgttttctaatttagcatccagggaggcaagggggagtctttgcttaaatcatgttaatgaaattggaaacacttgaaatagcccattgagggtctgttgcccctgttttttaaagttcatctaaaagttaacctacaaggaattttcatttggggaatttctgcaatgtcaactccactgatcacccacagtgtttaacacccttgctataaatttgggggctagcttggcagctcctgccacccccctgagtctgctaccttgctccagaaataaaaaatgactttggccacagtaatgtttcctcgatcctcagcccctcctgggggcctccggcagtcattattttaaataaacatgccttttattgttttcaggtacacagagatggaggcgcttctacctctggaggagggatggactttcaggggccccatgatttgcagcagttcagtcaaaagcaatacaaagagcaaaggataggggctgttatctcacccaagagctcctcaagcagaggatactcaattggaaaggaggctcttccagtcaaatttggggctagtggggtcaccacgtttgataccaactaggaacaacatccccttagaggcttccaactgaggaaggttccaaaagagagctccatggctgaaatgattcaaaagaagccaactccttctcattgagctggccctttggaatatggccccctcctcccacggcatccttccccctgcccagtgcctcaggcccatctacatgcttctacctataggctttgcttcttctctagaaaggagcaaagaaggaaaagaatcattggaggtgagtcaaaagcaggcaccgtaactcacggggccttgtaagccagggacacagtttcagattttacttcaaatggaggcaaaaccatgggagagccatgcagagacaccccttgatgaactctgcttcacgccaatcactctggcagctaagaaaagtgcattctctctccttttgcagttctcctggtgcctagcacagggccaagggcacagtagatgtgagcctaacacttgtggcctttgctgatgaaggacagtgaaggggataagaaaacataaagatattttgggctgcaagggaacgaactactgaaaaactactgcggccccctctatttatggagatgctgaggccttggagagggaattgacttgtccaaggtcaaccagaaaagtgatagcaaagccagggttagtatccaggtttctgctgattgcagctcctcagataaaagtaagtgacttgcctctcttctcccatatccagaattgatctcaaacactgtcatgaatccccaagggccagagagacacacagcatagaccaaggtgagtaaactgttttctctctttctgatgatctgagctttttcctggagagatctcaggtggccaagaaaccaagttgcccacctcatggttcagaggaaacaataacctcctggcagcttccctgggagcccatgcaggtgcctcagggattaaggagctcctgaaaacaactcctttcctttgcaggaagtgattttccacccctgaggcataacaccaggcagaggctctatcagtgcctgctgatataattagctctggacagactctccaaccaaggcagacacaaccaggcccttgctctagaaacaaaaagaatgttctggacctatcccagtacacttccaaaccccacgccttcctgggcaagtcggggctcagagaccaacaaacccaacagacttcagcagcagccagggagctggcagcctctgtcccctgaaatgccacttttttttttgtgattcagcctctgtttcaagctatttttagtgtaagcaaaggctgcatctgagggaaggtggtgtgggaaaggggtctttactttctctctccttttcaatgaactgtcctgtttcccttaggacagccatttcaccaaaagccacaaaacatgtggggagggaggattaaaaagaaaaatgggaaaaaggtcaaaattcagcctgtttgctaaaagtctgggaacagttctaggaaggtgatagtttctcgatcctttgcgttaacctgctgaatcctgggctgctcctgccagtggggaaccaatatgcccagtccatctaccttccgaattaaccaacctccagtaaacaaggaaggcccagaagtttgctctcccagggacgtggtgcaaacaggtttaatggtcccccttgatgccccagggaaggatgtgtgcccttggaggcttgtgaacagagaagcaagcttccgctcacagaggaccctggcttcccaccctcaccccgtctccatcatgtcagcacaaggccaattttacaaactgaaattaactggatgagcaaaaagatagccttggtgcttaagaggcttgggtacatttaattgagtttccaagtgccctgattccttaagaaagccagagaagccactgttatgtcctagatccctcactactcaaacaggagagaatagtttttacaataaaaattttagggcaaatggtggctttctgttgttgtcatttccctgaagtaggttttttgtttgtttgtttgtttgtttgtttgtttgtttttttctggaaaaagcctcactctggacccagagtctaaaaatgaggcttttagtgcaccaaattgggctgtttggggcccgtaggcacgagtcagtctgcctcctcctaaacatagcctcgtaaactaaacttggaagcatcagcttgcgtgtggtcccgagtgtgactttccaagcatgcactcccctgcaacgacaaaggctgatgactttgtcatcatcatctctatttttgagtctccctgctaaacaaactttctcgcagctgaaatggaggctctaaggatatttttctgacaaaaacggagtgctaagccatcagcaccctctgaaggccttgggggaaaacctgggtaagaaaagtctcccagcccaactcagtagccgcaaatacagacatttcatttcctgaaatgcctccagggggcgccagctttcatgggttgggaaggagggagggaaggacggaggaatggaatgaggcgaggaaggaagggagggagggaggaagggagggagggaggagggaggagtgggggaggtgggagggggcagtggggaggaaggaaggaagggagagagggaaagaaggaagggagagagggaagggaagggagggaaaggaagggagggaagggaaggaaggtaagggaggcaagggagggaagggagggaggcagggagggaaaccaactactcacatatttgcccaggcccctgggattcagctgcagaactgcacaggatgtgcaatcaggactagaatgtctgagctcccaggcctgtccaagggactgagagatgggtcacaggttctgacttatcactaaaccctacttcagaaaccttgccaccccaaatcattctagaaaatgcaagcataacatttccaccttcaacactttggatgactgcactttgcagcttttgctgaatgaaccaacatatgtccagcacattgaacagtatctgaccccgagcaggtgctccagaatgtttgaaggaatggatgaagggatggaggaatagctcagaggagctgcctcgcatgtgcagtagaatctgggtctttatcttctggtgacctcacacgctttcccatctcctttcaatgaatgtgtggtcactacctgtcaaaatgtacatcaaacccacctccccaaatactggtgcagatgtgccctccgaaaccagcctgtccctgccctgtcagcctcgccccacctccagggagaagtggatacggagaccacagtaagtgcacttgaccctttttccttaagactcatctgttgtcctgccaaggcatttcctgtgacacatgcgcccacaacgtacagctccagggagagcccagcccgttctccagtccccagccagctcagggaggctatatgaagtgagaatttcctggccaatttgacaatggtgagtcaggctggcatgagccagctgcaaagaggacgcagcctggacaagcctgaattaagtgtgtgcacagagcaaacatcatcatctggatggatccaaaccagggcttgcctggggcattcagagcctttcagatggccctgcccagagctgctcagcactcttggaagatgtctgggtttggggaggctcaagggctgttcttctacccctgccccagaaaaggatttgttcttcaccccctgacccgtctgtctccataccagcccatttcctccatgacatggtgaccgggctcacacacacaataacaaaaataataataaccatgcttatcaagcactaaccatgtcagaggcactgttctaaatattttacatgcattaactcattaagaggcagggactattattgtccccattttgtagatgaggaaactgaggtatgagacaatgaagccactcgcccagggtaaaagccaagcccctgagacagatggagctgggagtcaggagtctgcagaggctgggcttccaactgcccagccgcaccacacacagcagctccttcccaagatgggtgtcccagggagagaggcaatgcaagagctgaagtgagttttgaggctgctatgggctccacccatcctccttgtttgttccaatcaagtgagaacgagacacaaggagcaagatggagatcaaaaaagagtaggagctctagttcagatcatgatgcactgacaaaggggcagggtttctcactcccaggccccaacagagactgaagcaaagcggacagagacaagacaggaccggcagaagcaggccggactggctgctgactgcacagaggctgcaagtgctctgcttgcttaccaggcccccactgacctgtgctacgctcagttctgtatactagggaacaccaatcaatgtcggtggatcacacaggtggatgaatggacatagatggatgggcagacagacaatgggatggaaggccaaagcaggcacccacatgcacctggaaacttcagaggagagggaaaacagccatgccagcacttgccatcagagccctgagggcctgggagccagagatgagtggccaggatcaagtgggctgtccctggaccaggaggctcttcctcactctggagccaactgagggttgatttctgaaactctccttcattttcacagcagccctggggagggcagaggagccaacacaccagctagtaaaattaacagctgctctttacagggcgtgccggagagcccagcacatggctcgaggcctgcagaccagaagctgctgcgagctgaggtgcctggcctgcaggccctgatcaggggtcctcttgggggtaaggcttagactctgagctgccagcagggcctggggtgtgggggctgccgaagcagtgggcaggtggatggagaaactcaaggaatgatgctgctacaaaattctcagacatattctcctgaccttgcgaagtggaaatccatatgttcaccccagctgggaatctgctatggaacttggggacccacctggctctggcctctccatctctaatgcagtacttagttgagcttggggaagtgaatgtagacacgtccccatgagaaggggacagatgttatatcttatctattacctatgccataggtaacttatggagcaagtcctgtaggccacttgaagaggaatattgacaggcatacagggagtggcaattgtttctttacagggacagatggtaattattttaggctggtgggtgttttggactccggatactactcaactctgcctttgtagcttcttacagaagcagccacagacgatacgtaaatgagtgagcatggctgtattccaatgcaactttgtttatggacgctgaaatttgaatttcatatagctttcacatgtcacaaaatacacttattttgatttttaaaaaataaccatttaggccaggtatggtggctcacatctgtaatcccagcactttgggaggtcaaggtgagaggattgcctgggcccaggggttcaagaccaacctgggcaacacagtagaaccccatcagtacaaaaaatttaagaaaacatagcatgtcatggtggcctgcacctgtaatcccagctatcagggaggctgaggcagaaggatcgcttgaacccaggagtttgaggttgcagggagctatgattgcaccaatgcactccagcctgagcaatagagtgaaaccttgtctctgaaaaaaaaataaaaaaatgtaaaaaccatccttagcttatgaaccacacaaaagaggcaatgagccagactgtcccacaggctataactaactgatccctgggctaattaaatgtttcccaaagtgagtgctatgtgatgcccacaggtattacatggggaaaggattccacagggaaatgaaaatggaaaatgctgggcaaaacagagcctttccgctttctgactgcaggacttctgtaagtatttatatgctgatatgcattggcaatctcgaggagggggatgagaaatgaagtctatccaagttcccagggaaccatttttatccgggaacaattcgtgggtctagtgttctatggaacctaattaaagccatgaggataaagtctaaccaactgtcagcaacagcactatgaaatgcgatcctgctgctctttgaatatttctagtaacaggcagctcactacctgtcgggggagactgctcaattcaattatttctctgactcatgttttctcatctgggtaaatgatgttgagtcaaaaataacaaatctagtgcaaatctagtgtatctttcattagataaagacaaaatttcatgtttaatagtaaaaaaagaatgtatcttctttgactttttgactgatacccataatgtgatttcagtatctatgcatgggatgaaatacagaaccactattaagtcctggaaggaaattatcatatggttcctttaaacagaagcctcccttaggagtgttaaaacaatgccaataaaactccaactgattcccaatagcagagagcaggacatacctattcactatgggacattcttactaaaagtacagtcctgtgaaacctctagtctttctgctacacaaggcattggccaatgatgtaagaattttacatagatttgcctaaaatataataaaagctggggcatagatgaggggggtgagagacagagacagagacagagagagagagaagtgtgtgtgaatttgccaccaggcaccactgagaaagaaaagtagaggatactgatgggaaatgtcacaacctccatagggcacctaacagaagtgaatgcaatgaatgtgatatatttgattatgtgtgtgcccatgtgtactcccactgggttcaaccagtctaatttcatgcgcaaacagcacatcagtgaatgtacatctatttaactctgttaaaccaataggattattcctatttgaaaggcatatttgacacatattttcttttgggcccttggagataaagatgaaatggtccaggctatgtatataacgttaatgtaaaatgccacacatgcaacatatttagggggataaagagagaggctgatatttttctttcttcttacatcgataaatcatccctatacattcaagcaagtagcatatgctttcagttcatagaattagctgtgtaagcttcctggagcaatacacagatgtaacagcataggaatatggggaaagtaactacaaagagtgattctaagggctctctctagctttgctcaggagctggtagctattttggcaagaccagtctttgaagagacacacaaaacattgaatctgtcagggggttgaggtaaagtctaggcagtgtagatgtcgctcccaagttgaggtgaggctgtccttcaccacaggacatagtttccctagggagacagttgctgtgagatcaacatggaaatgaatatgaacatgcagaaactaagtgacaatgtggatagtgagagtatgtgtgtgtgcctgtatttatctttgtgtgtgtatcactgagtctgtaacgctcctttacaaagagtgtgacactcttgctactcgaccttagagaatctcttcgcctccagccccagactttcaatttctttatatataaaacaaggggataaattagactgagtcagcaaactatggtgtgtgaaacaaatctggcccaccacctgtttctttttttaaaacgttgtattgacatataatagtgtacatattttgggggatgcatgtgatattttggtacatgtataatgattagatcagggtaacagaaaaccatcacctcaaacatttatctttgtgttgggaacattctaattcttttctagctattttgagatgtacaataaattactgttaactataatctccctattgtactatcacatgctggaacttattccttccagtcaactgttttctctaccccctatttctataaatacagtttatttgtataaatgtaaggagtatgagtgcagttttgtcacatggatattttgcacagtggtgaagtctgggcttttagtgtaaccgtcatccaaatagcgtgcattgcaaccattaagtaatttctcatcactcatcgccacctcccacccttccaccattctgagtctccattgactactattccactctctgtccatgtgtacacactatttagctcccacttattcatgagaacatgtggtatttgacttcgtttctgagttgttccacttaagataatggtgtctagttccatccatgttgctgcaaaagacatgatttcattcttttttatggctgaatagtatcttattgtgtgtgtttgtatatatataaatgtaatatatatacatatataatgtgatatatatgcatgtgtgtgtatatatgtgtgtatgtgtgtgtgtgtgtgtgtattttttttttctttatttaatcatccactgatggacccttgggttgattccatagctttgctattgtgagtagtgttgtgataaacataggagttcaggtatctttcttatataatgatttcttttcctatgggtagccaccaattagtagaaatgctggatcaaatggaagttctgttttcacttctttgagaaatttctgtgctgtttttcatagaggttgtactaatttacatctccatataagtgatccttttctccacatcctcaccaacatctgttattttttgtctttttaataatagccattctggctgctgtgagatgatatctaattgtggttttaatttgcatgtctctgaagactagagatgttgagtattttttcatatgcttgttggccattcgtatgtcttcttttgaaaaatgactattcatatcttttgcccacttttaaatgttatttggtgatttttgttgttgagttttttaagttcctcatgaattctggacatcaggccattgttgaatgcattgtttgcaaatattttctcccattctataaagaaagtttactggaacaaagtcacaccaaggctgtttgtggctgctttcaaactactgtggcagagttgagtcgtggagcccacatggtctgcaagcctagaatatttactatctggccttttatggaaaaacttaccaaccctgaatttgactaccactgttgactttggcttatgattctatacagcacaaccaaactatactaaaacctacaccatacgtttcttgccctctttatttagaaaccaccttattcttagggggatttaatttacctgacaaaaatgtatggaacacataactgcatacatgtaaattccaaataggagtaagaaaagtagggcaaagggaaaatgagaggagagatgatgaagacaagccagagcaggggtgcaaagacacagagcgcaaacctgagccactctgtattttccataagccaccgacttggctctgagcagccaccactgagagacatgatccctttctcgatttagcatgctcactggatgttcaccaggaaaaccacaacaatctctggtgcaaaacactacttatcccatgagtctgtgcataaagcaggtaacatgagatgcagtgaacaaagtcctcaatgacacccaaacagttaagagaaatcctgacgacattgactgctatatccaaatttccctccgcatgagccgactccaaatcccacagtggaatttatcagcacgtcttccagcacatttcaatttttttaaaaaaagcaaacatatattacttttataatcagaaaataaacatttgtttagttaagaaaaaaataaaaggaagcagtactcttgacagcctggtgttcactttaatgtagaatccctcagccacgtgctccaagagaaggctctgtccagtcctgctgtttttggccagttgagcctgagtgccagggtgagagaggaggcaaagacaggctattctgagatctggagccggggggtcaaggaatttttatcatgtggataatcaggctccaggcgttgactataaaaagcactggtgaatggcaattatcatttgtcatttcttaaattgagctctgcatccttatatctagtttatcaatataaataattcacacctggatctctgttgctcactgctttatgcccagtgccttgaacagtgccaggtacagatgagcagtaaacacttagtgaataacggatgtgctcgtctgggagatcctacagatattctgaggttgtattggcaaattcttccccagctggaccttactcatgatgtcccagcttcgagattcacacctgtgacaattagacaggtgagatagaggcccagatgaggaggccaagctcctgagcgtgcatcaaggaaaacaaattaaaaattgaaacgggaaactgaatagccagctgtctggtcttgctttggtcccattgttgcagggataaacatttggacggctcaagacaaacacagctttgggttctgaacaggcagtgctgctttctcttgcccgccattacttaattgtgaaatctcttctttgttcagtgcagggacctgcctgctcctaaagggcaggcctattctcaggataccgcctggagctctgagatgcctgctttctgtgcagcaggtcccacttgctctgcatggccccaacagcctgggcaggattttctccaaggagaccttcagagagcagctggcaccttgggcaggctcaggcaaagaggcctgagtggaccatgcttctacatgcaaatgtttaacaagcaggccaagcatcctcaggaccaaattggctaaaagatggtaatgtcaaaatgtcacagccaaagtgacagctgtcagtggcttagaaaagaaaaggcattatcttcgactgggaagtaatgacacaaaaggagcaccagactgggagacagggagctggcaggtactagcctggctctgtcactcaaagctgaatgtttttagacaaataattgcccttgctatatcttgattttctcaactgtaaaacagagatgaattcactgataagattggcctgttttcttgtaatgaacccctacaacacaacagcaataaggagatacggaagaaatacgacattgtccttccccttcaaactgatcataacatataaggttagcacagtgcctggatcacaagaggcgttcaacagtgtgattgccaggagagtctcaaggtggccgctgggtgtgctgggcccaatgagttccatttccatgatatcacccacatgggctacctgcatcttctgcttggtgtcagtgcagaccgtgccccaccaggaccacatcaggaatctgctcccatgccatcactaaagcagtagcttactgccctaacttgtcctatagcctccaagctctagcctcacccattcagtctccacttgtcccccagctctctctgtacaacaccccctgcctcaaaatctccttgttctacaaacttcaaaaattcatttttttttttttgagacggagtcttgctctgtcacccaggctggaatgcagtggggcgatctcagcagagccgctcactgcaagttccgcctcctgggtccgtgccattatcctgcctcagcctctcgagtagctgggactacaggcacccgccaccacactggctaattttttgtatttttagtagagatggggtttcactgtgttagccaggatggtctcgatctccggacctcgtgatccacccacctgagcctcccaaagtgctgggattacaggtgtaagccaccacgcctggccccaaaattctttagcatggcctttaaagccccaccaggctgtctccaggacacttccccagactttggggtctgcaccccccatttcccagagcgccaggctccttctctgtttttcctgctcctcactttgaaggctttcttctcctttaactctcaagatcctaactcacacttaaaagctcactgcaaatgcattctgtcttattaagtattcttcacaaattccagcccacctagtggtcattttcttgtgtttaagcctggatatgtttttattttttatatcttcccgccataaagcagctcatcttgaaatgggagttttagttcaaagactttcctccctatgaaagcttttctgatcagccctactttcccctacagcccctccccacactccacaagtgcacaccgtgtttgtactcatagcacttatcctccatgcattccttcaataacttccgcatatggtgcaatagaatcaggatccttccttgttttctccagagctgaaacaaatacacttggcccagaattagtgttcagtaactcttgcaatgctgatgaagaaaattagaactgtctataatggccacatggaaggaacaagtgtcacatttgtgcagctaaactgtctgctgctccccattcactatcaccaccatacatatagaatacactacctccattttgtccccatgaatacccagactcagaattcaacctctcttaagtttccaatgcagaatccactcctcttcaagcatgaaagagcaatggagacttcagtcaagaggcaggaggagagatagaggtgctgttacacagctcagccaacagcaagtcacctccaagtccccactagacactgtccctcctgggtcacaccagactgaattgtctccctctctgccttcctccaagcagccactgacctcaccagtttctctctcctcctccaaaactccaactttaaatgtcccctctttccattttgccatcaattgacatcagccatggtttcataaccagacccttcagcacacagctcacggcagatccctcggtgaacagaacctgtctttcttgaaggctgtgtggccagcacctttgattactcaagcaccacgttcattctctcactccttcccacaaaagtgtgtgtgatattgatcccagacataacattgagttctccccaagaaggattctgagaagtgaaattctcaccacctccctccatctacagtcacctcttcactgagtttttgctgtgagactcagagataatgactgttttccagtgtccctgcctggtctttgagcctcgcaggcctcaggatgtccctactccttccatctatgagccaaatgactcttgactgagccctagcttcatgccaggacaggtggcccaaacaaaacagcttccagaatcacaatgagaaatcactccgaatgcaatatccttctcagggaaactcctgacccagagcagacccaagaaagcaagctagggctttcctagagcatgggcctggctatggcgaccaattcatccctgtttgcccaggactttcccagtttttgcactgaaagactcatgtctcatgtacccctcagtctcaggcaaactgggatggttgatcactataagcctgtcccagtaatgatccttgacaaaaaccaagggctcatgaggccagccagtgaagccaagcttcatataagcagatcagagagatgttggaaacatacagagaaggggcagaatcagccctggttgcaggtgggcttaggagacaatctcatcagaaaagggcacacaagcgagctctaggtacacgggccaggcagcctcaggtgggctactgatgcatccaccatcagcatgactgatttctaccgtgcacagggcccagctcacacactgcagaaaattaggaaactgctgcaagagggggtccctatgggctaccacaggacaagaagaacatcccccgaagaccaccaaacacacactcactcagcactccccaggatccccgcatttgtagcccttccatgagtttctggtatatttccttaaccctcttctcctctccaagatgatggagggtgtgtgtgtgtgcgcgcatgtgtgctttagcagaggaaatgtgctacatcttcccaacaacccttctccactgcaaatcccactccttgaaaatccctccacaaaccactgtacacaaggaaccgagcctctcctccatgaccacgcgggagcacttgctgctcacccccacctcccaatagccagcctcctgcagaagaccctggggaatatcacgtctcataagcaaagccaccttggcccagacagcaaggcctcctggtgtgagaagtgggtggagactcaccaggactctgccagtcagtgtctgggcggatatcatcacccccgcccagtccttcacggaggtcatccagccgacctcggcggccactgcctcctctttttcatccactggtttgagagtgccatccgcctggcttgagccattgttaatcttctgggcctcctggcaacagagagagcaagagttaagacatagggaacaatggatttaaataacatgctctacccataaagaaccagagccagaaggggtccccagctgagatggaaactagcttaaaggtataggagtaaagcagaaggggtaaattatgcctttgatttttttaaagcctttatttaaaaaagaatattttctttatttcctcttaaaatatcttagtgaaacaaagaaggatggtattattctattctattttattttattttattttttgagatgaagtctcactctgtcacccaggctggagtgcagtggcgcaatctcggctctctgcaacctccacccaccaggtgcaagcaattctcacgcctcagcctccctagtagctagaattacaggcgcgcggccaccatgctcggctaatttttgtatttttagtagagagggtttcaccatgttggccaggctggtctcaaactcctgacctcaagtgatccgcccacctcagcctcccaaagttctggtctcctcccattttaaagaaaaagaaaataccaaagcaagaggaaacgcaatctgtctaagattagggcatgctgaggagggaggaggaaagtgtgggagatgtcctgtggtctttgcctacccagcctctatgccccttttcacagcagcacccccactttcctttaggaaaattatctcttcctctcagtctatgtagttcaaaggggacagatggcctcacattggctccaacattggagtcctttctaccccctgccaacagcaattgggccattaataatcacatgatccatgccaagccaataagactcaagcgtggaacatttgcaggaaagaataggaaaagtcatccttccctgagaatgaagccactgcagagaaaagtaaaagtaatagactactgatgtcatcatttgaacacccggatccagctgtgcctgaaatctacaccagacctttccagttacaggagacaatacattccccttctggcttaaaatgtgcttgaggaaacaaggctgatttcatcagataactgagccccacacaggggccgaaactgtaaacctttgcatacagtgagtgttctgcctggaatactcttctcccacagagacttatggcctgctcccttaagtctttgctcaaatatctccttttcaatgaagtcttccctggccacctgtttaaatttgcaacactttctttccaatagcacttttctgctttatttttctccatagcacttaaaaccgctaatatacttaataattcatttacttctttcacttactgtctgccttccccactgctgcagccttggtgcctaatagagtgtctgggacagagttggctcaataaccatgaatgaatgactagaaagggctatgagtatcagcccctcgttagctacaaaggctgggtttagtgttgccagataaaatacaggatacccagtaaaatttaaatttcagataaacaacaaataactttttagtataagtatattccaaataccacatgggacatgcttatactaaaaccttattatttatctaacaatgtacatttaactggaccccaacacaaatacccactgcaactatgactgcagatgaagatgtttaaaaagatgccagcaaattatgttcatcatttaaaactctggaattaattcccaaggcaaagccacactggggatcattgtgatttggagtaaggggaagaaccaaagacagtggtgaaaagctttgtctgcagtgacaaagggggcggggcagagggaggccaggcacgtgggaggcaggtggggagggtgcactggtgagtcatcctcttggggacttggccacggcaggcaggaagctggtcccgattcctgcttctctccctctggctgcctgtggctcagggaagctggggaagagaaaagtgggacctgcagccctggacgctaatattttctttccaaatgtgttaagccccacagagctacaatgatccaagaggaggcccaggagggggaggccactgggcagatgtatctgggggctgcctgctgacatgtgtgggacctgctgcccaagcctcccaggccagcctcagataggacctgttaggtcttgccctggtccctgagcctctgccctgtgagactctgaacaggagggtatttaggaggatggggaggccctgatacagggtcaaccatggtaactgaaggtgtagattcgggggaaaatccagctctgccaccgctgtgggacctcaataagatggggacagtactgccagcccctcaggcattgtcaggattaaacagtgtccaatagcacaaaacacaggttcaagcaattatcccagcaccccttgcttcttctcgtgcccctgacaccataaagcaatggttatcacaatgagcgggcatcataagcacaccagagggcttgttgaaacacagtgtgctgggcccatcccagaacctacattcgaaccaagatgtcaggcacttctgatgctgctgggcttggaagcctactttggggaccacagctcctgactaccctagtatggctcggtgactgctgaaatgagacatggatcttcacccccagctctctcctggcctctcccttcacccaaggacagaaccacctgcttgtttcaatattggacattggtggaggggtgaggaaaagaggagggcagggagatcgtcccacatctgaggctctagtgtttccttttgagtcaagcctcccaggatgtttctgaactggtccctggccaccacgtggggacctggaagatagctccctgctcctcagtcctgggggcccaagttccacagccccttggtagaccctggagaggagaaatcaacgtgaaaaaggctgggaggcaggggggccctccagtcacagtggttaactgcatcagtaattcatagcacaagaggtatgtggcagataatgctatttcgccagccctcttacctattgttttacaaggcattcattattttaattactttatgataggcaaggaaaaacacagactaaagggagataatgcccttgttattatttgcttacactagatgttgtgagcttaattaccatgtgtgggaagcaggactgggaggagtgatgggggagctatttaaagcctgatgccagccggccagactagccaccaggctagccacagatcttgtgcctggaggaagaggcccctctctccaccactgacttcactctggccaaagcacctcttatggggagcaggcattataactccatgctccaaagaaaaagcagagaaggttcagtagccttgctgggaacatgcaggggcagagtccattataagagtgttggccaccattgaacaagccagaactaggtgccagcaactaagaattaagtgttttctatgcattgtcttgcttaaaccttataatacatccaacaggcaagtgaaattatttccattttacagacagggtaactaagagcaggtatctctcagaaaaaggcacagagcctgagagctcaggctggaagcagagagcccacctgggcttgtacctgctccagaacttccaagctgatggctgtggcccatcaacccttgagtctcagcctcttccatgtaagatggggacaaacatgccgcctcattaaggtggtggggaagctgaagcttggcacagtcccgggcacacagtggttacagctgccctgatgaagcacccgctgatggggctggggcctctaagagtaatccactgaagctgcaccactttcatcaaccagtggccctgggaggcacactggccagagtgaacctttaataaataatcacagaatggaggataaggaggtgcaggttctaacactgttatcctccaatgagcaagaagtccctataaggcaaggtgctgtgactcctgcagggcttctagtaggcgctgtgtgaccaccacccaggacagctggggcagggattcccgcacagggtggaccccagacccagtgacatctcagaccccttctgactcgccccattagatcaacctcccatttttaagatgagaacgctgaggaccagggagaggctgcctcctgagtcccagcattccgttcttgctcctggccccacaggatactgcctcacaggggaacaaatggtttgttccaaatagcaaaggggatatgcagccacgcccaaaccttccacctcccactgcagaggaccctgtccttacacaggaagcacttcccagtaggggcagcccgatgtcagtcaggaaatcactgagtgcgtgtgctcacacatgtgtgtgtgcatgtgtgagagtgtgtgcatgtgtgtgcacgtgtgagagtgtgtgcatgtgtgtgtgcgtttgtgtgcacgtgtgagtgtgtacgtgtgtgtgcatgtctgagaatgtgtgcatgtgtgtgtgcatctgtgtgtgtgctcacacatgcgtgtgtgtgtctgtgtgtgtaagggagagaaaccccactggctgcagcctccagctaccccagcttcaggaggacaggccaccagatcttctgaaatgcaagaaaagatgtcttgggaaaagaaaggaacatggagggaagaatagggagaaaaatgagaggtgaggccatcgcgtggggaggccatctcagaaagaggaggtcctgcaggagccctccccctgcccttggcagctccctgagaaagggattcggccttgcactggaggccactctggatctgcctccaaccctgccctctctccccactagagccttgtgtaaagcaggccacagctgcctctcagtggcaacagtgacatctaatttcagtgcccacatcagaaggtggggaggaattcagggcaagggtgcaggcacaggaggcagggaacaccagagagaagagtggccacagtcccctcccgacacccaccctaccaggcaacctctcacggggctgtgcccagccttacaccctcacccctttctatgccttctccccattccctttagtggtgttccccacgatgactttttgttgacatggccgcagaggggctcacccttcctatgtcacctggggccaagggcctgactgcaccccatcacctggtgctcaagatacaaacctcatctgatgcgtttgggcatttcccgctgaatcacaagatcaaagaccaaagcttgagaagggaccttagcaattcctgaggatccccaccaccacccaactaccacacacacagtgtacagatgagaaaactgaggcccagagggaaagccacaagctcagggccacccagcccagccaggtgaccaccgggccaggaagcaagccccagttgctctgtttcccttatctcttgttgcctccccgataagacaattgctccaaatctagcccaagtgacagtcactctgctgccccagcctggaacctggagttcagggtgttcctaggactggcagaaggctccacctagcctggtactgggttcaggtgtgagggtcacgacaagggctaatcctgcttgtcttcaaagggcccagccttccccagccacgacagctgctctggtctagcacaggagagcaagcttgtgctaatcctaggaccccacagccccatccctcagatttggctgtctccgtctctcatccttgctgaattagacccagtatactgggactctcaggtctgtggtgtggcaggaagaactatgaaaatcaaaagatactctggaccaagtccaacttttctgggtggcctccagcaagtcatgtcattcctcaaaccctccatattctcttctatgaacagggatgagtcctgccttgtcaccctgcctgattcttgcaggagccctaatctggtaacagagcattgcctttctgaaagcaactgctttacaaacggcaggcaagtggagtcactgtcctctggttctgggcaggaagcagggctgctctggagaaagaagtcctgtgccacaaagccagagccctcacagaacgcagggctcaacactcagattcctacccagctgcaacttgcagggcaggtcccccgttgtcaccctgcaccctaacaggatgtcaaattgccaagtctcagcaggtgacctgtcatgctgggcacaccctccctgacagggtgagctgctgccacacctgctctcacccggttggactctctcacccccaggcacactcctgacacctgtcaagctgaaccaggcaccaaggtcactgcaggcaccacacctgctggatgactgcctcaggcatgagaagctggctgggcccgccttgaggggatcccagggcccctccctgctgcctgcctagagccaagccttgaagctccaagtctgcctcgggtttaactacgtgtcagttctttggacactggttcctcatccaggatctgggaagttgtttaggcaaaggccatctgggaagaaaaatacttttcaaaaatgtaactgaaatcatgtcactgttgtacccaacaccctcctatggcttcttggcccattcagaggacaagtgaagtcttcacacccaatcagccccactcgtgcctgtcatcctgcgagtctgccgctcactagctccacttcagatgcaatggcctcctcatgctgccaggacattccagacccagtcccgtctcggggctgtctgcactggcctctgcctctgctccagagatccccgtggctgcaccctcatttctctcgagctttggttcacatcctcactttgtccatgagctctccacctcatcccgacctctccctgtctgtgctgtcttctccggagtgtgtctgccacctgcttcctttacttcatcattgtgtgctgtctgcaagctgcatgagggaaagagtttttgtctgtttctttttgttttgtttgttttgttttagacagagtctttctctgtcacccaggctggagtgcagtggcgtgatctcggctcactgcaacctctgcctcctgggttcaagcgattctcctgtctcagcctcctgagtgctaggagtataggcatgtgccaccacacctgtttagtttttgcatttttagtagagatgggggtttcaccatgtctgtttcatttatggctgtatcttcaatattgaatccctgtgagctcagagtaagcacctgacaaatcttggtgggtgggagggaaggaaggagtgggggaaggaggagaggagggaggagagctacagcaaatggaaagtcagttcttaccatgcacaatctagaatagatattactagtaaatagtactactaacaataattatactatcgactactgttttttagcatgatcatagtaactctatgacgttggtactaatgtcctccattgacagatgagaggttaagtagctggcccaggaagacacagtgtgaatttaaatccagctgtctgatgccaaaaagggacacgtacccatcctgctgtcctcccgggaacagtgtgagcagcagacgggagaatgcatgtgcaaggattattggctgctgcaaagtgcccacgaaaggtttattaacatgaagagcactcaattcatgccacttctgggtactgcttgtaccatcacgacccttcttccagggccctgtgcctatggagggcagttccatcaaggacagagaaacacagttcctttctctgccaagaacctgcccggaaccataaattcacccttcgtggagcagagtatcacattggaaatgagcgtggccaagctgacgggctgtgaagccctcctgctaagaaccacggttctctatgcagatgctgctaaaggaagatttggcttcctccctcgccatgcgtatccttggagtccttagcacgctctgcccagcggtctccagcactaagaggctgagctctgccgggcctgacgcacctgagtgggaggtagggttctgacagggaacaggagagatcaggttagcacaaaaccatctccgctagcccttttgggaccagagtaggggctgggaagcccctctcatccctggaagctggatgttctgcccagcaccctggaaccatgggatagtcccaggatgcttgacccccagagggctgtgagagaaggaagggcctcatgcctcacagcccctttgtcctcaaattttcctggtcaacatcagaaggccatttcccctgagccttcattgatggactgcgctctgagttactcattccatctgccaggagccccaccccaccctctccctggccactccattgccccatctcctctcgtctgttgaaactgacccagcagccccacatgctgctgtcctcaactgggcacaatgcagaagggctccttctctcctaccaaagggtgggggcagggggaagccttctggaccagaagctatgaagccaggcacaggctgtgtgccctgggccagtcacctaacctctctgagaagagtccctatctgggagacgagagggggtggtgagttaaatccacagttttctgtaccttgaggcccagcattgtgaggtgccccaggggggctggttaccaagggagggcagaggaggcagggccccggaccccgcggaaataaaagcgcctctgcattgagcaatttcacctattatggttctgtgctagactgcatctgagtgaagggattttctggggaaaaacattagaaatcccctgagtaaaagtccataggcccatgttagcttttttttgttttgttttgttttgttttgttttttgagaaagagtctcactctgttgcccaggctggagtacagtggcgtgatctcagctcactgcaatttctgcctcccaggttcaagtgattcttgtgcctcagcctccctagtagctgggattacaggcgtgtgtcatcatacccggctaatttttgtatttttagtacagacagggtttcaccatgttggccaggctggtctcaaacttctgacctcaagtgatccacctgcctcagcctcccaaagtgctaggatttacaggagtgagccacctcgcccggccccatgttagctttttaaaaaatgctttgtttcatgacaataactatgacatcctgtggcacagtttggcctaagatccagaagtgtctgaacctcaataccttaggaagccctggggctgctggtccctccccgcgggctgctctcctctccttcgcctcaggttttcaccagccccgaatgctggggctgggtcttccgtgtcccccctcccatgccaaagaggacatccacccagcaacctctttcacctcctgggcgggtttcccagccacgggcattctcccaggtaccaataatcctgcatattagggtattaggcagattacccaaagcagctcaagcaaatcaagcatagcatgggcaccaccagctggggttttcatggcaagagttctgcaaagggaatggatggaggaggtggttactctgagactcaaggaccagagaaatagggcaacaggggacccaggtctttcctagagctggtgtcaggagtggcagagttcacttctgcccctgggaagttgcatagtccaacctctccctggctgccatcacttctcctgctctgcaccccggagactctgcaccagcagggcttaagacatttgcactgattaattcacctagcagttactgtgtttgctaactgtgggctgtacctttagggaagggacacactgtccacagattcaggcaacaggaacttataaagaagctgggacctaaccgattaccccgagctgtcagaaagccctgtgagtttactgggtgtctcggctggacctacagtgctccaccattgaggcatttttagccattgctttctgggtgccctgtccagattctcactcttagaagcacccctgcgctgggtgtgaacaactactctttggaagtcttcatggtagaaaaaggccaggtgacctttaacaagtccttaccatcttgtgcctcaggtttctttgtctcaaatgcagggagccatgtaaacactccccaaggtctgtccagctctaaactgtctgacccggaggcctggattgttaagtcccttactttgcacgcactgtctcagctctgtaaccctgggcaagtcaatcaagcatcatttccctcccccgggaaatgctgcaggacagattccttttcagctcttctcagagccaggttcaaagctgctctcccattccctgaggaccaagggggtcaactggtgctcaggagatcactgatcccctcttacatctactgtgttctgtccttggtgattttacaccaacttaatcttcacaagaagcctgcaagataggaatgttttttctttttttcttttttctttttcttttgagacagagtctcactctgtcgcccaggatggagtgcagtgatgcaatctcagctcactgcagcctccgcctcccaggttcaaacgattctcctcctcagcctcccaggtagctgggattacaggcacccaccaccatgctccagtaattttttttttcctagtaagatggggtttcaacatgttggataggctggtctggaactcctgacctcaagtgatctgcccgcctcagcctcccaaagtgctgggattacaggcgtgagccaccacgcctggctgcaaggtaggaatgtcatgaggctcagagagattgggtaattttccaagattacccatcttgtaagtggcagagctgaaatttcaatctagtccattctaactctgaaggccatattttttctctctattccacactgtcttgggataggtccaatgtgcaagaacagagatggaatctccatataaaattctgtttactactactactgaaacaaccatctcacaacctatggcttctaagtaacaaaatcctgtagtacagacatctaaattcagttataatccactatgtacggacagagagttggagaaatgggctaggggacggggatccaacctgggaatacaatgctcattagacattagatatgttctcaaatggccacatatgctgcctaaaattagtaaggcaacctccaaactttcagggctaatacatacatcctggccaatgtgccgtatttgtaaaataacaatctccttctctttcaattagcttaataaaattggaaaatataagtgacagtccagagtccactatcagagccatagagactttgaattggattagtagagtcctcagccaggatgaccctggcagggtccaagacagcctgctgtccatcagagactcggagactcagctgccagtctgcagggcagcccatcctgccccagaagctcagctcaagacctgcccagacaagaaaactgtggcaggggcccagcaggaaggcaaaaattacatttgtttctcatcagggcagactgggatatggataaccaaacacacaggaaatcccaaaccctcatgttcataaaagaatgcagaaatcttcgtgccaagttaacttttaccggagggagcccattgccatcctgtagaccaggaggaggatccagcccccaaggagcctcactctcctcagcaaaggctcctgcaggtagctcacaggtgctctgttcccatgggtcctgcatggccacagggcagtgctgcccctgatgtggtacggaatgaaaagcctcagtacagcgcactgtgtgtgtcagtggaagacaactgatgaagggcctctcccaggaagaactgtccttttctttgacattatatcgttactcctttgttgggtattaacatgtccttttaatgaaatgacaatggtggcagagctggcatttgacagtttctttttttatgtttttgcttgtcaaaataaaaagctggtggccttgtgatattctgttttataaaaattcattgattatcccacaaaaagtctaggaaccactcccctagcccaaatgcctcattctacaggcaggaaatttaaggccccaatattccacactcatagtggccaggttcccctcgaaaaatgtggctttcagacttcaggggcccagggtgtgtctgtcacactagccagaggcagccttggggccaggaaaggtagggtctgagggatggaggcatggtctctcagggctggaggagctctgcaagctgctggcccacacaataggggaaaggggaaggcaagcattttcagagctcagggccataccaaccgcctgagttcctggcatctaatgccttcactaccactactgcaggaaatgcacagaactataacaacctcccgggaaatactacaagtgttaccgtggccccaagccaccacccaaggggcaactgggaagaaagaattcaaccacagatagcagataggatgaattgtttatggttgaatattcccttcagagtcaacagaggactccaagcaatttggagtaaaaagatgagtaacccgagagcaatgtaagtcacagcccagtgccccacacggaagggaacacggtcatccccttcgctgctgttctttgcttcccaccactaccaccttcatcacacacgtgtgcttattctctagcagtcagggcagagtctgcctgatttgcccactccacatcctcaaagcctgaacagcacctagcacacggtgagcatttcacagtgcactgaaataataaatgaagaaattctgttttttgttctgtcctgctttgttttcactcttcgctcatatcttctggaatctcaaaaatcctgccaagtccacaatgccctaagcatagaagtcaaactcctcaaggcctgatcttcaaggcctggagctgaggctgccggctgccctccccactcgtcactgacctgctcttccacctgacttctcggctatgacttggtcctcctgactgccacacctccgtgctggctgttcccactcctgggatgctctccccattgctccccaaccatcttcatcctccctgatcaaatcccagaggtgcagtgaagttctccttcctggctagatctccccaaagctctccctgtcctgtctccagggcccacatctgctcccccaattccacatgggacaggtacttagctgtcttttggtccatgcatgttgcattgccccagttagcctggacaatccttgaaggcaaggcctatataccttttatgcccaaagtgtttggcatacagcaatgtgcttaacagacacgtaccgattgagtaaattaaatctctgctcagtgggcactggaaaagcaagagctttcccaggcatcactgacgtctgggtaaaccaggccagtttccatgacttgaagcttaaactgggggttggctcctaactgctgttcctcagggcagctacattttcaaataaaaacactaaatcccaaatgagatcagatgacatggagcttctgagaggcacatgccctaccaggcatgtcagtcaaaagaaagatgaatgttcttgtttacaaaaggatttgtcccgtgccaggaaaatttccaccatgatttaggacctaatccagtctgtgcctatagacctcaccaactgaacatgttcccgcttcttccatttgctgaacttggatggggcttggcttcgggtcaaaagagctgtcccaattaggtcgtcagacagcctttccccacacttaagatgatccccattcaggaaaccaagggctagcaagacagacagactttgggaggcagaaagatggccaggttaccaggcatacagcggcagtcaggatctaccgctccgagcacagcccagcctgaggaaccaggctcccagagctgccctgctccctggactctgcctctgacctcaccccttggaagaactggctgggttccaaaacttcagcctctatgtccctgggttcccacacaccctagtttggatctaggtctccaacacagcagccaaacacaagagagtccagagcagttgctaatgtgaaataaaaacaattcaacagcccagggaaaggagacaggacttctttttccattggattcagagaactccttctccttttccttctcgatccctaatgggagttaaggatggcaagcgcctggccctgcaaagcctcaactctctacttggctccgctagacccatcaatcttctctccatggcctgggacccctccaaccctggacgtcgagagagactcggcagctgtgagaaccttctttctcaagtaaggtttttttccaaaattatatcaggtttccttctaccccagcttgtcagtgggggactcttttgcctaacatggttgaggaatgtcttagaaactggtgtgattcaatctggcttctgatgaggttttccacccagacagagctcaccgagtgtctggaagtgtcggttccctacacccaggggcatccacaccctgtccccatctccagacctcagtgaggaggatacccttgacaaagtggctggtccagccctacgatgaagttggatccagaaaaagagccaagaggaagccaaaaggacttgcccacacacttgcatccacgggggcctccctcctaccatgtcccctctttcccccaactttctaaattggtgaatctacttgcaacacacccagtataaataattgaagagctcccgatggaagtggctcaataattgaaatctcaaaaggcacacacctttcttttagaagagagggccacctcattcagacttctccaggggaagtcgttcttcccctcattccttttcagactggcctccttctacaaatacagattttaaccagagggtaattgttagaaagtgcagtttgcaaaaatgtcagtaacctgaatgccaagtttactaatgaattgtgactaggctgttgttagtgccgccacactctcacctgaagacccacaatctcccctggacagagggaaactggctgtccctctgttactgctcagctactgcactgaggtggggtggcaccagggggactggcatgaaggtcacatgaggggagagttccttttacatctcagaagtctcttattataaggatctgccaactgcaaggagagaagagccctgcagagcagagggacctgccagagcgctgcaggcatcaactttgctggcgtcttggaaagacgccccacgtctccataacaactaaccatccagcccttagcactgacagggatggagaccttttttggaggagcagatccggaagaaaggtcaggtggttacctgaatcccaagtctctttgttttgttttgttttgtttttctccttttgcagctgtttttcttactagaagctaggcagaaagagttgttactcagatttcttgaacttgagacgtcaaaggtgagacgccagccaaggagaagggatggtcagggaagcttctggggataccgacagtattttattttttgaactcagtggtagtgacacaaattttctataataatttgctattttgtaatttttcattttatagacttttctgtctatactatttttttaaagtctttaaaaaataaattgggcaaactgctcttcagggacccatcgtcattgccagcatttattaagtatcttctggcacaggacagaaatcagtctgcaaatcaccctgtgtcacagccctggaaagcaggactgagaaccagaaaacttcagtggaagtcattggtcccagtggccaaagcaccaaactgaagaagaaagtgaagaggtcaggggcaatcacaacaagtcataggatcaatgggctagaggccccagagaacttgttgatgcagtttgctgttatcccagctttagagctctgcctataaacaaagtcatagagaggggaatgtgattcatgatttgtacctgccttggaagggcctgaagtgaattggggtacgcagggccctggccatcagtgaaagagtgggtcttctgctgccctgctgatccactgctgagggtaactcatggtcccagcacagccttcactgaactgtcaggcacatgaagcaatcaggagtctagattgagtttccaaaacaggagcacctctttgctctctgtaagcctccactgatggctcatgccagccacatggctcccctagcctcccctgcacccaccggaggctgttaatagacctgtcattgtgctcatgttggattaatgaccactgttctccttcccaaatcctacacattgtttaagagaaagcctaaacgctgcctctgccatgaagcctctccagacctcttcagtagagctaacgtctccagggctgtttgctcaatacttcctttcaggtatcagtcccctcagatatcacttgtttctctgcttatcagtcctcattacattctagtccagtggctacatccatcagtctcccggctaagaacctgaggtcaggagccagggcttattaattcttatatttcatagcatctagcactgggcctggtggatttgtagcaggtgtgcaacaaacaatcaatatttattaatatatcagggtccaagagcacagacccagtaaccaggaaggaaggttctttaggttgtcagagaacacaaagggcctggcaggagggaggccaagcatcacagagaaccttcacctttcaaatctacccacttctctccatctcagcttctctcccctggttgactcctaagcttcataatcatttacattgtatcatgcaatggtacaattcccacttagttctgcccctcattctccacactgaagccagagagataccacaaggtttctatcagtcacatcatgcctgtgcttaaactcttctcagggactcccccttgctcttaggcaaaagttaaggccctcagcatggccgtcgaagatgctctggcacatctggcctttgccaggcatctggccacatactgaaatactcttggcctcacctcccttaatccacagcaatactggacattcttgcattccttcaatgagcactcctcttttctaattcagggatctgcatgtcctaggtttccttttcctgtaacaaccttcttcacacagtcatattccagatgtcctactcatatttaagatctctccccaggaagcctttcctaactcaccctccacctccactccaccaccaccattgctatcagtcaataaaaccttccaatcatgtggtctttgcactgctccttcataacactcaaggcatttgcaagtacttgttcagggcctctttgcttcactagactagaggtgggcaaattgtttctgtaaagggccagataggaaatattttaggctttagcatatggtctctgttgcaactattcagctctgttgctggggggcaaaagtggccttagacaatatataaacaaaggagtgtggttgtattccagcggaattttatttagagacattgaaatcagaatttcataccatttcatgtttcatgaaatattcttcatttaaaatttttgttcaactatttaaaaatgtgaaaaccattcttagctaatgggccatacaaaaacagatggcaggccagacttggcccacagcctgtggtgtgccagctcctgcactagactatcagtttcctagagacggaagccacgtcttgttcacagatgtatctctccagcacagtgtcttgttctcacaaggcggttcataaaaattcactgaatgccttgatatgtggactagagccatgtttcccagtgtaaattcacggaacaccagtctgatgggaaactccatacaaaagggacacttctctttgcagtgaaatctggaaatgccatcattcctcttctaacaaatgttcaatgctcactgcatacagcatagcaaaagctcagagatagccttcagtcaaggaacctgttcaacatagaccaatacaatgctgcccacactcattttgaccaaataactttcttctttaacccaaaatatctgccagtgtccaagggcagccccactgaaaagtgatgcagtgaggagagacggcagaatttagaggaatgggtctcaaactttagtgtgcatcagagtcaccaggaaggcttattaaaataagaaactaccccagcccagagtttccaattcagtaggcttaggttggagcataagaatttacatgccttacatgtttctcagctgacgctaatgctgatggctaggggaaccccgttttgagaaacactgatctgcagaataaatgatttcaaggcttcggtcctctagctggagtttgctcctccatccaaggatcttattcccaggtgaactccaacttgtccactttctcacactggcagtagcagctctgacccatctttctagtcttaggcacctgtaatgggttgcagtgtttttttccaaaagatttgtttcaatagtaatccccagttcctgtgaaggtaagccttatttggaaagaaggtctttgcagatgtaatcaagttaaaatgaggtcatactggagtagggtgagctcctaatccaatatgactggtgtccctaggagaggaggaaagagacacacatagggagaacgccccatgaccaaagaagcagagactggagtggtggctgcaagtcaaagactgccagccaccagcagaaacacggaagatgcaaggaaggagaaaccctacaggcttcagagggaggctggccctgctgacatcttgatttaagccttccagccttctgaactgtgagacaataaattaacattgttttaagtcaaccccgttgttatggcatcactaagaaacattctagtccaaggacagataaagctctggccaaggccttattcttggtaggtgtccacatgaactctgaaggaggaagccacgatgtcagctgtctgttccctttgtcatcactgctagacagtgggtgtctgcgctggggtctgtttttggaaattagattatctaattaatgtgatgttttgttggatccatgccttagggctggatttggcaaaaagcatgtgattattttttactcttaaaaaaatgtcactaaataagataaggagacttggctttgccctatcttgggctccacatgtcctgtttctcactgagagaccctggcaaggagtttctcagtgacaaagaaatggtttcttctcctctagttctgagctataaacaccttctctaatcgacatagaaacggctaagcagtagatattttcagtcagagtaccccagttttagtcataaattatatgcctctccttttggaaatataaggggtataatttttattcttgggcagacatagtcctgtgcccgataccttaggaaagagccaaaaagagaatgtggacacagcttgtcatggtggatggagaggaaggagacaccaggggtagggactctgtattctgaagctctgaggccacaggatgaaaaatcagagccaagtgaatgccttctctgcctctccaatccatgccaacccagggctggctgctcacatggggtctgcacaaacttgaaaatctccagatgttttataggggggacaaagccacgctttctgctgcaacagactgtgagacttttaggatgctcaccccaaggcccttgaaaaatgagagaggggtctgattctttgagatgggtaaggcagaggcaccccgtggaagtcaagcattccttctctcttccctcccaaggccagcatgtaatttcaaatgtccagtccatccatgaacaatatgttagcctttggccaggcggtgagcttccaaaatgcaaacatctcagcctctgtctgcagaggtgagaattcagcttggcagaggaatgggacactgtcaaggaagacaagcttttggagtcagacaatcccaggtttgcatattggccttgttttgttggtttgttttgctttgtgttaaaatctaatttattctgcaaactacagcaggttagttaatcctttgaaacctcaggtttctgagctataatacaggaataattataagtgctttgcagcagatttgtgaggattctgagagttgttggatgtgtctagcacattccttctaacttataaagcattatatgccaagtatgaatctaagtaatgcacatgccctaatcttttccatccttacaactatttatagcactgcccccatatggcaaatgaaggctcagagaggtcaaggcacctgcccacagtcacaaagtcagtaagcagctgattctggagctggtgctctcaccacagggactgctatatacccatagtggaagcctggggctaggaatgaagatctgtgttcattcattcattcattcattcattcaacaattcacctgggcatctctgagagaggattactcacaacaggttctcagacaaaaaaaaaaatacaatctctccttccaggagttgaagatctctcaggggaaacagacaagtacccaaaactaaatcaaggtagaatatgacaccagggaggaagagagtatggcagaggacctgttaaatggcaggaacagactgatttaatgaaggtggtggtatttctgctgagcctcaaaggataggcatgattttgacagatgcactcagcctggttcagtccaaattagggcccccttgttctttctcatcacaacccattcatttcctttgttggactcactgtgattttaatttcacagctatttgctgatttatttgttcaatgctggtctcccacactagaccatgagcaggaaggagaggcagcatgcaactgtgctcgttgtctacacagggcctagcactgggcctgggccagggcaggcacctgggaggtatgtgctgaataaatgaatggatggatgggtggatggatgggtggatggatgagtggatggatggatggatggatgagtggatggatggatggatggatggatggatggatggatggatggatgaggatataagtattggcaggctggtggcagcttgcagaaggagagcacattatctataaacacattgccccgatttatttaacattgtagtcactccaaatcttggttaccctcacctgaattttctcttttgggggaagttttacacaaccaccccagtttccctaaatgccccctccctggattcctgcagcacttgaatttaggcttctgagcactggtatctccccaaatagatgagactccccatgtgggcagcagccctgccttctccttcatgtttgtccacagtgcttgggtgagatctggacatgtagcccacactctgttgaaacctgcccatggcatgcagctgaggggccctgccttctccttgtcctcatttattgccatcagtcaaccaccaatcatcccacatcgaccccagaggcattggtcttggggtctccctggtgcggcaatgtgggctgccttcccagccttgtccaggtggcaggacttctgctgctgacaacagggctgtgatactcagctccccaaggctgaactggatgactaagagtcctaatgattctggtattttttcaggacctgtctccaaaggcaggaggacatttaaaaatgcatgggtctctgctaggtgacacatcctgcttaggagtctgctggcctccagtctgggacaacagagcacttcaaataggcacctgtgttcatcgcggtgctttctgtccacacagggccttggtttctgaggctgagagaggataagctaagcaaggggcagaacaggacaccaaccatctccagaccccagtacaacacagatggcaggccaaagagggactgtgtcgtctgattcaagagtacagactacacagccagaataatcggggcctggcttggactctctttaaatattcattcctcatctgtaaaatgagcatatgagtcccacttcaccagactgtaggacatacgtgaaggactctgcagtgtctggaacatatttatggcccctgaaataaacagttattgatgacagagatgaaaagaagaagatccaatggagtaatcttcaaggcctgcttcaagtcttgccttggtaaagctttctattgggcactcatataaagcttatatgacttttttttgtatataacagacatgtatatatgatgactgtctactgggtatggttctgagcactccctaaatagtaactcattgaatcctcacaacaagtttatgtagtatgtactattattatgcccattttacggatgaggaaaataggcatgaggggttaggtgaacgactcgaggtcacacagttataagaggttgagctgggatataaatccagacagtctgcgctagagttcgtgttagttaaagatggatacagtgtgctgctgttattattcttgtagatgttgactattatagtctcttgtcttgcggagcagagctagtctctctcccactttcttgacaaatggtaggggcctcccctataacatctctgaagcccctgcagcacttcatagagccagtcagagtgagtttgctgacccacttgccaggacttgctgtgccctctgccttcttcaaggcatccccagcagagccttaaagggcaaagcctgcacacctccctctgcagcactgctgcatgccccacctccttccagggccacgctttccaacttgtgacctggacccaaagtaagaaatacattttacatcgtgacccacacatacctactatacaagtaattgcaacacaggattcatgaaacaatacctacactattacatggaatgtactttgatatcctgtattttttaacattgattacaactcactaaattgatttcataatccacttagaaaattcctcttaggggagttcagctccaacatctagcacatgcaatttctgagtgcagtgcacagcaattcttcccaaaggcagcccttcctggtgcacatcagcatcatggtgctgtcccagcccagatggtcacttatatattccccagagccctgagcctggctggagcacccaggcagtggaaagtcaatacaggctgggaatcaaggacccattcaaaacaatgctcacagcagacacagagtgaagaggcttgctttagagtatgatagaactgagctcaaatctcacctctgctagttactaactcagatgttattggacgggttcttaacctctgtgagcttcagtgccctcccctggaagggggcactatcaatatgcaccacagagggtgttagctgagatgtggagatgacttggcacagcacccagatacagatactgaatcagtgccagtcagtggtggtgggaggtctttgctaacacctcacaagggccttccctcccctctctttttgtctctatatttagagattctacaaccttcagaagaaatagcagtacttcctagcacataggtaacactcaacaaatgtctgaaccaattaagcaagggcccaggcttttgcccaataagtcatccaatcctgagcatccatccattcatttatttatttatttatttatttatttatttatttatttatttattgagatggagtctcgctctgtcacccaggctggagtgcagtggcatgatctcggctcactgctgcaacctccacctcccacgttcaagcaattctcctgcctcagcttcccgagtagctgggactacaggtgcatgccaccacgcctggctaatttttgtatttttagtagagacagggtttcaccatgttggccaggatggtcttgatctcctgaccttgtaatccacctgcctcggcctcccaaagtgctgggattacaggtgtgagccaccatgcccagctctaagcatccttttgaaggaagatgtgttttataatcccttctaaattcagtggccaataaagtctgctccgtgaattacactcattcaatcacagctgatatctctagatcaaggacaatgcccctctctacaggtgggaagacaaaaccaggaggtcccaatgtggcttctccaaggttcccccaaagttactgtcagtgcagagctggggtgacagagcccctgctcatcactgcctatgttgccttccaagagagaagcaagttgctcaataaatagctcatcaccctaaaaataacgaggtctctgatgagacttagtctctaatgaaactaagcacaggactgagggggtgaagagcaagcagaaaatggatttccaccatgggctagactgttcacgtggcccagtggtggagagaatccttagggaaagcctaactccgaagcccagagaaggaaggaaaactaataaggagtgtgttttgcaggctgatttttctgaagttatccataggaaaattcatttatgtgagaggctaattagtcatgacagtgctttgctccagacataattgcattggtcccatgcagtctctgtgggtcagcctgtaatggaatttccattacctattgtgttttggttactggagaaaaatgtgtgattggggaagaaagagggatgaagagaaaacatgaaaggctggaataccttgaatatccataaaaaccatctgtgattttaaaacttcataaagatgatggatctctaagagccagatagtcttcttggaatctgagctctgtctgcgggaactgctcctggcaggcagtgggttttgaaatccaagtttgtcagaccacagagcaaagcgagctgccccagcttggccactaggggtggaaacaagacccaggaaagggagactaaatgttcttctcaactagccaccagctctcaggctgccaggaatgctgggctgtggtaaatgaatatatagatatatagatatatgggtctggtgccagaaatgtgcaggtctgcagggatgagtatgaaaggcctcacctctcctgccttctagagaataatatacagttcaagagccaaagatgcctgagggtgaactggtatgccaagttcggaagggtcaccaaaccacctaatcccccaagtgttagagccaggaacagaagggggttttaagttcagggtttctcaacctcagcacaattgtcactttggctagatggataaactttttgttgtgggaggctgtcctgtatattgcaggaggtttggcagcatccctggcatctatccagtagctattctcctccattccacccccatccttaattgtgacaactaaaatgtctcccaacatggccaaacgtcccctcgagggcaaaatcgccaccatttgaacatcgctggtctacccttacaattcccaaagtagaattccaaggaatattaatttcataagcttctccccaacacaagtattctatggtcaactaagtttgagaatcactgcatattgtaccctcttttggaaattccccatagtagtctattaaaggccctaaaaagttctgcaataagaagaacactatttaattgttttgtttgacctaacatcttgcaagctttctcaaacaaaacccctttattcctatatttgcatctttcagagttcctgttccaaagaatattgtgatttatatatatgttaatatgtatctatcatatatgtatatatatgatatatcaggcaacccaacctttccattgaacaagaggaactgaagcaataagcaagtcagggttcaaaatcctactaagagatgagtgtcagagccatgcatagaagctgaagtcctgattcccagtctacctccttctcttacacaaatgatttagattaatcctcaagaagatacaagatacaagaaaccatcctctcacagccatgtcacaatttggtttgtgaaaggaaagtaaaatcttgggaccctcaactcactatgccaaaagaaagagtgaactttgtcatgcaaaagctgctttctctttgttcctaaacagattgctgcaagagagaaggtcacctatctccccaggtagcctctctcaccctgacaatgtatcttcacaggtaagggacaaagacaagactagaaatcatccctctgcccacctcaagacaaatgcagatctgacttcttcttcctctactctatgtttactttatcttatgtaaaatacaagatttactgagcaggagccgaatgcactattgagtgtccctctttttgctccttcccactctcctgcctttaaatactgaagttctcaaaaccctctttggaaaaagcacaggccacagagtctactgtagcctttatctctttttcctgggctcatcctcaaccttggcaaaatgaacctctaaattgattgagaactctttcagacatgttttggtttataggctccaccaccaccatccagaatactcacctaggaacaacgcctagtgaaacatcagcatttctgttccccaggagaacagacaaagcaggcactttttgcagacatagttgagaaggacctcacagtggtcataacaagggagggtgcaaggaggcgccatccacttacatcatgtccatgcacctgctaatctactataagtacaactcccatgagaatcactaaagctgattcgtctttgtatcaatgcaatacatctttgtattgtggcgagcacagagtgggcctccattaagttaggtggaaggaataaactgttaggcaacacatgctaaggacttgtccatcaacatgccttgattataattcacagatcgtcaccaacacaataaagcctccccaatcctctctgtcctcttcatgattttcttgggaaatattctaccctggcctctccaggctgcagggaactactccttttaggatggcagctccccgcttccctgacacatctactgtcatctcttcacttgcgccagttcagaaagataaaagatcaatttccagctcagatcagccagcccaatgtccctcctgaagacagtacatcaagggaccagtttcctatcattctaggtagaaaacatgcagtgactggtcattcagtctcttgatggtctctcttgccaaaagcaggcactggagaggccatagattggctcccattctcagattgcaaacaatagaactaatattgacagagaaactggatggtatgacattctacaattttgcatggggattgaaatgtaatcataccttgaggcctctggtattccaggaatcctctttcagccctgggaacagaacagtgtcctagggatttctctaatccttttatgacattctaagcagagtgtatggatgcaggaacagccaagagtctcagccagagggcagacctggggccccctcttggtttaccttggctccagccagtccaaagaatacacaggcagcttgcagaccactgagttgagactaagggctcagccctagggcagctgcaacacaaatgcagcagcaactgctagatatttgcagcatgcccctgaagtctggtctgttgtaaaaaaaaaaaaaaaaaaaaaaaaaaaaaaaaaaggccgggagcggtggctcacgcctgtaatcccaaaactttgggaagccgatgcggatggatcacgaggttaggagattgagactatcctggccaacatggtgaaaccccatctctaaaatataaaaaattagccgggtgtggtggtgcacacctgtagtcccagctactcgggaggttgaggcacgggaatcacttggacccgggaggcagaggttgcagtgagccaagatcgtgccactgcactccagcctggcgacagagcaagactctatctctgaaaaaaaaaaaggctcacagcaaagggtgtggaggttgggatgctcagcttcggggcaggagaagcatacagcaagcctctcacacctgcaggactccaggctcccagagccacagctgcactctacctctctcctttcctttccccttctgagcaccttcgggttactgggataaagtagtgcttaatgagaggccaaagggactttgcctccttgaggctttttgattgctttgcacaaaactcatagaatcaccttatgttccttcacttaatcagtcacttatgagcactattctaggcactgcgtgaggctgggaaggccctgctcacctgttactcttactctgttatgctcttcgtaaaatccatcaaaaacaagcagtcatcctgcttctcttatttccccatttcacaactgtggaacccaagtacagccatccagtgtcagactcatgaacttcagaagcagaagcctgaagatgagctttggagtcactgtcacagcaacaagccaactggcatgcagaaatgaagagactcactcaaatgagggacctaaatcccttctatggtcaatgagaaacagaggcccatgaaagggaaaggccagatacaccctcacacaaggaagtggtggcagagccaggcccagacagcagagatctcaaaggtccccattttcaatgttgtgtttcttccatactgtcatttcaaaagagccatttaaggctgggacactctggtcccactcaaaaaaaacaacaacaaatcattaaactttcaacttttaaaaaactaccaaacaggttgcaaaacactttcttatcctacacctgggcgagagagacttacagagggggaaggggcagggagggaagaaggagagggtcatgaatggtgagggggaagggactgagtgagggtggaagtgttcatgattgggatggagtagagattagggagccttgaacctccctgaaggtgagaaaagatcacggatatctgttcatgaatttaaaaagactccgcaacttcatattcagagaggagcaggactcaggaatcaggcaatggtcatgaggtaagtttcaatttttcaaaacaaaggtgatttcatttttaaaaatttgttgtttatttgtcaagagaaactatttatttttatttttattttgagacagagtctcactctgttacccaggctggagtgcaatgctatgatctccgctcactgcaacatccacctcccgggttcaagcaattctcacgcctcagcctcccgagtagctgggactacaggtgcacaccaccacatctggctaatttttgtatttttagtagagacagggtttcaccatgttggtcaggctggtcttgaacttctggcctcaagtgatctgcccaccttggcctcccaaaattctgggattacaggcatgagccactgtgcccagccttaagaaaaactatttcttaagccacatattcatgttttatagttcaagaacacaggtcagtgacaaatctctaggtaattcttcccaaaggaatactttatattccaaaatcactttgcactctgaaagatacctcatctcctcaaaatctttcatagaatcataatttctgtagaatccgtgtatgccttcttttttagttcagccacagcaaagttacagagggttgcaacccccagggaaataacaaatgcgccaacaatatgaaatcacagatgctcagccagaaggccatgtatctgaggttttgtcaaagcaccggaagccacagtagttattatgctcaaaaggtatgtcagcctcaacaccagcatccttcctggctgatcgatttcattttttgacagatgagtttgacaccgccaatcagtggcaccaagggactgtatcataatatcctaatggtcccgaggctgattcccacgccacaagggtaactgcaattccatcaagccacagccaaatacagaatgcctcccatttaggaagctcagttaaactttttatgtcaccaacacgccccaacctcagagttgtcccttcctcactcaacacacgggacatttatcttcaacgtcaccacctagcttcaagcttccttcggcttccccaaccacagtccccactaactacaagctcaggccagcgctacagcctgctgaccactggcaaggggccttggcacatctagacatctgcagccaggcctgcctctcaccttctaggctattttctctgtagaagaacaaactgcttgaaaatcagactgcaccagaacaggcattcttcctgctgctgtggaagtgtgtctcgttcctgtggaaaggaggtatcttgttctggacagtgtgggctggagctgctggcggtcagaacagggaagatcgtgttcaggaagaacaccatccctgagagaaccagtctcccgacacacatctcaaggccagcctgcaccagctcaaccctctcctaagcgagaggctcccctattagcgtgatgcatgtcttggaccattatggattgacatacattcttttgtatgaagatattcaatgctgcacatggcatctctcacgacaggacccccgaacccagaacacagctgctgaggaacaggtgctccatcaatacgggtgaaatagatgaatacgtccaagtgccggtgtcgagcactggaaatacaaggacgataaagacaccacccctgcctccaaggagttttttggctagtgggagattcccccttgttatttgtcactggtggggtcagaaatggagtcaaggtcagcgggttttggactaatctagaagaaggactggatcagtgcttcttaaatgtgttattcacatactcccatcacaacttctgccctagctgcatgactcctatgctattcactaaacatttttctttcaatggagtcaaattttttaactaaacaaagatatcttttttggggagagagtctcactctgcctcctaggatggagggcagtggtgtgatcataactcactgcaggctcaacctcccacttcagcctcctgaaaagctgggactacaggcatgtgctaccacacctggctattttttttttaattttttgtagagatggtgtctccctctgttgcctaggctggcctcaaactcctaggctcaagcgatcttcccgcctcagcctcccaaagtgctgagattacagcaatgagccactgcacccagcttaaataaatatatcttaaggatactccgtaacattaccacatgtgaaaaactggtatcaccagtgaagaaatagaagataaccttcaaaataaacaaaatagaagaaaactttcaaaataaatgcaaaacaaaaccagggtatgaaattctaggtagatgcctccgtttgcatgcagtctcaatgggggctgttctgtgcctttgttcaaaagggagacaggcaagggttaagagatgttcaaacagtaaaccgagactttctccctgagataactagaaagactggaagaaaactggaaatgaactaaatccctccttggtgactcagggtcctgtccatatatcactagaaggtatctgctacaccacctgtggtgtggggaaaccataaagctgaaatgagctttaacatttctttcaacatccaggtcctataacaccataagcagattatttaatgtcaaagaaatcaagcgcatggaagaaagacagcacctaaacaacacaggtctgttgactgaattagatttccaaagtttctggccctcccagattcattatatcctatggtcttcgggttacaaatgaggacagaaaagcagagagagaggagggaatgtacccaacccatccacctggcagtgacagagctcagaggtcttcattttggatgaaccatgggacccagatgcctatgaaaggggaggacttgtaatctttttattcccgatcttagactacctgtgtgtgcaatatgtgtttccaccactttgtgaagttcagccaaatggcccttaagaaatgaaggcaatgacttggtggaggccctgcacgtagagaacgtcagaaaaggctgaattggatccccagatgttcctaagacctgctgggggaagcttgcacaagtctggtccaaaatccgtttgtaaggaaattggtgaaaatcacagcaaagctggccttcacaggccacatacccaggccctgctctcaagcaacatcaggcttggatagatttttccagaaccccagatagagctgggctaacttaacaggttgaattcaaggcgtaccaaactttaaaactggaattggagttgactatttatattacaagaagattcttcactctccaaaagcaaccctttgtcgtctgagcacccctaaagacttaagtgtttgttaacagattactaaccatttggcaggagtgcaagcactaaagaaaacttgcagagaaaggaaggggagggaactggaatctctgcaccattggttcgccaagctttgtgctacatgcttcacttacagtatctcatttaactaatcctcccagcagggttaagaatctccattatacagaaaaggaaacagcacagagaagtgaagtaatttggccaaggtcacacaggtactacagcactagaagcaggggctgtttccagcagcacatgacatggaacttcctaaggaagtgccatttgcattttgttatcaccatctactaaaacatacccctctggcacacagtgcaataactatttattgacatgaatatacataaatgctaagaatgccatacacagtaaagatgaccatatggagcttaaaatttattacaggtcagaggtatcaaaagaaaattatctgaatatgccaggctagcaagggaggggattcttggtgcctaaagtcctactattccagtcttctttctttacacacacacacacacacacacacacacacacacacacactccttcagccaaaatgttccactttagtggagggaaaagagagcctggagccataagtctagcttattgctgatgcctggtgttccccactctgcctcccaggatctggaatttatcttgaccaccagacagagcacagaactccattacctagggtgggccagggctgccacggagcagcattgtgtggctgtaccctccagaaactctggatgtaagatggaaggattgtagtacctggtggacaataggtgggaaaggatggagggtaaagaaaagcacaagacagggagaaaaaggaaggggagagtgggaggatgggaggcaggaagttcggttaaaatatactgtcagtggcaccggataaaaataatagccttttctgtgattgaaagcatttctaaaaatcaaagataggaacagctgctgtgctatggtggtgggattatgactgcttttgtaaatgtcttttaatgttcttatatagttttacagcaggtaaaattttggagcagaaagatataaaaacattcatggatagaaaattcagaacaagtcaccaaggggaacttggtttgtgataattttataaaacagtgttacatacattcctaacctatccccaggccccctgagagccacaaccaagacccattggaccaagcttctgaatttcacagagcttaatgggcttctgatggcaggggctagtcacccacaaagagaggccacaacatacagaggcaggaggcctgcaccggggccaggaccatgctctgtggacaaaatagatgatttcaggcaaatcccttacctggctgactcgggtcgtcttccttaaagtaagaggctgcatgcgatcaggagtgacaaactcaaatgctttaaagagttaggctgggatcacagaactgaatgggccatcagagcctatggtggcctggaaatcacacacccggaggccaagggtgcagctgctacccagacctaggtgaatgctgggccccatgctgccagtgtagagaagttgggaatctatacttttttaaatgtttggtttaattttaattttttttgtttttagagatgggatcccactgtgttgcctagagtgaagtggtgcaatcatagctcactacagctttagactcctgggctcaaagtgatcctcccgcctcagcctcccaagttgctaggactagaagcatgggccgccacaccagaagaaaactagactttcatgtgggctctaatttttctgttggcatccagtttctaaaaaacgtagtaccaagcacagtgcctgaatctgtaattccaacactttgggaggccaaggcgggcagatcacctgaggtcaggagttcgagaccagcctcaattaggagaaaccccgtctctactaaaaatacaaaattagccgggcgtggtggtgcatgcctataatcccagctacttgggaagctgaggcaggagaattgcttgaacctgggaggcagaggctgcagtgagccgagattgtgtcattgcactccagcctgggcaacaagagcgaaactctgtctcaaaaaaaaaaaaaaacaaagaagtacttcaaatgtattatctcactactctatgatatgttgtaagattggccccatttttacaaatgaggaaactgaggctcagagacattaagtaatttgcccaaggtaacacagctaaaaaggggcagagccaggattggctactacaaagtccttattccttctctccacaacattttattaagaaaatttcaaacaaggccgagtgtagtggcccaggtggctcatgcctgtaatcccagcactttgggaggccaagacgggtggatcacctgaggtcaggagttcaagaccagcctgaccaacatggtgaaaccccatctccactaaaaatacaaaaattagccggggtgatggtgcatgcctgtggtcccagctactcgggaggctgaaacaggagaatgacttgaacccgggaggccgaggccgagcccagatcatgccactgcactccagcctgggcgacagagcgagactctctcaaaaaaagaaagaaaagaaaagagaagagaagagaagagaagagaagagaagagaagagaagagaagagaagagaagagaaaagagaagagaagaaaagaaaagagaagagaagattccaaacatacaacaggttgaaaggatttcacagacaatacctgtatcccatcacctagattataccataaacattaaattttactgtattgctctatcacaaatctatccaaagattgtctcctttggttccatctgaaaagcaacctagaaagtacgttagaggtggagcccagatgttgccatttctgaattagaaataatttggcctcttctgaaacccactcatcccattccctttgtggctggggagtatgggggtgggaagggggcaggcaggaaggagagtgttgatccaggaacatctgcacacatcatcacaacacacatcccaaccagctctgatttctcccctggctcaaagcagggagagatgggtatttgggaaaagctcaccaccccaaaatatctccctaaaccctgaaggctaagtcaacccatgggctctctgaaagtggccaggggacagcaggagaggcagtactcggaaaagggcagcggtacctatcttcggagccctttcacctgctccagtgggattttattctcactctgtggccctgatacctcctgtgtcttttagctgcattcgtgggatgggagggttgtcagggaggtttcccacctggggcctcttcgtacacctcaaggggataccatgcccacagaatgcaatgtgaatggtcctcctggagtcctgcagagtggtggcaatcttcaagtccatctgattcatgcaaaagttgttcgagcataaacagcagctttctccagtgtcccacgcacagtaaagaccctgcaagagggctgcctatgaaaggccttggggccagggcgggggctgggagtgctggactctcaattctgacaccatagcttctccaccacttcttgctatgtgaccttaagaaaccttcctatcctctctgggtcagagctttacaaatgacgccacaccaaaggaaaaaaaacaagcaaattctggccatctcctatgttcaagacagtgggccagatgctgggtggaggggaaagaggcatactaaggagctcagcagatacctcagagccctggtctaagcgctttgcacgtttttaatactgacatcaactctacaaggtgggtgtgacttttatccacattctataggtgagaaaactcaggaggagagaaattaaaactttcctaaggccacagggttaagtaagaggcagagcaagggtgaaacatgggcaacagtttcagaagcctgcacaggtgaccaccacaaaacgctgcttgctagagaagcccaagaccccctctctgacctccaggaagactcggtccaggggagggagcaagacaaaagtgaagatttaaatgctgataaaatatttaaataattctttgagataatagtgggaaagatgctgccagggagaacatgattaattgtcaaatgaaagtgttcagacaaaattgctctaacggtccagaaaaggggaggaaaaaaacccctctaccgtgagctcattctgagttggaggaagcctgggaggttaaatgtcactggcttttgcagagtgagcaggacttgaacaggagagagtagggcagaaagcattccagcaagaatcaaaattctttttttgtttttgtttttgtttttgagacagagtctcattctgtcgcccaggctggagtgcagtggcacgatcttggctcactgcaagctccgcctcccgggttcacgccattctcctgcctcagccctccgagtggctgggactgcaggcgccagccaccatgcctggctaattttttctgtttttttttcagtagagacggggtttcaccgtgttggccagggtggtctcgatctcctgacctcgtgatccaccttccttgacctcccaaagtgctgggattacaggcgtgagccaccgcgcccggccaagaatcaaaattcaaagggccagctctcatgtttggaaaggtgaagggccctgaacgactgaagatggctcaggggtgcaggaagggtgagctgaggctgggtctgaactttgccttataagtaatagggagtcatagaggaatttcagtagagtagaggagcatcatgacccaaatgtctgctgatgacacactggatacactaggggtgcagggagaaaattaataaattccccaaagtgttggccaaggagtccttgggtcttgacagaggaaagcaagaagttaaggtcatgatactcctcagagactgaccaaagaaggaagaagggggatacttcagctggaagtcttcagctgggttccatcctaaggactttagaatttggcactctgcgtcatcagggaagcaagtaaatatgatccaaagtccccccaccccctcgcagggttatatccagagaacagaattttttaatgctatttttaatctttctgttgaccaaaaacacactgagaagaaatgaagcatgaacatcaacaagaggctctacaaactctctcccctctcttccctcctgttaaccactctgcgaccctgcagactcaccatatggtccaccagctagatggccccttctgatcctggaagggctgatccgcttaattatttggcagctataaatagaagcattggacaatagcctgagatcttttttttttcttctttttttggtcttgcaaacaaagagagggtccctagttggcaggattggagagtaggatttcactccctccctccaggccattgtcttccacctgagccaccacagcctcagggcggcttcagaactgtcctggatgagctagggacagccctgtctcaactgcgccagcaaggagatgtgctggggtcactcacagttcttagagtcagggtgggttttaggaaagagatcacccaggagactcgaaaggtccgtttgctttaggcatgtccttgcctatggggccaagacctcactctagccacccacagcttttcctaccttaccactcactgcacccacattcagccttcactctcacccccaccccattcccaggcgagagcagccacctggaggaatggactcctctggatccagagccaggaggtgagcagagcaaatgttcccagtgcctgcaggaggaagccaggcacccagggttccccttgccacctagacccccgccacctccccatctaggatgggctttctctactccacacataagcactctcctgccccagctcctaagctgttctccctacccctaatcttagcagggacctggcatggaagtcagatgagcctggcttggcctcttgggtctgctactttactagttgtaagatcatgggcaagaggtttcattgctcagtgcctcagcttccccacctgtacaatgggcacaataacgatactgacctctagggactgcttatgaggacctatcgagagagcaggtaaaggttgtcatctagagcctggcacacagcaagtgcttgctaaggggtgttactggcagcttttctctgagtccaactcccatcacctatatgcatgggactcagcacacatttgctaagttgttggtttctccacgctcccctcctcctccttcacacccaagaggaatgaccaggtggccacaggagtcagcatgtttgactttggtacctggggctcctgaccatccagtgtgaatccaaacgcatttccctgactgtctgacacctgctgtttaatctccatcaccttccctcctcctacctggctcagggtccctcactccgcataggtggccaaggtgtgggggagagccctccttcctaatgcttgtttgttttttcgctcatgtgtttgctcagagacaggataccatggtgacacccacgatccagggtggctgggtacacacacatagacagggaaatcaagtgaaagaaaaagcccatgggggccaccatcatcccacgaggggccagactggctcccaaaagagggggaaaggctgtccctcccaggggcctacatatgttttcccaatggaaagcttttctcagtggtcccggcaggcttccaggacactcctgcaggccagggactggtttctgtttgtctagaagccctgcattcatggtctagcatagccaccaacctccttgagatccatcactatccccccatcatgggcatctgcagagcattcatgggttgtggtcatgacttggaaaattattcttaggctgggagtatggctggactaggcttcacagagaacacggagggcagggtgagacgctgccagttggagagaatggcagcccctcatgaagttcagagaccccagcacacgaggaatctaccctgcctggcactgcattggctctcgtggaacatggagggagtgggctttggaatcagaggccagggatcaattcctagctgtgccacttcctagctaggtcaactgtgctgtttcctttaacctttctgagccaaattatttctaattcagaaatggcaacatctgagctccacctctaaagtgctttctaggttgcttttcaaatggaaccaaaggagacaatctttggatagatttgtgataaagaaatactgaatgctaaaatgaaaataaaaatatcttctgcagaaataagacctagagtttgatagatcagtagggtgactatagtttagaaaatattatatatttcaaagtagctagaagagaataattcaaaggtttctagcataaagacaaatatttaatatgatagatatcccaataaccctgatttgacctttacaaattatatgactatattaaatatcacatgtacatatgtacatttattatttatcagtaaaaataaaattaaaattataaaagggagagagacttcctgcatatgaaatagagattacaaatcctttctaagtacacatgggatactgacctgtatgctaagtcattaaaaaaagaaatccttctgcaaaggaccgttttgagactatgaggctctaatttagaaaggtgacaagcacattgcaggaccttacttaatagggctggggcttgccagcatacaaaattactgcagtgacttgttcagactcctgcactgggaaaagacttagtccagagacttacccaatgttttgccatagtaaattctccaaggatgaagaaaggaggaggagagaaagagaacttttctctgtcttcttcaaaagctgtagcagccagatgaagtacggtgtaggtggccaagcagccagatccctaaatagcaactaatgactttgattgaaattaataatgaaacgacacctgttagctcacttgtagccactttagtttgtcacatggcaattatattcactatcctatcagctggtccatgagctgtaaaatgctataatgccatgccatatgcctctcttgtctcccatgttgagacgggggctgtcctcagggtggttatcaattccaggcctcctaaccactctggagattgtcctgggaacttccccggcattcaaaaagacttgaggaccaccagccccagtgaacctgctgagtcccagggagcagctgggcagcctctttgaaggtggattcccccaccgagcaagaggaaaaacacacccaagagttaccgagtcccttctgtggttgggtccttgaaaagccttgttgggtgatagagggaattctccacttgagcagtgaacaacagtgtcaccatccacattatctccccagacagaggcaggacataaagaactaaacaggcccccagcaggccatgagatttggtttctatagcaacccaactgaggttgcatgagtgcctatgagatagatgcccaaggctcaccccagacagggccagaattccagaatcccaacggcaaggaccacccagcagcgtttagagatggaaagcaaggtttgttcatgttcagaaaaacccagggaagccacaggaaaaaaatggggctaggatccccactttctataaggcaagctccaagactatctggcagcccaaagctggcatgcagagctgaggcaggccccacaggtgagctgagccacgctggggattttaacagaaaataatcctccatccacctctgcatcgtccatattctctctctctctctctcacacgcacatacacagacacacacacacacacacacacacacacacatatgaaaaataaaaaaaatcttgcaattattcaaaagaaactatggttgatttgttgatcagaaaaatatcaatgaatgaccaattgcaacaaggtccaaggtcctttaatgaaagtttctaattaaccctacctttgaacacttctattactctatctgtagagtaattgttattttagcgatgcaatgtttcctaataagaccaagcattgggagaaagggaggaagggagggacctgaaacccaaacccagccccaggtacaagctagcacaattagcagccagtgtactggcttctcgaatgctgatatggaatagctcaggaaactcaatcccaccagggacctgcttactgtccacagatgtcatcacagtcatcggtcaagctgagagaggctagcgcaaacaggcgatggggccgctctatctctcctcctccatcaaatcacaaaatgccatgacaacacccaagccagggcctctgaggacacatgaaaggaaatccaacttcatgcaacagggactcaaggtatggcccttttcggccaaaaggcagtgtgggctggagagagagataaacacaagaggctggaaacacagacagggtgagtgggaaagcttagaaggcacttagcaggtaaggctggcatcgggagggagctggctggaccctaatccctgaaacctctctccctgaaacctctcttcaaagagatctacactttctaaatcctgcctccatgagatgaaacttctgttcggtgtcccactcttacagcccctgattcccccagggcctagctaaggaggcccttggaccaccagtgaaactaaacagagtcactgcctatgaagtcccttcagtctggagctgtctgaggaaacagataagccatccaggccaaagaccagcctttcaccatctgaggggctattagatgcccagcaaatatgggttgcctagctggtagcttctggcccagatgccagtccaagagctagagtggcctctccaagcttgggagttagggaagctgtacccagatccttggcacccaccccaaaagagcccatgaagagaaatgaatgaaagggcccagggagattctcaaggccccggtcagccgccctagaagtcacctcaatcttagtcaaggatgagctgagccttgaaaatccatactctgtgcaagaagatgcagataatctgcccagttgcccaaggcaataacttggaggacaaccaacaaaggccaatgggggtcacttgggaagacacatccctaagttgacctgacttccttagagtgggcaggaaagacaggcttcagaagatagctagaaagtaacaccagagaaggtcaccctagaggtggcccctggccatttctcaaggtgacagcctctctgcccaggcgtccacactgcaatgttttccatattggcacttccttacaaagtcctctctttctacctccatacctttgttcacactgttttgcttagctggcaagttcttcctgctcctctctgcctaccaaagccccacttgcccttcagggtcaggtcaaactcaagctcctcatcaagctctgcatgccatggagatgtgctgcccccaacctcacctcgaagaaggacttgaggcccagcttcagggagacggctttgcaaacagcccccagctgtcggttccttcaggctcagcctcagctacagcttcagccaaggtcacccttcctgggacagcctgcatctggtgacagagtgaggtggggtacagaagcacagcaatttgggcccaaagggatcatctctgttggataaatccactccagagttgtctgctgggttggccgaggttttgtggaagctgcatcagctctcgacttgtccctcttgtcactctggcctctgcctctcccttctcagaggtggattcctaataaacatcatgagctcaaactggtctccaccagtacccatctcccaccagaaattcaatcaatggtcattattattatagcccatgtttctgccacaaaaggtgctcaataaacctttgataaacacatgagataatttagcatttctacttgctgacggagctcttgcagagcctgccactctttcaggcacactcacagcagctgctgatcaggtagaccaaatgacatgaggccaatgaaataaatatgccatcacaagagcatggcttcctctggctccctaggaatcacacagcatgctggctcctgaagaacacacaaggagatgcctcacctgagaggttttggatcctgggatcaagaacaggggctcattggtacctctgtgtccatcctaaatgatggctcacttaagaagtgatggaaggtcagctttagtgacaccttctcatcagcaatgctgctactaggtgccaacagcatctctcaccacggcactttaatcaggatggcatgacaccactgtaaatattaaaaaggttataattagagacgcagttaaaacaaccgagggcttagtgttactaaagatatttgcagaatctggtgcaatataaatagcagggtttacggtgtcatgcctaaaattttgagcaggctgatgttccaaggggatgttcagtgaatgcccatccaagctgggatttctctcaactgattgttttctctccagtgtcagagttctcagaaatagatatccagagtgtgcccattctcataaaggggtgaaaagaccttgctactcaaaaagtaggacaaccttgcaccaggacacccgttgaagctcggtggggcagctgcagcccctcaagctgctagaaacactgtctcctgcatggagaggtcacagccttgtgattccatcggctccaaatttaaagcaatcttgcagaaaagggccaacatttatcagaatgaggaaattgttttctagggtgatatcaactggagtctgctgggtacacatgacacagagaacaggcaatcaacctaccaacaaagacgataattgtcacagtgcctgccaccggccaggcctctgcacacattcactttttcctcaccacaatcttacaaggctattgttgacatagtcactttacatatgagacaatcaagactcgcaacatcataaaactgatcagcagcgacatctaaatttgaattcaggtctgtccaattccagggttctttcagatgtgagaagggaggttcagaaagggcccctttttcttctccctccgtgtacttctgtattatttgaaatttttatcaatagtatattttcttgtattactttttaaatcttcaaatcatcaaaaagaatttatgggcaagagaaatggtcctatttctgttgaaaatgtatcttaatttgatgtaacaaaatactactaacaggccgggtgcagtgctcatgcctgtaatcccagcactttgggaggccaaggcgggcagattacgaggtcaggagatcgagaccagccagactaacatggtgaaaccccgtctctactaaaaatacaaaaattagccaggcgtagtggtgcatgcctgtaatcccagctactcatgaggctgatgcaggagaatcgcttgaatccaggaggtggaggttgcagtgagccgagatcgcatcactgcactccagcctgggcaacagagcaagactccgaaaaaaaaaaaaaattacaaacagccattgaaataaaaaaaaatctgttctttgctacaataatttcatttctggaaacctatcctgaaaaaaataagcagagacaccaaattatattaaataaaaaagctgcctttattttgaagtgttacctttaataagaaataaactggcaagaaactcgacacccaacaacagaaaataaagactggatatcctcatgataaactagggtgatgctattaaaaatagttttgaaatgtcagcaaccacaaggggaaatgctcattacatgtttctaggtttaagaatcaataaataaactaagtattcacacatgtaaatgctggtatatgcatccctcccaggacccacaggcatacaaaggaatttagaaagagtagacatctttggagagaggtttccaggattagggtgggtggggtagggtgggcagaaaacttttacttttcattttatatttttataagttatttcaatgtttaccatatgtgttacttttatttcatttcactttttcaattttttttttaatttttaattttttttttttttttgagacggagtctcactttgtcgcccaggctggagtgcagtggcgggatgtcagcccactgcaagctccacctcccgggttcacaccattctcctgcctcagcctcccgagtagctgggactacaggcacccaccaccatgcccagctaattttttgtatttttagtagagacggggtttcactgtgttagccaggatggtcttgatctcctgacctcatgatccacctgcctcggcctcccaaagtgctgggattacaggtgtgagccaccacgcctggcctatttatttatttttaatttaaaatagagaatgtgtctcactctgtcacccaggctagagtgcagtggtgcaatcacagcccactgcagcctccaactcctgggctcaagtggtcctccaccatgcctggctttattattcatttatttatttatttgagacacagtgcagtggcacgatcttggctcacttcaacctttgtctcccaggttcaagtgattctcctaattcagtctcccgagtagctgggattacaggtgcccgctaccatgcctggctaacttttgcatttttagtagagatggggttttgccatgttggccaggttggtctcgaactcctgccctgaggtgatccacctgcctcggcctcccaaagtgctgggagtacaggcgtgagccgctgtacccagatttattttttaaactaagtatattttaaagctttacatatattatgtatattaaccaatatacatattaacatttatatatattaaccaatctaagttttcagaataacatttcattatataataataaaatacacccaaatgtgatttctgcattgcagaattacagacattgctttctctttataatttttctgtatttgccaagttttctcccataaaagcataattttattatcataaaaagcctccttttcaaaactttaaggtatctcactagtaagaggatatactttctctaataagagtttgggtttcaccaccagtcatgtccagcctcagacccacccaaagagtcatactatcatgagtacaggggatagaagggccccatgagactcattccaggaggttaccaaagtagtagacctgaaatggtttggctctgtgtccccactcaaatctcctcttgaattgtaataattcccatgtgttgtaggagggacccagtcaggggtaacagaatgatgggggcatgtttttcccatactgttctcattatagtgaataggtctcatgagatctgatggttttattaaggggagttcccctgcacatgccttcttacctgctgccatgtaagatgtgactttgctcctcatttaccttctgccatgattgtgaggcttccccagccatgtggaactgtgagtccattaaacctctttcctttggaaactacccagtctcaggtatgtctttactagcagcatgagaacagaataatacaagacacaagccctactggcttagcctagagcctcagctgaagccacagccctcagccctggacccctgagatacaagaggagcctgaccagtgacatcccggaattaaacagggggagaatcttcctcttattgtcatcctgagcaatacactagacaaaggccatcgggcagataaaaagaggaaccctgtgcccctgaagttgatctgaccaccagcgagaggtcacatctgctatgtgcaatgccctgcaggggtcacaaagatgacttcaacctcgaccctgtcttcaaaggagagtccagtccaggcgagtaggtgagaaggcatgtaccaactcaaatcccaggtagaaagtgagcagagcccgaactacagaggtatgaatacagggcaattgaagttcagaggacgaaagctcgcttccagcctagggtgcaaggacagcttccaaaggaggtgattcacaaactgagtttgaagtctaggtgtattcaaatacaggccaagtgtgcccctgcccaggagtaggcagtctatgcaacatgtgaatcacatgttcaagcacctgcctcacctgttttatgggcaagtctgccagctacagtcctatcagggcacctatatttctaaggacctggatgcctggatgttttttctccccagggcatatatctcaattacaaacctgcaggaaacaaaaagtttgtggagagtcacaaaacatatttgaaatgtataagactttcaccacaggaaactaggcctaacaagtattttcctgtggaacacccctggctttgatgaaactccccattcaatgtctctttcctcctgcaaactttgctaatagcagtgaaaataaaagcacagatcctatatttacttaatgatcttggctgctttagacatgagatagcattccaagagagcaaagtgctttttaacaaaattcaacaagaccctgccctttcccccgccctcccacctggcctctggaaggaggaaggaatttctcattctctgatcttttcgcctgccatgacccccagggcaatccagacagtaagactggccatgcctcctggtcatgtcccatacctcatgtcctcatgtgagaccccagatgggggagatgatcacatttgagttacatttgaggcggagattcaggtgggggcccaaaacatggctgacatccagccagcattctttgctagatggagctgggaatggggggttaacttttgtgaaagtttattagagaataaagtaagtgagttaattaaattggagtgtgaaagacatttgggtggtgatgaggaggcgaggtgatgatttatttataattgacaaggttgcatctagctactgggatagtaattatacactttataaatgcgcaaaaaaagtcctttcatgcgatggaggtttaagggaaaatcctgtcagggaagtttctgtctgcccatgagtatgacaccacctcaagagctgttggccacttggcttctgccaaccacagctgtaagttggggactgaataatctctaaatacccttctaaaaatgaggccttttctgggaatcagtacttagcctccatctgcttctgatgatgttttcttatctcaattcagggacaaagagggatcctttatcttgtgtctgattctttgtttttgttttactgattcatattcaagttccagctcttggatcctccctaatcaagatgataagaaagatgctgcccaatgcggcatctcatttaagggtgagcagatgtgaattcagaccctaaatttgggaaagttccttaatctcatctggaaaacagggatgggggtacctagctgacggggttgctataaggacagaacctggtgtaaaggcaagcctggtacccagttaacactcattatcatgcaccttaggttaagtcatggtaaaggaaacgtttcaggttaacttcagtcccttgataactggggattccagcctgacctgtttgcatagagtctagcttggcccctgtgaccagcatttgcctctctaagggctcctaagcactcagttttaaaatccaatcaagagtatttccagagataagccacgacatcattagaatacagattacagcatccatcttctgacacccactgagaaattctaacaagcacaagaagttccagaatgctagaggtaaaaaataaataaatataaataaataaataaataaataaataatcttatctcaccattcaaagattctccaaagaagtagcatggactagatctctcctcccacctgaaacaactaaaaattcagacaagacaatgattttcagacactggagctcagtcaggggaagacagcaatccctgagagaggagaaacgaagtgagccctacagttgcctcaacttcctgtctggagagagcgtccaagtcacagcagaaagaaggaggaccccagcagggcccagatgtctccctgagttgaggagatgaaggctggattccagcaaggccaaggaggctggaattcacaggccagggcagcaaaaagaactgcccagtgaatacttgaggtcagcagagggacccccttgagtctttagctaagtattggtggacacaggcatgtgtgaaagctatccaaggtgggggagagaaacaccctaaaggagcagacagaacatttcccagagtttatacagggctgggaacggttcaccttcccaccagccagagtggaaacctcaagctcacagagcacctggtagagtactgagaatagcagcgtctctgtagtgggaaaaaattagccctagattaagagagctctggttccacctaataaagctcaaaggcaagacccaaaaaagatcaaactgtttccatacaacttgatcatgtcccagaaaataagctcaagaatgttttataggagtactaagatatccagcaaccaacaaggtaaaattcacaatgtctggtatccaatcaaaaactaccaggcattcaaaaaggcaaaaaaattgaacccataatgaaaaaatagtccatcaaaagactccccacttctgcaaccacatctacagtgtatttcaggacccagccatagagcccctctggtcctagaaatgcatttcaaagtgcctctctagctctgtgcaagagattttctctttttcattctaaagacagtaatcctaggtagaaacaagagagagaaaaaaaacagaaatgctcactttctagtttgtttctctgtttgctaacagtgtcacatttcccaagcagtgatactctcccatctcgttcatcttctaattctctgcctataattttacaaatgtctgtggctatctttagcagttttcaccagttttgtgttttagccacctgaccccctttcactctaccctaagttagatgactcctcattcctcattcataaagttctgtctgttaaacctagagttgatcagcgatcacgatacacgaacatgctctcttcttcagatgccctcacattttccttctttacttggggattaacaatttaatttttaattagtggagcatactcaaaatgtcatggttgcagccttccatcactcttgggctatattctctcttaaggtcttcatatggactgctgtctaaaacaatctagaagagcaagaaatccaaaaatgggcccaagtatcctagggctgtggatccaaggcatccatccaatgtgaactagataaactgcagtctgtctgcaccattgatctttctgagatgagggcacctgaaagagtgggccaagccactagaaccctggaccctccaccacaggtaccttgtggcagttggctttaacttcctccctatccttgccatattaatcttcattccctgtagtcataaagttctagaagaatatatcagctttgatctctttcagttattcatgcattctttcatttaagtaaacagatatttactgagtacctaccatgtgcttggcaatactttccaatcttcagaaccgggctctcacaccaagcccaagcacaggcagctacccttactcctactcaaaaatgtgaagaggctgaggcttctaaaatagaaaaagtcaccagctcagggtcaaataattaatggaactcgaacccaggactcctagacccaagcctctcctggccaagtctcattcactgcaatcacaggtccagcctggtcacgatgatgagtgggactgtaccctgccctccctgcccagcccattctaggcttcctcagaattccctactttgagtgctcctttgccatgtgaggctcagtgatttccttctccgagtccactcacatttgataggctcctatgaaatgtaggtgagcttcacctgaatctgcacctgtcctcattgctaaggtgatgagctagtgtcaagaaaggctgagggatccaaggatgaactcaggcagggcttgaggccactactcccggttcccctcctctcttccccatgaatcaccttcaaggacacttccatcaaacctgactcacacagaaggcccagacctgagaaatgaccagcccctgggccagagcagagagccagaaggcaattccctcccccatcactgctgcactgggtggaaattgggtcagagctggccagcccattcatttaatccaaacgccccctttccattcagctcttagtcctcagagctttcagtccaaggaagcactatttcctctgcaaaataaacaaaataaattaagcccatgctctttgatctcagggcttttgtgtggctgatgaattgaacagaaatgatctgccatcctcctggcatctcaaagacactgcaaaaattcagctgtagcttccagccacctgccaggcactgtgctgacaaggaagcatggctaaggaaggcactctttgccacccattctcccagggaagcaagaagagtctgcaggaggcacgacaggggaagtcaaaagagtcaaagactgtgaggcaggattcgtctttggccacataggcatggattcttcttcctctgctcattcccaccccagggactttgcactggcttttgtccccatgtggcatactttctctggagaccttggaaagctggctccttctcatccttctcatgtcagcttgcacaggacctccggagagaaacctttcccatcaaaagtagcccccagactctacccgcatcactgtctgccagccccctactctattatctccacacttatcataatcagaaatgaccttgttgctgcatttgttctcttgtttgttttctgtttccacttctacctccgtgacagcagggacatcatctatcttgatcagtgccatatccccggcagttagcaaaacgtctggcatatggcaggtgcaaggcaaatgtttgctgaaggagggaggctgcatggaggagactgggccctctttccagtgccagctctgcctgcatcgagcactatgtggcgcatctagaccaggatccacatccatggtgtggtttccccaggctgcagaagtgcactgtggaagcaggtctgtgtgcttgagatcagggaaagctgaccaagaagatgggacacagttgattctggagaggcagggaacagacaggggactctcctaacaggctggatcttccaggacagttgaaggacaacatccagtaggaccctagaccaagagtatagacactgtcgctatgggtgtttctctgagccctgagacttcccatgtttaagataagctggttggattactggttattgattatgttgaatcttttggtggcacagaccaacttgagaatctgaagatatcaactttctttctggagaaatgcatgtgcttacatagagacaaaatatgcctgcacttcctagaagggcaaggacccctccgaagttcattcacagccccaggatgacagcctctcacttaaaggctcttgggccgccctgctagtcattggcctgcttgctctgagacccagtctttacccctcgtctgtagactgtggactacactccccaggctccctcgctctttcttctagggaagtttgttctattcagcaggaatgcaggcagaagtctgcagggtgggggcaggcagaaaccaggacatttctccctccttctgcatttggtggcatctccagatagagaacatgtccatcattatatctatcacctctgggtatcctgccctccccagagtcctttcctctgtgatcctgcccagcccagcaggccttctgtagttccagcatccgccaggtgctgctggatcctgagttctagaaaaccagctcctcccttccccctctagccctaggatgctagcagcttcctgccattgctattctctgggctgcctctccattttttgcttggctttttatctccttggacacctttataactagttccccatataaactccttctactagatattttggcatgaactctgggtttcctctggggtccctggtgggatcagcctccctccagcacgggcattctgagagcctggtagcttcctggaaaggccaatctgagctgaattaacaaatccctaggaaggtcaagaagatggaggggctgggaaaacccatgttgcctgcgagtgcagtgcctccatcctgtctggttccattccaggaaaaaaagttatataggaaaagcctcacaatcgcaatgtagttaaaaactgtttactgcctttttctaaatgagggaaacaaatgtaaggcccagagcagcctcccatcaaatcatgctcttgctcagatcaaacggcagcccgagtgaatattcctagagttcctacttgggagctcacgctagctactaagtcctccctgccaaaaagacccgattatacaaagtggggcagcaggaaagccagtcttgtagcatcaaagaaacacactgtctgaattccatcagccacaagcaggcatcctccacccagggataatgcagccagggcactgtgccccagaatggccccacccatgcaggagggcaccttccctcctcactgtgctggcttcttttaacaaatagccctatctatgagctcccttgttccttccaaccattctaaagatagggcaggcaccaaggccaggggtatgggcaggtcctcctccctgaggaccaaggcacagagagtttccaaggccacacagccacttggaagcagagctgggattagaaccctgcctggacagggaatgacttcaacttacacacatgaacaaacacgaatctcaactccctgttatggtggggttccccagacacacatgcatggtagagatttcagtgcaaatttaatcatttgaaaatactgacattcaaccattttttaacctcaaaaatggcaatttcatgtggcttacatgaatagtttatttgggtagtgatcccaggggagaaccagctggggagtggggaaataaaatgggaaagtgagagggcagggtttgttaatggtcaggacactgctgcagacaaccaaggctcaatgccactggagacctctgggagatggggcagaaccaccctgtccaacatggaaggcaccagccacattgagctatctacatttaaattacttgaattgaaaaacttagttcctcagtccactagccaaattccaaaagctcaataaccacagatggctggtggctatcatattggacagcacacatacagaacatttccatcattacagaaaatcataggggtagcactggcatagaccatgcctcagagctgtgtcatctgaggggtagaatctggggtatttatactcccattagggtctatcattggcaagggctgcacctgggggtatttgctgcaggcacttccagatgtcttggctcacactggtagggggagggaaggcactgacagtaggggcatttgagtgggataggaatagagtggcctgggggcatgggcagggcattcacagcctctgccacaatcaccagcccttcctgcacatcacctctgctcttgttgaagcacctctggatgcaggcattttgacagcttcttcgcaatgggaatgtggccccagaatcctctgacctgatgacaagccattctccctggagacaacacacagagagagacacaatccaggccttccaagcatttgtgatctacagcaggcagctgggacacagaccacagcatgcagcaactatacaaacactgactaataagctaaaatcggaaatctttatggagaaacccttgtgagcagtgcctggctaacagcatgtaggtgttgcctccaagaactgtctagcatttgagagacacagttggagactgagcgtccccattaggcaggctggtccccgaatacccacattattgtggtaatcaaaacacagctttgagacatcactgtgctggtcacaaacctggcaaggtcaagaaagtgctctgaagaccagcacccaaaatcttcacagcttagccttcctcccaggggcccgctcttggcatagcacagtggccagaacacagactctctggagcccactgcctgaggtcatgtctcatctcctccttcctcactgcgtggccttaggcgcactatttgatctctctgagcctgcatttcctcatctataaagtggacacaataacaataactttccaatatggttgtcaagaaaattaaatgagcccatgcttttaaagatcttataagaaggatggcaaactttttccataaagagccagatagcaaatattctatggcattgcaggtcacacagactctcacaacctctcacttcggtccttgtagctccaaaccagccataggcaatatgtaaacaaatggatgttccaataaaactttatttataaaatcaggtagtgagccagatttgccctgcaggccatagtttactaacccctatcttagaatgattcctgctctacagtgagtgctatatgaatgttcgttgataaagtctgctgcgctctcccacctctcagattcttcctgtattattattctctctgcctccctctccacccatcctttaagaccaagctcaagtagccttcctgaaacagtgtggagatttctcaaagagctcaaaatagaactactattcaatctagcaaccccactaatgagtatctaccgaaaggaaatcattagaccaaaaaaacacctgcactcatgtttattgcagcactactcacattagcaaagtcgtggaatcaacctaagtgtccatcaatggatggctggataaagaaaatgtggtacacacgtgcacacacacacacacacacacacacgcacaccatggaatattactcagccttagaaaaaaaatgaaatcatgtcttttgcagcaacacagagggaactggaggccgttatcctaagtgaactaactcagaaacaaagtcagacagaaagtgatgggtacactaaaagcccatgttgtcacttataagtgggagctaaactgagtacacatggacatacagaatggaataataatactggagactccaaaaagtgggacggtgagggggtgtgggataaaaaattacctattgggctgggcatggtggttcaagcctgtaatcccagcactctgggaggccgaggtgggcggatcacctgaggtcaagagttcaagaccagccttgccaacacggtgaaaccccatctctactaaaaatacaaaaattagctgggcgtggtggcatgccactgtaatcccagctccttgggaggctgaggcaggagaattacttgaacacgggaggcagaggttgcagtaagccaagatcacaccattgcactccagcctgggtaacaagagtgaaactctgtctcaagaaaaaaaaaaattacctattggatacaatgtacactatttgggtgatgggtgcactaaaagcccagactttaccactacacaatatatccatgtaacaaaaccgcacttgtactccctcttttttttttttcaaaaaagaggcctccctggaccctccctcttttcttagccacatccttagaccacttccaagttgctcttctgtggtgacccttgccccaccctgctatttgtggggcaacttgtttcgctgtagaatttcattgttcctgttaaatgatgagatgatccaatgtcttcattttacagggagggaagcaaggcccagagaagccaagcgacttattcaaggtcacacagtgacggcagagtcaggaccagacatggatgtgtcttgattcatgattcagtacagtcttgggcttaaggagatttcaatactgaggagagtggggacacagatcacccagccttctacccttgatttagggctggactaggtcacccctccacagaggttccttacttcctgcctcagcacccctccaggcagaacacttacggggcttgttgccccaactagacaggtctggctcacttctgagtctgtcacatatccagcatgggcccaggcacgctccagatgcaatagtgttgaccctgtgtgctttgtcttcctcttccttccccgtgagtctgcccattgccccggggacacccaggacagactcacagatcttccccaggggacatgtcctgttcatgcctatctaagtcatcaaaggcaaattccagagcagcctatagccagggctgtgtggggactccccactgactatggggcttcacagaggcacagcccaaagtaccatgctcacagacacacaaattcagacacacacatgcacacacacacacaagcagacacatgcacacactaatataaacaacacagacacacatacacatacacacggacacggacacacacagaaacatgcacacactaacataaacacatacatgcacacacatacacgcatgcacacaatgaaacaggcacacagacacatgcacactaacataaatacacacagcacatatactcagatagatgcacacacctaaacacaaatatacacatgtatacccacactgatgctaacacatacacacatgagcacacacacacatacacagaaacatatatacacttaaatacatatatgcatggagaaacaaatgcatacatgtgcacacacacacttagacgtaaaaacacatatatttacaaacaaacacaaatgtatgcactcaaatagacatataaatacacatgcatacacacagacatgtaaacatacatacacgtaaacatacacacatctatagatgctcatgtgctcacagagacccttatatacctatgcacacatggataaacacacacaccctcacacatgcacttacacactgtgtgatgtttttagcttttacctttacagacagacatgggagctttccctggaagatgtaaggtccctgggaaagggactgtgccctgggctctcccccgggagagagtcccgcccacccacagcatctgcctggtgtcttgaacacaactagtgctcacgtttcctcaatggacggatgaatgaagtcgtctcatgcctgggccttgggtccatggggagagcttggctcaggaagccggtgctgcctctatcacctctgagtttccaagccatactctctcaccccatcccagcttgggaaacagccagcatcttgctggcctcttggtggagtgttgctgatccatgcctctgccagaggtgggagaaacctcgatgaaactcaaaccaagtcttgacttatctagggatggctgaaggtcctcctggggtggggagaaggtggaagaaaccactgactaaagtggtcctggccccattctcccagcatgtaggttttctggctggactttacaagtaaaaaccacagtgaggagctcacttctacctgaggtaacacagtgcatggcccccacctgcttcccttcatatcactatcttgcaaaactggctcagagagagcctcctggccctgcgtagcctgggaagataccacccaccatcatttgttacctccccacagtgggaaggtgaagggcttaggagacctgcttcttggcaccatcacactgtactgtgttgtcaccctatctggacctcagtgtttcctctgcttctataaaacggggtgaataacctttgcctcctaaataccaaggatacagcatcaaggagaaaggactctgacctcacaggaggtgggaccaaggagaggggcaactcacaaaagcctgaggaagaacattctttggtggcacctccctgatgagcagagaggagccgctctgcaagttaagtaattgatggagcacacgctaaaaatacaaactaggttagcactcagggtggtttattgctccaagagggagttaattcaggcactcaaatctccatggaacagggactgtgagcccagagcagcagactcctgagccaggaggcctcatgcaacccagctgagaagtgctgtttacttaaaggctgagcaagacggaaccagagaaaatgggctggggaagcatagggggtggcagagaagggagtgcccaggccttaggagcatgagggaaagaaaggaggcaacatgcaaattagtaacaggaagtgggacaggcgacaggagctggaagggctactccctcctagattgggctgcaaagaccccagcctcccagctttctggagccccttgctattccaagtaagctccagagaccagcggcatctgcatcaccagggctctcatcagaaaaacagaatctcagaccccaccctagacctcccgaatatacattgccacaagatcctcagatttcctgtgcacactaaagtttgagaagcacaagattaggagtcaaaatccctgagttcctggtccagctattgctatcaaattgctgtgtggttttgcaggacttgcttgacctctctgggtgctagaatttcttcctctgggctacaggatgagtgaggcttgtttctttctcctgggttctgagaggctcaagtcagacccttcatctgcaggcctcggaagcatgggagggcctttacagaaaaacgtttccattttctaccaggctgcccccttccgctttcttggagtcattagtacacagagaggtagatggggagatgatccttgaaggacacactgcagtcaggaagaagacttcttaatgtcattttaagccttgatatctctccattaaaaaaaaaaaattataaagcagcctcttgctaatggggaagcagcgggtctgagtcatgctaagtaagccagagcatttcatctggaaatccctggtctggtgttacccattgcctttgggacattcaatatcactactgcacttgagaaatgtggcttctggggctcagagaggttaagtgagtgggtcagagtcacacagccagtgagaaacagggccaggacgggaagccaggctcccggccctctaagagaaactcttttaagtacctcaaggtgcccacgtccttgacagctgacccagactggtgtgaggacaggaagggaaaagacattctgactattgcctgagttggacagagttaagaggataaatctgggaggatatgatatcacaagggttcagatagaaagtttctaaattattgcttaacttgtttcatcaaatgaattgcttccctccattagcccagggctgaagtggccaattacctgccttctgcacaggacgacggccgtgtataaatcaacttgggtaggtaacaaaggaatagccaaaattctaaaacaaaaatagatgagagacttaagcacaccccaaaataaaacacacacacactcggtaactcaagtattaagttctgagacggccaggcctgagtccctctcggcctccatccagagaccaaacatacagtctctgatgatgctgagcgtggcaatgaggcctttgcataggccacgatccctgcagcaaactgcgttgccttccctgggctttgggaaggacacttaaggctggagattcaactaagtgcaaagctggtacctgcagacccaggggcaccagtcagtctacagctatggagggtgttttaatgcaaatggtaaggcaactttgctggtccctccttctggctccaggatggcacctcctggggctgctgggcttttcccaggtcttaaaaggaattctggtattacagaaatactcagagttttggagttagaacagcctgagtttgattctggatgctgccactcactagctgtatctgccttgggtgagccatttaaacatactgaaccacagctttctcatctgcaaaatggggataataacaatgccagtgtcagagggctatcaagaggattgaataaggttaacatatacaaagcaccctatcggcacctggcaaacagcaggcatttaatgagtgtgggctccctccaacatagactagaaaaactggtcgaggggtagcctctccctaggaatattctcttcctttatacattacattaagagggtgaaccagtccaagccagattcccaattccatccttcagcccaaggctgctccattgcacagcttcaggaggcactgcccatatggtggtctagatgtgtgacgcttcccggggctgggcagtccacaacctgcctcagcctatggagacacccatgggatgctaagagggaaagaagagatccaaatccacccttggcagaaaatgggaccatcccaagaaagtgttcctggcaggagctcagtgggcaggaagtaggatgcccagcaagggcatacccttggcgggagcatcaggaactaaggcaaaaatagaccatgaggcccagggctgcatccacctcttcctggcccagacctctctgcccctctgaagcctggctgccctcactcctcgatcctcagtgcctagcatggactctccacacccactctccctcacttcgcctggtctccctaactagagagcaagctccctgtgggcaggggagtaactgatatcactgtggtcctcttgagccaaacacactgtgctaagaaagcccaggcctgcatcatctgctggctagctgcttcttcatctccaaagcccaattgacacagccacccatgtatctcagaggatggttagagagcccaaacgatgctcactcagtctttcaacaaacatgcattgagaacctactgcatgagctctggagtgcaatagtgaaataggcagaaaggattcctgtcctcaaagagcttattctctagtgagagacaaaggccaatcaagtacacaaacaaatactacatattacatatatgttaaattgtaatcaactacaagaaatgagttcactgcattatataatcaaccattgaaggcttcaatagtcacagaaagactgatgcaagagacaggctgaatgtagctctagtgagagagtaaggagccagaaaggtaaggaggggagaatatgagcaaacaagcctcctgtgcaggacatttccgtctgctgtgaccacccttcacagaactgagggcttgcctgttctgtcacgtgggatgctgatgtccatgagggaggcaggttatcacctttgatttgaaagccctagaggcagtgaagttgcaatcagatagacaggacctgaaagaaagaaaaaagggagggaggggggaaaggggaggagaggaaaaggaagaggagaaggaaaaaaagaaaaagtagagaaaagaaaaaagaaagccagacccctgtgctaggaaaaatctagctagaggaacgcagagcctagcctgtgatcttaaggtgacttctaggccagactgtgaagggcaccatgtcataaagccattgccacctccatttgatgtgcaccatcacctctcctggctcttggccttatagattcaccagtttttaaaaaaactcttacattgcagctgcttctcagaggctgagactcagtgactgtgtcagttttcatcttaattcatgtctgtactgccacactgttggcaggacatgtttcacaccaaataactacactttaatcaagctctctgttggttgcattttttgatgatggaaagtccgtctccgaagcagttgtcttcactaatgttgactgagcagtgctcagcagatgtaatgctgagcgaataggggatcccaagggactccagggtgccagtgcgatgatccaacagggttccagacatggcaatttagttggacttcatcctcagtcatagaatccagtggcagaactctatgtcacagcatcacagttgtgtggacacacagagctgccagagactataaaggccatagccttttccaccagcgcctgcatttgcccctagggaaagccaactcgaggtcaaggttagttcccaagtttccagacttgagagaggacagtggtcagagagtccagaagtttctgaaaggctgctccaaaagggcagggaggcacagcagggccacttggccactcgccgagttctacattcacagggaccacgaattttgaccttgaagctattcctgattaggttatgtacacattcctggagatgtattcatggaaggaaaaaatatggcattgatcatctgatttaaacttttatcctgttaccagatctcattctggtagtacactaggaattaatatgaagtttgcaaattaagtattatcctttgaatagtacaatcatattgtttccttgtttttatttttatttttatttatttttaaattttttgacacagagtctcactctgtcgcccaggctggagtgcagtggtgcgatcttggcttattgcagactccgcctcccgggttccagtgattcttgtgcctcagcctcccaagtagctgggactacagatgtgcacaaccatgcctggctaatttttgtatttttggtagagacagggtttcaccatgtgggccgggctggtctcgaactgtcagaactgtcaggggattctgtcagaaccaggggattctggagtcagaatgcctgccatcttctcctatagctctgtgtctacacacaagttacttagcccctctgtgcctattaagggctgatttatgttccccaccaaaaattcacattgaagtcctaatgcccagtacctcagaatgggatgtattcagagacagggtattcaaagatgtgataaaattaaaatgaggtcattagggtgggtcctaatgcaatatgactggtgtccttagaagaagaggaaattaggacacagacatatacaggagggagatgatacatacacagggagaagaaggcagtcttccacaaggcaatgagagagtcctggaaccgatccttccttcacaacccagagaaggaaccagccctgccaacaccttgatctcagacttctggcctctagaactgtaagaaaattaatttctgttgtgtaagccacctggcctgtagtactttgtcacagcaggcctagcaaactaatacagtgcctccctttcctcatcaagaaaatagaaatgataatagtcccttcctcacagagatgtgttgagtacccagttcccagcactcagtaggtgtccagcaaatgtttcttgcactacttgtgattagtacagagtcttaacccaacctggtctctgcatgcttcatcttactcttctgtgtgagaaaagaggcttataatgaaagcagagaacagtaaattctgcagacaagtcacacacttcacaatccccaccaccctccccgaccacttcgccccaagcaccttaaggttgaatggtttgagtcccaaatctgcacttgcataaggtttcttttgctctagccatgtactttgctgactgttgtaggacccgcctgcccatcctgtgttctctccacccaataccttcaaaggccacaataggaaccccgctactccttggtttatcaatattagacaacttaggatgcagttagagatccacacgccatccaagtccccacattacagaaattagaagcctctccttccagtttattggagaaggaggatttctggtcaagacgtccaccttcaagatgaggtgaagagcagacaccactctggacagtttgcctggccacctaaggaaaacacagcgtttagagggcagcgccagaactgtgtctcctcaagaaatttgtcttgagaagggtccctgaatataacggttgccagaggggactccttggggcctagagcaagcttactgggggtcctggaagagttctcagaggtgtgtgaactcactggcagctgactgagaaactgggagtggcacaaagacctttagaaaccaataaggacttcagaggtatcacccacaagcccagaagtgtggccaaactgaataccccagctctctgctgcctcagcaaggagccagggattcagtgatggtgtcttcttccaaacctgtatggcatggtaattaaaatcaaggtcatttagaacccagaaaccaaagccattctgactctagagggaattttaatttgttaatggatcttccggctgatggctgggggaaaagatagcaattcacaatgggtttgaggccaaaaatggcaccacagtggccgggaagccgctgatagctcctcggtcagtcttcaactgcagcaaggaacaggctgggctacccagggatacagatttttttttttaactttttaatcagctaatagcagatgaagacctaacaatgctgccaagattctgctccttctgtcagcagtggtgagaaggaggccagggtcggatgcgtccggctgcctttgctctctgaggttcttttggagggatgtaggaatttggggctgaggaggaaaccccagggccatcttctccactggtcaccaactgcaaggatccaggaaagggaaacaggtggaattctcagttccctatgccaatcctgggggagggcctgagacatgtactgtattaatttaccccacaaatgattatgggctgcttaaacggtgccacagatgtaatggagactcagcaaactgaggaggtgaggcccggaaacgtgtcactaaagctgcttactgtgtgccgcaaagggaagactccgggtggcctcagacagagggagggtagggcagcagaagagcttcatccagaaatgtaaaccaaaggcccggcaccctaccttgaacacccagtgctgccggaagatcctgtccccacatgagggctctgggcaggggatctcctcctaaccagcgccagcgaccacaaagggtgctcttcagtggagaagaaaaagaagaatctaattcctgacttttatttttagctgcaagtcagacagaagagcagaaagaaggcacttgaccataatcctgatcatactgaacgagtaatttaatcatttttaaagcctgtgtgcaggctccgccatcttactggggtctaacttgggaaactctcacctcatttcaagcaaccagggtttctctacaagagccatcaaaaactacttctttagaagcacaatttctaggcatttgttttgtccaaaaacttggattctcttactttgttccttgagctaaatcaagcacaactatgccagctgaggcagtgaggagaaaaccggggtggggaatgaagcaggcaagagggcctcctgccctcagagaggcagcccggctcatccaatggatagacgcacaccatacacacaccacacaacacacatgtaacacaacacacactacacactgcacaccacatacataacacaactcatactacacacacaacacatatacaacacacaatacacaccagacatgttacataactcacactacacaccacacacataacaactcacactacacacacaccacacacaacacacaatacacaccacacatgcaacacacactacacaacacacattacacacataacacaactcacactacacacacaacgcacatacaacacacaatacacaccacacatgtaacacaacacacactacacagtgcacaccacacacaactcacactacacacacaacacaacacatgtaacacaacacacactacttaccacacacaccacataacacacatcacacatacacacaccaagcaccacacacaatgcaactcacactacacacacaccatgcaccacacacgtaacacaatacatgctacacacacacttcacaccatacaccacacaccatacacatacacacagcacacactacacacacaccatacactgcacacactccataccaaataccacaggtcacacacacacaccacacacactatacatatacatacataatacacacccaacacatatagacacatcacacactacacacacacaccacacacactatacacacatacacattatatacacatatcacacatacacacataacacacatacacgcattgtccacacaccatccacgtacataccacacatatacacacacccaacaaatatacacgcagcacacacatactatacacacattatacacaacgcatgtacacactatacacacatcacacatatatacacacacataaacatacaagtggtatacacacactatacacacaccatatatatatacacaccacatacaccatacatacaccacacactacacatcacacacacataatgccacatacacacaccacacacacatacaccacacaccacacacatgacacatattcacatacatgtaccacatacacacatgcaccatacacataccacacacacacaccacataaatacccacacaccacgcattctgcacacactacataccacacatatcacacatatattatatattcactgcccacatacacaccacacaaatacaccacacacacacacactacacacacactatacatacatcacatagacacagacacatacacatagcacacctaggcacactatgcacatgtcacacacacatcacacacacacagagagcgtacatactaaacacacatcacatatacacatacacacaccacacacacatactacacacacactatacaaacatcacagacacagacacatacacatagcacacctaggcacactatgcacgtcacacacacatcacacacacacagagagcatacatactaaacacacatcacacatacacatacacacaccacacacacatactgtttatttccttgctttaataaaaaaataaaaagagagagaactttaaaaggaagcagaggaaaataggcatttggaaaattagccccatcctaccatgatagctcctataaaacatcttctagagtctgattttcccacatctaaaaattatttctttttattctgttgttgtttggcactacaatataaatatctgtgcgtgcagaagcagcttttagtctttcatctgtgacatctgtggagagcgctggagcttgtgtttattcataggcatcagtccgttccacccttcaaacaacaaaggaggcaggtggaacccagagatcagaggagtgaagacattagctcaagggctcaggatgggctccaggtgcacttactctatgctgtctgacattcatggtgggctcgtactaggattgggcagggtgagtttggcaaaccaaaacccaaatgtgcacttcccagcggggccacccaccagggtgctgtaccctaaccctccacggctgtggcctgccctgggtcacctcatggcctggtgctgcccttcacacgaggaaaacccttctgtcagttcctagtctccatctttctcctccctgattccaaagtgcaggtgcctgctgactgagttctttttagatgaagtctgttttcaccataggccctcaaccaaaggccagttgacttcaactggccaactttcatctcaacccagaattacagctatccccaggaggcaggcattggaggagttgctggaccgcagaactgaacactcacatcctctgagaaacggagcagtgaaggctcttgcaattatctcctgaggggggctgatgaactgggggccccagcctggagcagtggaggccaagaagagctttagccctgtcttcaagggcctgaagagagtggcccagtggtcagatgtattctgtccatccccagggggagaccagaaccaccagacagaagatttagagagaaatctctctcttgcttttcagtagagcctgactttcacaagataggaggggcctccgtggatggaaacaggctccctggcacaggaggcatttaagaagaggtggatggtctctcagtgggacactggagcagggggacagacatcgggggaagggtgggccagtgcgacctttccaattgcctcccaccttgagaatccctgactcgacagagtgaatacacagccatctgagacctcctggtcacctgcctgcagggctctcttctgggcctaaaaataagattcccagagtcctgatccaaattagatccttaataacgtgtcaccatggctataaataagtctctttgagggccagttaatataattattttaatcagctacactccctagaaggactgccagctagctccccgctcagcctcgctgcgttctgaacaggtgcgctcctcctccgcctcacccagggccggtccttagagcagtcacaatgatgaagggtgggtgggcagtctctctgcttccctctctctaatgtccctgagacactccttccattctggggcctacattctcccttgatcattcaccaagacttccaacaggaagacaggggtgaaaacgcaaagtctacaagagccagacacacagcaaagacatgtaaatcacacacggcatgatgtgagagagagtgttacggactgaattggttccctgcaaatccacatgttcatatcctaatccccaggacctcagaatgtggctgtacttggtgacagggtctttgaacaggtgattatggttaaatgaggtcattagggtgggccttcatccaacaggactgatgtctttataagaacaggagattaggacatggacagaaaaaagaccatgtgaagatacagggaaaacaaggcggccatctacaagagccaaggagagaggcctcggaggaaaccaatcctgctggcaccttgacctcagacttacagcctctagcagggtgagaaggtaactgtcggttgtgtgagccacccaggcgatggtcctttgttacagcacctcaggaaactcacatggggcgcggtagggtgtgccctgtctggaggttccacattcttttttttttctctctctcccaaagactggacagccaaacaacacagagccctggacttctctgtcattgtatatgactccctgagagaatgtaaggaaagaaaagcaatagggtgtcagagaaaggacattggcctggccgggagagctggtgggtttagccaggctacctgagcaagctgctcagtcttgggaactattcaattatgttggcccccatcctatcatcagttaactgaaacacctggcccacaatgacctttaaagagccttccaggactaacaattttgcccctgggtagcaaggggcagcctcagatcatgagcctagaagggagaagccctggaggacagagtgggacaactgcagaaggagcacacagaggtgtgggtgatgtcaggaggctgcttgactctttcctggagctaggagctttcgttcctgtcccagctgctctatttgctaagtgcctcaacttgtccccctcccgggcatctgtaaatgagataataggagtgcacgtgttgtgtaccagtgaaagtctacactatgccaagcatgctcaccattacgaaagaggacaaggacaggtgggtgcccagtggcttctcaagactgacatctacatttatcagattccccaaggggcaactccctgggcaaggcaaggtgggtcttcagagttggggccggagtgcctgtcttctccccaccacaaacctaggtgccacattactatacagtcctaaagatgctttaggattgtggtttcgtgctgaaggaggcaggggagaaatcgtaacttgcatctcccaaaggctagaagtgaaattaagatccttacacacgcttagtggtctgcattttacatagagctttcaccaatacaatctcccaggtattattattcccattttacagatgaagaaaccaaggcaaggggagattaatgatgaaaataaggcagtgtaaaaaaaagcacaaggcttgggttcttactttgacctttaacaaagtcacttaatatcttgttatcacatggcctgcaaacaaagtcctgtagccagtacaagcagggtcaaaacatgacctgaggacttccacccagaacacgccatatgcacatttcacagattcaaataatctcagaactggaagggcccttggcaatcacagatctgattcctttggatttatgccaaggaaactgaggtctaaagatctccttgctcagggtctcacagtgaggctctggctggactaaaaccagagtccagggttctttttcatagaccatcctgccctgtcaatttgacttcaaaatcttcctcttcaacacaaaccacaaccacaaagagaagggtcttctgggttatctgtattgggttgcagaaagaagttccacccgtacccccaaacctggatacttcctccaggccgcacggtgctggcctcctccagcgactttgagcaggagagcaaatgagtcaagctcctctcacaggatgaggctgctgggagcagctcagaggactggaattagaaattctaattattagaactctcggaatgcaccaaaggacaatttataattagcacatgtcaaaaggccatccgcaaaggggacacattataaatcagaaaacaaagatggccccagaaagggactggggagctgagctgtttggcctcccacccctcctgatggccctaaatccaatccacctcccactcctgtgagccctcctccctcctatgccagcctctctcctgctgctctgccctttgcaagcccagcattggtgcttcccgctccctaagccctcttccctctgctgctcggtcagggccactgtccgaaggccttagcacagggatccctctcttcagggtccatgcagctctaaccccaggtcctgagcgggtcagaggcttttggctcctgctgtcacaggctgcaaataaggatttaatgactagcctttttatgaggaagaaaatgtctccagtggactgataatgtcatcgtctgctgctcaggtgcatgtgcccaggtaagcctcacagccagaaccctgctcttatgatgaaagctcagggcacaatcccagtgcagacttggaaaggccagcatgcaaaagaggtcggggcacctccttgtttcttccatgaatgaatgaatgaatggattttctactgacttatatgccataaatattttcttgagtacttcctatgtgttagtcacagcacttgagattggagaggaaaagcagtcaaaaacacagaaataaataagacacgaccctaccctcccagaattcatagtagcacatacttgacaggtgaaaacatttttagaaaaacaaaaacgaaaaccagcaagagaactggcatctgaaggcaggacacctggattccaggaaaagctcttagctgcatgacttgcctcctgccggtcatttgtcttccttgggcctccatcatctgtgccatggagataataccaacttcgtggatcccacaggggttgccatggaaaacatgataaaacacaggaacagaccctctgagaaatgtctgcagtgtaactccttatcataacacgaaacactgaagattctgttggctgataggaataagaattctattttcccacacttgccagtctgactcaagatggcacctagttccttggacaaagatcccaagggtagagaaaggcaatttatcaggccaccatatgtctgtgcttaccaaggaaccttctagatggtgacattttctcatatgctgtggctcacaggggaaagactgcctctatgtctagggatgacaaggttttattccaggagcaaatgaaccccatctgtgtggtagtggctgcctggagcactgtgttaaaaaagatcctgaagttgcatcttggcttggctagaaagaacatcctgatagattatggatgtctgttatgaatatggagttggggagtggcactttgttacttgtgacctaggaagataacatgcccactcaaccacactccttgttgcacacctttctttagagctgtgtcctctggccattcaaaggtgagctgagtattggtcaatgccctgaacacgattccttctgtgtgaattgttaatattaagttcttagagccagcaaagcctaagacatatgcccagcaagaaactgctatttttaggaaattagctggtccttcagacccggttaaatgtgctaggtggtctcagtcatgttctttataaactgagaagaatgcctcacaaatttgggtgtcattagggtctgtggatcccgggcactgccacacaaaatcacccggttcaaataccctgcaggtacatgataccctctgccgttaattctatgccattttgttgaagtctattccacttccttcctttaccacttctcaggacaatgcattctctgagtttattatgagctttatgctctatgaattcttgccatttttctaatatttaccctgcttgcgttttaaaggggacctctctcttagcatgtcaggatgtggcaaagagtctgtactggcttagttgctctgctcacacttttataaaagtctattatgtctgtgttaattcccaacagagctgagctgcagtcaacccctgaactacttattaaaaagaagcactgagcagatgaacgctctgctcatgactgagaggggaagagaacagactgtgtccaagtccatcaacacatcatctgtgcaccaggaatgctccaaacacaaacagccctagtgagtcacaaggatagatgaatgctacggtgattcttacatttgcagtcaggaccacagagtgctggagacaagaggcagcttagaaaccatctagtgactaaagatgcagaaattcaggcccagaacaattaaccggcccacagtgttactccaagccaggtatacttactataaaaaagagtatcacaaaactctacatgtgaggtatttcatttatgtctctttttgctatttcagatggtttcctctcagaactaaaagcacattgtattgcacattgtagatactcaaagtctgttaaataaataaaccaatgaggtaatgtacataaccctgcagaaggatttcagtacaatgctatttataatagcaaaaaagaggaaaaagtaaagagcaaatataaggaaaaggagtgagcatccatataagatatagtcatttaaaatatgtttatagagtcccagtgtcacttggaaatgctgataacgtaatgttaagaagaaaagcagaacactaaatcgcacatattctaggatctcggcattataaagaaaaatgcacagtaatatatttgggggaaaataaaacgaatcatgaacagtagtagatgtttctgttgtgattatgggaggttttatttctgcttctttgcactctgctgttttttgcagataatttacaatgtgcccataggattttcataagcaatgcgagggtattaagaaatagaaaagaatatccacagatattattcagccttgctgggatttggaaagagacagagatcatttctctcttttcacataaagaagctgatgaaacaaagagacagagacactagtgatgaaggcaggcattagctctctggtgtggagggccatccaatgccaggcaaacaacagatgcgggataaaatccactcaaaccacagtgggagggggcaggaggtgtccagtcttcctcttcacaaaggttccatccttaccttatccaaaagatgagcaatacaaggctaggctcagcctttaccagcagagcctccccaaagactctctggcccctgcagccaatgacaataaattaactatcacagtgaggtttttccccttcgtcaggcaatgtgctatacacattgtctcattaaatcctccccatgtctctgaggcaggtcttactgtgcccatctgagggatatagagaccaggactcacacaggtaaacccaggtggccaaggtgtcacagtttgtaaccggaccccagaagcctaagccctcgcccctgtgccccggctggtcattcgttcctccagatctttgcagcactaagaagatgctgcctggtgacatttcctgaattgtttcccacgggtcttgtctttcaggctaggacaagttgtttaacctttcacgtgcgtctgtctctcttgcttccctcaattggactgttagctcctgagggggatgagggggtcctgctttataattccttgtgtgtcccacggagccaagcctggtgatgtcttcagtacttgacacttcagatctcagaaaatacctgctcatcgattattggattgaataggttaaggaggagaaccgtctcatgggcagacctggcctgcagccaagacagaagctggatgcgcctccctccggactcttgaccccaccaaatacgacgcccatatatgtcaactgtggcattggtgtttgtcccccacacccctaaaccacaagccaataaattgcagggcactcagacatcaggatgtgtccttcacttgccaccagacctgagctggctacaggccaatgacagcatagggctggccctgcccgcctcccatctggcagcaaggatccagttccagattgtgacctgtggttgagtctggcacagtgacccagggctccagcaggcaaatcccagtcataaaaccctggtctgaaccagccacgtgatggaccccagttatctcttcctaaattgcagcagagctgatcttcttccagctgagccaagggccatcagacagggacacgtttacttttactatcctattaaagcatcccagaaaaaaagaaacagtccccatatcctagagcaagaaataagcaaatcattatctacaatgatatcctttaagtctaagcttgcccagaaggtgctgcacatttggagaccaggctatggctcccctctctgaattcttttgaaaccgcagggactgttacaggcgcctccaagactctggagccacagcttgcctagcgcagcttccccctcccggcaaagccctccctgacaaccctacccacagtaatctcaactttcatgaaccttttctctccccatagggtgaacacataaagacacacacgtgcagccgggcacggtggctcacacctgtaatcccagcactttgggaggcggaggtgggcagatcacctgaggtcaggagttcgagaccagcctggccaacatggtgaaatcctgtctctactaaaaatacaaaaaaaaaaaaaaaatagccggaggtagtggcgggcgcctgtaatcccagctacttgggaggctaaggcaggagaatctcgaacctggaagggggaggttccagtgagctgagatcatgccactgcactccagcctgggcaacagagtgagactccatctcaaaaaaaaaaaaaagatacacatgtgtatgcacatacacacgcgtgcacacacacacatacacacagcgtgtacatgttatttctccaatgaaagcatatttcccttaagggataggaccaatcacttatctttccagagtctaactgaaaaatggacccaacatccttgaattaataaataaatgaacaaataaatttgttgatggactggtcagttgataatgtcaaggaactccctgcaacagcctacacaggttcaccctcctccaaaatcatacctttccaagtccaaggaaatgctcaattcaatcatgctgttttagaaataaagtaatgaatgatattaacaattgtttagaaactaacaggtgcctggccaggcacgatggctcacgcctataatcccagcactttgggaggccgagacgggcggatcacaaggtcaggagatcgagaccatcctggtgaacacagtgaaagcccatctctactaaaaatatagaaaaattagctgggcatggtggcaggcccctgtagtcccagctacttgggaggctgagacaggagaatggcgtgaaccctggaggcagagcttgcagtgagccgagatcgcaccactgcactgtagcctgggcaacagagagagactctgtctcaaaaaaaaaaaaaaaaagaaagaaactaacaggtgccaggtactaggcttttgatataaatctcatacgttaatcttgtaagtgaggtagtattatcattattatccccattttacaggtaagaagaataaagaccagagggctatccacaactgaagtatagacagtgggtgaggaaacatgaaccaaatggttcttccagactcagggccagatccctggcacaaagtgcctaccctgcattgccttcagctaacgtgccaagcagacagttcccatccttcaattttatttaatcaaagcaaagaattcataagaatctgcccatgttcattattcaggcagattaaatatttgatagccctgtagtttaattttttatggctcagagattggagtgaagtgctccctgggaagccacactgtccctgggacagggcagcagctggccaaggaggccagaggccgaggctccacagggctctgctcagcacccacgtgcatctgtcctgactccagtaagctgctcatgctgggtcccagggccaaaggttacagacactttgtaagtttgcaagagaatctacaaaaaggaaagaagggctgtggggacaggaggcttagggcatcacaaaatcagaaaggaacccagatgaaccaaaacatccaggtcccaggaaggggaggcagcctcctccttctgtctctgaccacgcagcagaaacaaagcttttggacaaatgcatgagacggcataagggcaggatcaacttgtccatctctctgccaactaaagcaccacagggccatttgggaccttttgcctgccccttccagccacatgtaaccttcacagtcactacatattcctcccagttcactgtctccctgcagaagcttgaaagtccacagagaacaagaagagctgggagccaagagtccttcacagcctcaatctgttctcctctggcctaaagaagctctctttcctagtccttttcttatcttcaaaatgaaattccagcagtttttgtctcagctaccccaaaatgcccaaatgtcatgcagcatgatttcaatccctgaactgctccaacccaccccgatgcccccaagtctctctcttgctctccttccctcctttcctccttccctttctccctccttcccttcttctctcccccatccttcctctcttctctctctctctctcacatacacacacacacacacacacacacacacacacacacacacacacacacaccccttgttcttctgtgcctaccatagaacaagacctaatatctaagaatttcactggtacccagtcaacatccaaccaattaatttgttcaagggtttagaggggccaggagaggagactttttcactccagcagcccacggagatttctgttttaatttctttttaattggcagcgccactaacagcatatcagaaatctctctgctccgacccttctcctctcctctgttctcttcaacttttacaagggaaggacatccggcagttttctggaaaaatagagacatgtcacagcagagcccagctcctttttcctgccatccctattcatcaccagcctcctgaggagccggggtggtgacacaggctctcacttcatccatgtggggctcatcggggcaggtgacgaggagaaaggcatgcgccactccccccagagatggggcctgtcgcctcctgggaaaactggggtggagggctctcttccccgatcacctggctctatcttgctctacagacacctcactgggccctcagtactctcatgagaagagagcagacttccagccacccctgcttgccactccaggcctctctgctgatgggtgtatggccacgggacactggaaataacaggagtgtgtggtgagggagaactgtttgcccattttccacattcaagaacctggtgaaaagatgagcaaggattatctccacactggaaccattcatgctgcaaaaacagcactgagacattgaaggggaggaggcaatttatttgctgtcttgacactgtcgcccaagcaattctcatcgtgacaaaagaacactctggacaatcactgcccctcctctttcaggaaaccacactgagttttcatgacttgcaggtgacattttaataaggaatcaacatggaaccacaggggaagtaagctgaggccaggatctaggaggaccagggtgggaggggccaaaaatggcactcaggaaacaaagtcacctacggtgcaaaggctctttgtgcctgcaagtctggcaccgtgggatttctggcttttttctcctctctcatttactatttgggcagaggggaagtattttccagaaaggacaaagtagaagcagcctcagtaaagagctctctagaaacttctcctattcagttggtgttttacaaagtgcaaagcactgcaggcacctccattcacttatcccgttacgtgggtgtcgttatctacatcttataggcaaggaaaatgatgtgcccaaggtcacagagctactgaaagaaggaaggagaaatcagacatttctgtgccacctccttatagaagttgccgtcccccatcataatccaattaatggtaaaaatcacaactgaggctagatatgcagtaactccttgtgctctgcacagtgctaagcactttacatcagttgtctcctattttaatcctcatactaatgccaggagagaggtgttatcactctcatttgtcagatggggaaatcaaggctctgggccatcagtcacttgtcccaggccacagaagcagcaggagcagaaccaggattcaaactgtgtgcccctgcctgtgtatctccatggttctcaatcttgcctatcatcagcatcacctggacaaatggtccaaacaagacatgctgggccccacccaaagagtcgctaagtcagtggggctgaaagcaagcctaagaatctgcatcgccaacaacttcccaagtgaggctcttactgctgatatgaaaactccactttgagaacctctgctctgtctagcctgcctcttgtcacccacaagctaatgtgagcatcctgttagacaagtaatggaacaagatgtgcaaaatgtggctgcaggaagttcacttcctgatgcacaaaatcgctccaagaaatcacacaccatccagaaacacttaagcatcatctgcattaaacatcaactaagggatgttctaagccaatttactctaagactcactctctccttcttctgaacctcctctgctgaaagtgaccatcttccagccagcccacctcatgatcattaaaatacagctgtggagacatagggagcacttctgaatgagcaacccccatcagtgtccactcccacgtgtgtatttgtatgcccatcatgcaccatatggtgctcatattacatacgcaataaagtgcacacagatgtaatcattttaaagagtgataaacgtaaatagaaatagatgtcttaacattttcttcccctattccaaaggatagttttgtgcatcccactttggaggctgctggtctagaattcactgttcccgtttctaatttctgatcattagaatttggcaaccaccccctgcccctgcaggctgaccgagcgtgtctgaagagttgctgtgctctgtggttcgaggaaaagccgtttcctttctgttagcaagcccctagagaacacaggctgaccctccaagacttgcccagcacaagctctgtaagtaaggatggctcagccaaagcttcttgactgtgggggtcttttctccaaaagagaataagaagcatctcagagcccatagagaagacagtggctgtctctaaaagcttttgacctaacaagcaagagcaggagactgagccctcacttctaaagcagcaggaggagagggaactggatcagggtcagagagcaggccttgggatcagcctccaccaataaccatgggtgagactgggaccacactgtgtcccccaaggaccaatgtccttgcttgtcaaatgagatatagggtgaccaaccagtattgtggggcctcccagaatgccagagtttagtgccaaaactgaaacacactagaatgtttggtcaccctagctgtggaccaggtaccgggctctgggcaactataagtgtttatcagccctaccctgacctctgctgtaaggtatcctaggagagcctgagggagctggaggccattccctgctcactagggtgttgcaatcctaacaagatagagataatgataagccatgccaagtcaaatgtcaataccaggtcaaaacagaagctggaaagaggacataatgtaggctgccgtggccaggacagaccttcaggaggagggcagggtgcaggaggaggcagattaagcacacactgaagtattctttcctcaacctcacctcatctcctccctccccttccccaccaccaagtagagcaggaccgcagagaatgaacttaggctctggagtcttcctgtttgattccaaatctggtgctacacttttccttttggagtgatctcgggaccattactcaaactgcatagctgaggtattgttttctttaaaatggagccaattataccccactttccagggttgttctaaagattcaatgaagtaatgcacacagaacactttgaaattgtggctgagagcacaagctctataaatattggctgttcttaacctctcttgacccttttcaatctgttcgtgaatctaaggtattttcaaagaacagtgagctctccatgagaatgagctatcctgaatatttctgttattaatgatgggtacagccggcttagttctgcttctatctgtcactcctgaagccagggaggatgagagggtgtgtggagagaaagtcacagggaagccagccctggccccgggcaaagcccaagggtttctcctggccctgtgcataataagaagcagcttcctctgtctccatttccagctcctagccccaagcaggcaagtcatggaggggtttcccttcctccctagtcccccaggttctgaagaaagaaaggttcagaggccttctccctctgcagaaagggtatgtcacctcaggccatgacaagtccccagctaagcatccgctcaggaccacttaaagctcttgaaaatgagctgtcttagctcatggcaggtttcaagaatccctgcaggatgaaataccagcagtgttccccataaactcagtcagcgatgttgatggtaggaaccaggaaaggtaccgtcctgcctaactttctctccatccagctcagccctagaactcaacacatatagtagaatctagatgagtaaacccccacacagacttggccctgaaattccaccattaggcattcacttctttgatatgaacttcttttctgtaggtaatacatttttttttggttgcctggtatgtcaactggaacacacttaaatgaagaagaccaagattcacctcagcctctccccttagaaatctcgcaagtcaactggggaaaacaagccacacagaagtgtaatacacaaaaagaagtgtatacttcttcaaaaagtatatacttttggtgcaatacacagaaagagagagaagtgcaatacaaaagagagagagagacactatcacacttgccctcaaagggatacccccaacaacactgcacattccccttaccacacccccattgcaccttcaacacaatatcccaataaaagtaattagattaaatggtcattgtttgtcatgggcaattctctcactgtactgtgagttccttgaggcaatttttctctttttatccccaaaatttcgtgcatgggacagagtaagtagtcaatgaagatttttaaaaattgttaattaaggaatattttaataaaagtaaaatggaaatgcaagacattttgagaagggcaccagcttaagccagtggtcctcagagatggccctggacctgcaacatcacctggggatgtgtaagaaatgcaaagttgtccctaccccagaactacaaagtcaggagtccccaggttgggctggtactgtgcgttttaacaaggccatccaggtgatgctaatgcccactcaagtttgagaaccaatgacttcattcagcctttatcatcagacaccttctgcaatatgggttaactgtcctcaactctgtgaatataggcatatattcattcaatatatgcctattaataagcacccatgcagcaaaggccaggtggagccagccctggtcattaggtggcccaacgatgtcgacaagatggcagacaacatggtgagtccctaagcagttactcccaaagaccctcaaaggctgttctgagccaacaggaagaaaggccaccaagttgtggctgtggccagctgactgccctttaggaggagctgtgaggatgagatttcctagcaggaagctgctctggggaagggggatggcatcctgacacctgggagcaacagcctggaccatggattgggaggcggagggaatggggcagggcagtgggccacccaccttgtgccattggctgccggaccctgagcactgactggtttggagcctggtgtctgggctggtaaggaagcaaaggtgaaaggggtgtgggataaggcaaggtgagggagcagctgagccagcatccccttctgatctgttgataggctccacatctaggcctcttctaaacaaaaaggctgagctgccggctcagcagcagctctgtgggtgcacagccctgcccatcatttccccctgtattaggaacaaccgcccaactctggcccctggggcaggcccagagcccaggggtgacgaggagacagcacctcagccctggaaggtaccatgtccaagtgctcctcagccagggcagccatgttctctggaaaccagtagaagtgcagaggacactctgttccccaatcaggggcaaagttgccacaacttctccagacttggttttccagggccataggtcacctgctgacacttcatttaaaccattctcctgttataaaaagggacagtttggccaacctctcaacttacaggccctttagcccagtgtggctagccggctcttcccaggcacccacaggccaggagctaggaatgcctgctccactcaaggcccacctgccccttcccatcttccccctctaggcagagggggtcataagggttgcaggagcctcagacaggggtagatgaccccagggcctacctgtgatctcagggcgatgggtagagctcacagggctgacagacaaaagatagggtgccagttacatttgaaattcagaataaacaagaaataattttttagcataagtatgtctcaaatattgcatagggcatacttaaactaaaaactaaaaaccaaaaacctatcttgcttatctgaaattcaaatgtaactggacaaccttattttctttttatttatttattttttattatttatttattttttttgagatggagtctcactcttgtcgcccaggctggagtggagtggcacgatcttggctgactgcaacctctgcctcccaggttcaagcaattctcctgccttagtctccctggtagctggaattacaggcacccgctaccatacccggctaattttgtttgtatttttagtagagacagggtttcaccacattgaccaggttgacctcgaactcctgacctcaggtgatccgcctgcctcagcctcccaaagtgctgggattacaggcgtgagccaccgcgcctggcctggacaaccttattttcatttgctgaatctaccatccttactctatcagcaagcccagaataggaaaacctggtttttccaaagcagagcttaatatcacaagagaaagagccttgaaaatactatagagtaaggcctcattcacatgggtgaggttgataatttacttcacaggtgagatgacagtatcaaggttctgtctggcctctggcctctggtcaattgattcaaactttggatcccagctctggtgcagctgtgctgcctaacctcagcaagtcactcccccttcctggtggtcagttgtctcatcttcaggttaggacagagtttctcaaccccggcactgttgacattttggtccagattactctttattgaggagggttatcctgtgtattataagatgagcagtgtccctggccgctacgcaccggatgccagcagcacccaccccaatttgccaatgtctcatgggaggcaaaatcatgcctggttgagaaccacggggttaaatgaccctatatcctaatatctagggctcccaccacttttaacagtcgagaattattgggtttacacatgaatttgtggcaaagattcctcttaaatatccaactcccataatgaatctaacaggagatgtgaatgaccagggtttgattacatgtaaactttttaaaaatgtatcctctacctcactcccctcaacctcattccagcattcagaaattgacctagcctgattccagcaagtggctccagctctttgatggccttacagacagcaatgacttaataatactaaaaaataaaattatcatcaccctgattgaagggaatgatttactggaacttcttgggcaaacagtttttgctagtttaatattaatatgactactactaacgatagagtgtgtagagtgcctacaacacgctaagaccacactaggttatgtcatttaatcttcacaatagacctaggaggttggtgctgtgcttattcacatttagcagttgaaaagaaattaggcagtttgcctaaagtcacagactctgcctgtgctctttccaacacagaaacagtctatttacatacagctctcacaggagtagggaaattcattcctccctgggcctccattccaggtaaatactcacagtctttcatctccaggaccgaaatctctaggaccacacagaaccccagtccttatagggctgccacgtacagacaacacactggcttgtaaatgtatcttgaccttgcttttaccttgaaccactctttgtaactccagggcctactgtaggagccctaatcagccctactgtaggagccaggcccacatcaggcactccctcaataaatggttgctaaataactcagtgttcccccatttcaaagatggagacactgaggtccacctctttccgtgcaagtcattatctaaaagaaaaccaacgctggctctcaggttttgtttgtcctgaatccaaaatcccccacagtgctgattcactttgttttcttaacttgctcttaagatcccacatttccttttgtattattagtggatggagagttgattggatttgagtgacctggttgcctggtggcccaaaggactggcccaggagaccactgaagagttctagagcctggatctggaactggggcctggaaaatcgtgtgtccgtgccctcagttactaggtcaccttgagtggggctgccacattgttccatggcccagtttcccctcggacagcatgctgagtgagattccccccacggcgtgctattattacctggcacaccaaggaattaggccactgctacaatgaggccaccccgccctccaagattcttcaaaattctgctccttagagcaggacaacagggcaatgtagggcagtggctccaatttgctgaggactgcaggatgaaagagggcatcttggggtgactgggtgaacactgttctgggacacccagctatgacagaagggaccacagaacaaaagggtgcaaactgtgggcctcaccctggggggaaatgggtttagaagtcatacacacacacacacacacacacacacacacacacacacaccctacatataccaccagggagtctaattttagtagccatttgccccagcaaagcactttgcaagtagttattttgagaaatggtattagccattcggttatttttaatgccccttctgtgacaggcatttgtgacataaacagcagctgaaagaccataaacccatagcccttagatgtgttcagggcccaggcagcagccccttgggatgtcccaagcccaattcaaatggagggaatgggcgagcatcttgtacgccctgccggtcccgcctcactgcctactgctccgttcactggggatgggcagcaagatttgactgaatgggaagcccctctggtctgtgacagccagtgtgctaatgacaaccttcagtgcttgccgacagagtgcaggtgaaaatccacactgctaatgaaggtccctcgtgggctgtccccaacctgatgttctcagaccctgctcccaacacatggcttccacactctctgccttcccacatcctcccctctgctcaagctgacctctcatttggatcagcccactcctcatctctcataacccagcccctgctgatctgcatgctctgattccccataatgaaagagctggatcacctccttggccttctgcatctaatagcttgaattgttggccacctgtgtacttgtatttcttattgaagccactgcatttactctgtactgaggatgcaccaggcatcattctaagcccttaatgaagttcagggaactttcctgaggatcctagctggtatcatcatcatctagattttcgagatgatgaaatggaggtatagggaagttacccaaggcttctttgcaagtagtgctctaagcaagactacagatgcaagagcctcacggtctaggtctaaccctggttctgcaccttggaaccatggacaagttcgtcagtctgtgcctcagtctttccctgagttcctgtaaagattaaatgagttaatgcttatatgatccctttacagatgtctggcacatgacaggcactgtctaagagtcctcgcttgtatgggagtggagaggagaggccagagtattgtaaggtaagatgtattagtgcctacaatgtgttatgcaatgtactaaagcattctgcatgtattatcatatttaatgctcataataccttgtgaaattttacaaagaaattaagcttagagaagtgaaatcattctcctgtggtcaaagccagtgaatggggatttgaaccaggtagctgaacacaagtctaagtttattaacctgaatcctctgctggttgtcttgactctctggaaactgatcatgtcttcagatttcccacagttcctggcactaggttgagcactctaaacagattcaatgccaattgcaggcttctgacaaggcttcctaaatgcagagccctggctgcagatcaggagaccctggcccctccaagggcaccccggctaatcagcctcttcttctgacttctgactccaccccaggacaggcatggtgcttcgaaagcagaagtaaggcagcagaacacttggagaagcctcgctgagggccagggcctggtggttcggatggcagcaagctgcccccagggacccaaaacccaaaggtcaggaatgtagtactggccagccagggcaggcactgctgtgtggtagaagagaagtccagaactgtgaggcgtcaagcgtgagttggaggcaggatggcagtgagaatgcacgcccaactgagcgagtgcgtgtgagtgaattatgtgtgtggttcagttttaggcactgggcagatttgcaaagctcatcaccctcctagagttgcctgcaaaaggccacatgtttaacaccacgtcaatcaatcaacggaggtgcactgggtggggagtgtgtggccaacccagcacggggagccgtgcagctgcagggaagagagcatctctttccccagtggctcatggtcatagccgaggacacaagactggcccttgtgggaaaattgaggggacctgttaaatgctgacctctaatgtggttccagttgagtcaccatatttcttgtgaacctccaaagcactggaagacttctgggcctcgcgtggctgcaggtgaaacatacagccaatcactccaccctggagtcttggtttcctcccctgcagaatgagagtgacgctgataagacatctcaggcagaggcgaaggaggtgagccctgtgggaatttcggctgcccctgtgccaggctgaacaagacagggcctttgctttctgggggctgatgagtcatataaaggggatagaatcaaacactcaaaagacaataaccgcaacacagggctgggtgaataaatacacaactggctactcagaatgggataaccatgggagaggacttttaatgccaaagaaactcaccacgttgcctttgactttgaaaagtgatctgtgcttaatctggcatttcgccaattggaccatgagcaatggggtcccagtcctcattacccagtgcctcctttgcttcaggccagggctgaataggtacttaggacattcctaagaaggactgtgcaggaggaggctagcccagctgcctggctagcctcagcacacacattccctggaacagcagcctcgcttactgccagaccccacaggggtttctgcaggggctggacaaacgggcacatggggatgaaaagggtagagtccccagagtcagtcaatgtcagtgaattggcagccgctgctcacagagctgtctggattctttgcagcccagagagcacctttcaccacccagatggggaggccttgccaaccctgagcccctcagggaggtcatacgtgtgattctcagacaccagagggagcagttttccagagagtgaagaaatgggatccgggaagcttggtgaattcgtctgctggggctgccatcataaagtatcaaaaactgagttggattaaataatagaaatgcattgtctcacaggtctggaggccagaagtctgacatggagatgtcgttggggtcagttccttctgagggctgtgagggcacatgtgttccaggcctctctcctagttttcttgtccttccttggcttacagattcatcaccgcaatctctgccttcatctttataggcattctccctgtgtgcatgtctgtctctgtgtccaaagttcccctttttataaatatgacaccagttattttgggttagagcccacgctaatgatctcatcttaacttgatcatctgcaaagaccttatttccaaataaggtcacattcacaggtacggagggctaggacttcattatctgttggggagacacaattcaaccaataatatttgagttcctcaaaggaaaaacagctttttaaaaagccaaactgaaattcctaacattactaatatactggaacagagtcccaagaagtaggctcaatgtgtgaaggagcttcccggttccagcccccacgttaccccagcccaggcctttgtggcctcccgcctgcactgctctgtgatgggccccttgccggctgccctgacttggcctgtctcccttctgctacctccgcatcaggctgccacaccttgcatctcaccaccaggtccacctcggtcacgacaccttcctggtctaaaggccccagtggcagtcaaccacccagagggctgactgtggctcactccttttgacttcagcacccttggtaatctgcaccaacagaaacatcggccaatgagtgccgtgatttctctgcccgttttctcattcatgaaagggagaaaaaacgaactctccatgcatctactcccaacacattcccctgagaagcctgcggggaagctccctgggagcccattgccaaagcttccacctcatggagctggcgtgtacacagacaggcacagcctgccgtgctgggccaccatactggtgactggctgtgctctggtcccagcccaaggggtgggcaaaagaggaaagccagcctcatgatgagcagaggacagggaagagacccccacaccagggactgacccctccattccctcagaggaagcagaggctactgagccaccagtacccccgcggttcctccctgtagttgctcatggaaagccaccagcctcaggaagtcttcctgtgtggaagctcactggcaccaaggcaggctgagcccctctgccaaaggttctgggcagccatcggtctgataaagacacagagccctccttggaggcctggaagccccacccctagaaggtggtccttgaaagctctgtcactcatttcttctccagagcccctgaagcatcctccatgcagctgtgcccacctgaccatacagcctggccctcccttagcagcaccctggactccattcctaccacctccttgacaacagaatcctgtctgtcaccctcctcaccaggtgcgggtcttcaagataagagaccacctcatgcatgttacaaggaatgctctagaaggagcaccattcaagaaagagaggacagggccgggcacggtggctcacgcctgtaatcccagcactttgggaggccgagatgggcatatcacaaggtcaggagatcgagaccatactggctaacatggtgaaaccccgtctctactaaaaatacaaaaaaattagccaggtgtggtggcgggcgcctgtagtcccatctacttgggagactgaggcaggagaatggcgtgaacccgggaggcaaagcttgcagtgagccaagattgcgccactgcactgcagcctgggtgacagagcgagacactgtctcaaaaaaaaaaaaaaaaaaaaaaaaaaagaggacaggttgagcgccctgtcagaccagtgggcccccaaagctatataccatgtttgtttacctacttgatttctcaacatcactgtgagggagctatgaacatcctcattttacatacaggtaaggtaactgaagttcagctagattaagtgtgttgaccaggacacagcactagcaagagcctgaggacacctggctcctgctgtcacctggctgtcttcacctggtgtcccacaagtacttcaaactctgctctccaaagctctgctcattgtcttcccactcgccatccttaccagcccctacccacactaccttgctcttcctgaatcctttgtcctcactaggacaccaccctctactctgctgaccaggcaaacaaaaggacccaggcgaacaaaaggaccagtgttgcccaaggcctctgcagaggtctgtgcatgcatctcagagagcgaactaaccatgggagttcagcactgatcctattgtgtccttccactggctttttgtctgagctcccactggaaaaaccctgcattcttacttgatgaattttcaaaagcagccagggctttattatcaactgtcttttatgaataatcaaagtccaatggggactccctaattagcctgggcatgaaggccatttgcataacatattgaatgcctctggagtgtcaggtacctcagtagacatgatggttcatgcactaaacctcagcatgtgaccaagcctatggccagacacagatgaacttgaaagtgatgcactggaagtcgatgccccttgagggtgggtgagctcacagagtctattcctgacactgttgctctcacctcgtgacaaagaaccaatgctgctttcttgcatccacccctgagttccagaacccccgcagacaggcttccaaaaactgtgtccccaaactaagactgtgtgatatgtaagaagaactggcaggggacccaacctatattataaaacctcttgatctcctaaaagagagctgagtttaacccgacttagatcaccaggacagatgctatcacagaatcttagaatctgaggttgtaatggtcttctccaattcaatatcaaatccagtgctcccagtcctcttctcctaggactttgtatttgaggtggggaataagggagaaagtggaagatgtggctaacttgcaggtgagtaaaggagaagtcaggaagaagtagtgacttgtcccccaattcccacactcaggagcatgggcagtggagggagaaggatgctgccactggcttcatttacatttgtccatttacaaataccatggcaacaagagctcaggcatgcaatgccctcctgcccagattcctgcttcaaaatcaaaacaaatccagtatgcctggaaaacctgccacagctcagcaaactaggaacaggtgccatcaatgtgccaaaaacctaaaggaatctgaaaaaaaaaaatcagttatgcagaaaaagagaaggcagggaggccccttgggcagctttgctccctgagaagcggcaggatggttgtgaaacaaggagtgaggcccttgaagaacctcacatcagagctgcctacatcagtagggctgaacagggaggtgagccaagtatcaggcaccgggactccctggtcactatggatcacagcagtgttcagcagcagcagcagctctgagaagccctgggaatcacatggcagatacatccagaagaaaactggccagggcaggggcttgtccctgacacagcaggtggcagctccaggaaggaggacaagtccaagcacagtttgtacctggcatgttggccaggttaaacagcaagccagatgcaaacagttggcacaaggtgcagtggctttaccaaacacagagaagaaatatcacaggattaagttccccttctggaactattcatggttccagctcactcacccagactcacaggtctctgcaaggcttcacttcatcatccagtgctctagtgcaagatccgagagtagcattctatgggcaatgaggtgcacagcagaggagcccaagagaattgaccctccctatttacaggcaaacactgactgcattcatggatgcaaaacacgaaaacctcccaccagaccttgaaaacattcttaactataaaaggtagagaatgcagcactcaaaataaataaatttgaaaaaaaaaaggactgggtgggaaagtgccattatcatcatggccaagagcacaggctctgctgtgaaactggctggacctgagtcctggcccccagtcagtacccagatgaggctgagtagggctcaaccctctggacatgcgtttccccaatctatataatgaggacaaacaaagcacatgccccttggagttgttctgaggtaatgcacacaaagtgcttagcacagtgcacagaggacagtctgtgctcagtaaacaactcgtgtgatattgtgataattgaacttggagaaaccatctattctatgtctgcagtaaaagtcaagagaacttatttctgaaacaagatgtgttatgaagggcacatttagaaagcactctcaaaatgaagaggaaaaaaatacagaagcagaaatactgtgaggtctaagacagattatacaaaaagatgacagatatagaggacaggcagccaattcagaataaacctaactgaaaagacgaaaacaaaaaaaagtttcttaacacagaagacagacccaagtctgaaagtcaaaatgctcagtaggcatgtatatatatatatatatatacacacacacacatacacacacacacacacacacatatatatatacacatacatacatatattttaatttcatggtgaagaattatcagcatccaaacagaagatatcagattatctatgaaaaaaaaagagaaaaatcaagctgatatctgatgtctcctctgcaaaacccaacagcagggccaagttgtcattcatattaaaagaaacaaagtgcaaagtgcgataaagcagaatacgttgttcaagaagattaaacaggtgttaaatttttcatatttgtaattaagacattaatcaaaacaaggaattcaacaacaggagatgtccatggtaataaagatctggcaatgaaccctaagatctattaggtttaaataattgttacaactgtgattacaaatcaaaatgaaaatgaaaactaaaatttattggaagagaagataaaatgtgaaaaatataataataataagtagaagttttaaatatcagattataccataaaagcatgagtgtaatattatggaatgggggaatgaaaagaagaaaaattatttatcttacgtggcaaggagtaagaggctatttcactctatacattaaccattggcaaaatatggttgaacaatagttttaaatacttgagaggcagcatgggtagacattccaatttaataaagaaaagtataaaataaaaaatttaaatatctattacagatagacaaaaaagactgcaaaaagcattttttaaaaaacagaaaggccaaaacatattagttattacaatcaaaatgtgtggtacacattatatatagtattaactatatgcaataatatataataaataaatatataaaattatacactgtttataagaaatataccctaaaccaagtgacaaaataaggttaaaagtaaaagaataaaccagaatatgccaggcaaaaatcaagtgaggctcacacctgtaatcccactgctttgggaggccgaggtggcaggatcacttgaggccaggagtttgaaaccagccagggcaatatagtgagacaccatctctaccaaactgtaaaaagcaagctaaggagtgatgccaagttaaaggcaatggtatccaagcaagtgaaattcaaggcaaaagacattaaataaggcaacacaggaggtttcacattgatggagataatccaaagtgagtatctaaaagtcaatgacttttaggcacaaaggaagcctcacaacacaaaacatcaaattgtcaaaaataagaggagacaagtgacagaaacccagtagcagtagaggagtttactgaagtactattgctctctcatatattaagttgtccaaaactaaacataattatgggtgattagaaggctggaatttctgcgttaactggtcaactggagagaactggtagaaagctcaaccctctggttttggaggttggaaactgagacgggatgatgagtcagtacagcacagactagtgtggtccctgggctttacctcaaatggaaacttattaaaaacacacattctcagacctatcgcagacctgaccgaaatcagaaactctggagtggggccaagccctccaggttgttctaatgcaggctcaaggctaagacccaccaaggcaacaattaagcccataggctctggagggccagggccaaatcctgccccatttcagcattgttgggtgacatcaaacaagttgcttaacctctctatgcctccattatcatcatccataaactgagaagaagaagaatagtgcctcctcttggcatggccctgaggacaagatgagatcatgtggacacaggctcacagtgcctgcacggtgtgagcactcattgatggcttgctttggttcaggaatgcttggcagagctgtgcctccagccccactgctctcctgcctcccaacacccagaggtgttgagggtgaactcctctgcacccaatcctctgtgcatgtgcctgaggaggatggactgtcccctgacaatggatggatgccacctcatggctgatcactgctgcatgaggcagtgtcataaacccctccttgatgctctctggctggagcggccagttgagtgactcatggagcttgtcatctcagggcctccttccctgatgcacacggccctctatccctgccccccagcctgattcctcctccccctggcaagactgcagagctgagcagaggctgacccgatctgggcccctcgtctctgcagaagagagaaagccagcatgcagcggactcctgggcaagttccaggatgctgtcctcaagtaccacgtggccactgctacccatggtggggtgggagcaggggcaggcagaggccttgggccacagaacaaattctctctgtctgtgagcagaccagggtcaggtgtgtcctagttaaatcaaaatgtcctgtggggcaggaaacagtttttccactcataaagatgcagttcaaatttgagatgtgtcagggatttcactgtggctgactgtgtgtcatcatgattagatcatacactcgagcattttagagctgtaagtccctatggaaatcaccctgtgtatccccctcctctgccaggtgagacccatgaaggacagagaggccctaaggcagccccaaggtcacacaacataaaaatctaacagcaagaatggaaaagaaactgccttctaccacattgggttgccatgaaacctaacagctgggggcgcctgggaagagagaaaaagtcacgaagtttcttcctgacactcccactgacaatcgtgattctgacaccagaaatgccttttcttcatagcatttcccttacatggagaaatacacctcttgtcttgcttcattcacagttaaatatgcttaggaagacgaggagacggaggcccgtactcttgagccacccacctctgaatccacctgcctctggatccaccaaaatacctgcccttcctatttgcccgaatgctctcatgtttcagagccctctcctccaggaagccctccctgcaaacttcatcttaccatccccttttccatcctggatactctagagaaatcagagctcagattgaagctgagtcctcagactttcagttgcgtctgatttggaaggagaaagaagaacccccacatctctggcacccccatggacaccaagagaagaacttcagtccatctgacagcaaagcctgaactctttcttcactgagttcaaatttgcctctaccactcacccaccctttgtcatcaggcaagccacttacaactctccgagcctcaattttcccacctggaaaagggcaataataataataccttcctcctaggttggtgtgaggattaaataagattacatgtgcaaaagctccaagcacccacaatagataccgaactggaagtcactataataaaactgataatgacaacgatagtgatggtgataaatatcattagtgtataatccatacttggaccaatttgggttttttgttcaagaccgctcggtgagctgagtgtggcggcacatgcctgtaatcctagctgcttgagaggctgaagctggaggaccgcttgagcccaggagtttgagacaagcctaggcaacatagctagatcctctcttctaaaagaaaaacaaaacaaaaccaagaccacttggcaactctatcaaagaaaggtaaacaggtaagagctttttgggttaaaatgttgcagggatctgaactcccacccctctaggccagggaaggagaatgggagtggtaagagacttcctagtttaaaaatataacaataaaatccatcttccaaataaaaactgacctagtacacattttggattttttttctttcttccaaagctctgagagttagttgaatcctttaaaaagacagcatgctcacctctttctccctagcaccaatgatttggagagacagatcacttcacttctgacattctagatacatctatatgttgggattctccgtccacccagctagggcattctatgaagccaagaatttagttctaagctcccaaaggaagctctatttcaaaaagccgggtggctttatttcaaattgaagaggccattaaattcacaatattttgccaaatgaatttctcagtgatcctgagcaatcctctgaagtcagctgtccttgtgcagtcatgggcccagcacagagcaggcgtacatactaagcacctgttccagcaggtagagacagtgtagtgactgggacaagcctctgccctcatggatccagcactccttaaacaatttctgaagaaactcaggggagccagtgactggtacattctctgtttgagctgccacaagtgctgcgggatttttcagtgctggaaggggtccccaccatattagcaacaaggtatcaagtgccaaacactgtgcgacatcttacctaagttttcactgggcattttctgtttagtaagtcaggcactgagggagggaacatgtgacatgtccaatgttcagcttggcaaacagtgaagagggggtccaatggggggcagggcgcaggtggctgggatatggtgctggagggtctctccacatagggatacaattgggtagcatctccatcagctgacgtgttcccaattgtcctttcttggttatctgcctgcctggcaagaatgtgtttcttacactgccgccatgagcttacacttcactcactatacaatttattccactcacttttcacagtgatagcaggttgcccatatggctttatctcttctggaaagggagagtgagcatgtcccttgccccatcaccctccagatatggtgtctgtgcagctggcaggattggaacccagttctgtttcactgctcttcaagtgtaaccttcatcatagtctacaccctgcagaggagaagccatggagtgggaaggcagtgatggggaaccgagcaaccgagaggggtgccagactagcccagatccttgcaaactttcccatgacagccctgaaggcagaaaagaagaaacttttacctcctacctcagggagtctggattagaatttgaagcaagccttccacaagcagacagtttctttatatatattttaaattttatctttttatttttgttatatttttagagacagggtctcactctgttgcccatgctggactgcagtagtgcaatcatagctcattgcactatgatgcaatgaactcctgggctcaagcaattctcctgcctcagcctcccaaatcactaggtattacaggcatgagtcaccatgtccagccaggaagcttctttaaattgttgcattttatcttttaaaatatgtatgcatattttattcctcctcatgacaaatgtgattgaatacaaaataatattcattcccaaaccttcaagaagaactggttctccaggaaaatgtgccatgattatactgcagcttctagcattccctgtgaggctctgggctgtgcacctctaatgctggaaagtccaaatccaggagactcgggtctcctgagattccttggccatctgttcattcatgccatccactcactgattcagggcccagaggagcaccagggttaacggctggcggctgagtcagcagctctcaaggcaatcaccttttccacctactcatgaatcactaacctgctgcccccttgctacgtgcctggaaatgcataaatgtgcttaaaataagtggtacctgggtagcaagtttctcaccagcaggaaccagtccaagtgagtacagggcaaatagcagtgcggggtgaaaataaagactgactaccactggcaacccttggtcactcttcatttattcatccaacattgctgaatatttgccctgtgcaaggctccatgccctggcaatggggggcacttgaaggcaaataagagctttacaaggctctaggagatgtcactagtattccaaaaaccctaacagaagatacaaaagattagtgccattagagaggaaatggggtagaagctttggttggggggaagctcattagttagaggagagagatgttacttctaacttagaacatcaaaaacagaagcttcctggctttagccccaggccatgaagaatgagtggaatttcaggatacacagacaagaaagcagaaaagataaaatgaactcccacataaggcaggagataggggtgactagttatgtgggttgcagcccaggaacacagggaggaatgatggagatctttgagcaccaagaagagaagtttggactttttgttttcctttggttaatgaggagccatgaaagagtatttgtggaggaaagtgaagtaattagctaacatttagaaagtttaagtgggtagtaagatgtatgactaatcagaaatgacagagtcacgagaccagctggaagagtactgcaagagtccaagcaagcagcaatggaagcctgaactagaaaagagacagcagcagtggagaagagttgagccacgaggatttggcaactgactagagaaggcaccaggagaagcaagtccctgaaaaccatgctgcttgggaaagaccaactctttctctcatttcctcttagggaattgtaaaaggaattccctatcaccatttaaatttggttaaattcaccaaagagtgatggggtgaatcactctttggtgactaacccctctggctcttgtgtagagctaattagagtttcttctggaagatctgaaaccaccaacagtgagactcctcagatgaccctgatgggcaggtccatgattcaatctgtttcttccagcatctccccactggctgcagcacatctaggggttcaacctaagggagcccccctactctgggtatggttagagctcctttcaagatcattctaatatcaaaagagggaatcttcaaggagccttgttggcttcttatacttagagagaaaccaagaacacagtcagagttgatgtttttaaataccaaatctgtatgcatctatcagagagacagagagagaaagagagagagagagttagagagagacagagttttgaaacatggagagagggaaagagagatgttcctagagagagagagagagagagagagagtgtgtgtgtgtgtgtgtgtgtgttagagagggagagagacagagagggagagagagagagagagagagagctttgaaatatgaagagagagagggaaagagagatgttccgagagagagagagagagagtgtgtgtgtgtgtgtttgttagagagggagagagagagagagagagagctttgaaatatgaagaaagagagagaaagatgttccgagagagagagaaagagagagagagagagagtgtgtgtgtgtgtgtgtgtgtgtgtgtgtgttagagagggagagagagagagctttgaaatatgaagagagagagtaaaagacagatgttcctatgaagccctcagctcctaaccctctctctggctcagtgtttgaagcccctccagccgcccatggcaaaacttccttccagaggagcaggccatgcatcccagacccatgtgtatgctgtcccctaagaatgagagcagtgctctgtttcccaaatgggcaggggaagcaaacttttgtttccatagtctataaaacatttttaaatttaaaaacaaatgctttgcagcctctgaattattagttttttattaaaaatacaaacagctctatggaacaccatgggaaaatgaggactcttgcaacttcgtttggctccctgttaaacagaataatgttcatgaggaagaaggtactgtttgttccttaaaatgttgtattgcgtacaatggagaagagcaacgtggagatgactttccaatgtgttcccttgaaatgacctgaggaccgaatcaggaagctcagtctgaccagctcagcagactacccccactgccccatcccagagctgaacttgcagtcagccctgataaaaatctctggactagaaccagagcaccaatatcaagggattatccatgaactgactgttctttcctgcaggcaggctccacgctcctgggtggccagagtgccaatcagccctgtcccagtgctctaacgaggtgcccattcactgcccaagagacaacatgcccaagctatgacccagctccaagatctgaagggaccagactgccttcctgtttttctctgcatcccctgagctccctcttgaaaagggaaggaaagctaacagaaaagccactttctcacacacttttggtgagatttcatgaaagctgcatgacctttctggaaagcaacttggcaatgtatagagaatcttaaaaaacatgtgcatcctttggcccagcaattctgcttctaggaatctgtcctaaagaaacaagtctgtgatgtaaataaaaatggacatattcagttcttgactgcagtgcaacctgaaacactgaaaaactgaaaataactcagaggaccaacaatagggagatggttaagtaaactgcagtgtatctacttgggaaactaatatgcatcatttaaaagcatagcttcaaagaattattgataaaacaggaagatatttatgtatgcatctaaatgcatagagaaaagagtgacataaaacattcaaatatgaacagcaatcatctctaggatttaactgctgctttcatttttatttgattttattttgagacagggtatcactgtatcacccagccggcaatgcagtggcacgatctcagctcactgaaccgcaaccccctgggctcaagcaatcctcccacctcaacctcctaagtagctgggactacagatacgcatcaccatgcctggctattttttttttttttttgtaatttttgtagagatggggtttcatcatgttacccagggtggtttcaaactcctaggctcaagcagtctgcctgcctcggcctcccaaagttccaggattagaggcgcgagtccccccactcagcctgctttgacttttatgctctttttattgtggcaaaataaatatcacataaaatttaccattggaaccacttttcctttttcttttttttttcttttctttttttttttttttttgtagaggtgctctctccctctctctctctttttttctttttgtaaaggcatgatctcactacgttgcctaggctggtattgaactaagtgtctagttctatagcacgaagtacattcacattgtggtgcaactatcatcaccatccacgtccagaattttttcatcaacccatggtgaaaccctgtaaccaaaaacatctccctattccctccacctccagcctctggccaccaccattcgctttttgtctctgtgaatttgcctactccaggtatctcatataagtggaatcacacagtattgtgttttgtctttttgcgactggcttattccacttagcataatgtcctcaaggtgtgttcacccatgttgtagcatgtggcaggattaccttccttttcaaggtagaataatcactgtatgtctatgccacattgaacggacatttcagttgattctacctcttggttactgttttttgttgttgtcattttgttgggttttgttgttgttgttgttgttgttgttgttgttgttgtttgacagagtatcactctgtcacccaggctggagtgcagtgatgcaatctcggctcactgcaacctccgcctcccagcttccagtgattctcctgcctcagcctccagtagctgggattacaggtgcacaccaccatgcctggctaatttttgtctttttagtagagacggggtttgaccatgttgaccaggctagtctcgaactcgtgacctcagtgatctgcctgactcagcctctcaaagttctcggattataggcgtgagccaccatgcccggccctacctcttggttattgtgaataatgctgttatgaagatgggtttgcaaatatcgttttgatttcctgcattcatatcttttggttatataccccaaagtggaactgctggatcatggtaattctatgtgtcatattttgaggaactgccatactgttttccacagtgaatgcatcattttacattcccgccagcaatggacaagggttccaatttctccacatcctgtcaacacttgttgttttccaacttttttgataatagccatcctaatggatatgcatttttatgcttttatgtattttcagaatctccttcgggaagcatgtggtatgtttataataagaaaaacaaaaattaacgttatgttttaaaactgtgctagggaatggctcactggatgttatccactttactcctcaatgctgctgggctaacagtcctcctcccaccctcagcaaggcacagctaaattctggggatcattagttgtcaaacaccaactctatggcaagtggagtgcaagaccctacaaccttatggggctgatatcataacccaattagcacaatcccactgctgctgcttggaggcctggttctccttccatgagtgttgctcctttctccccactcctaccccccacttcaagctccaagcgatgacaggagtatagaaaggaaagaaaagagatttggggattcacacagtcctggggtacaatcgcagctccacagttgctcagtgataagataagcaatgtcaccttcctggacctcagattgctcatctgctaattgggtgatggtatcaggttcataagtttgtagggtcttgcactccacttgccatagagtcagtgtttgacaaataaggatccctattcatttctggaattgtgcatagcttctgccacaggaagaaatacagcatacctactagtaaataccacttaattgactgattgaaagaaacccgtcactgtgaggatcccaattcaattatttatgtcctctcctggaagcctctatggagtgcaggtttctcaaacatagtcctgttctcttctcctcaaacaaaggatctcaggatcaaataagcctgggaagcacaaagattgttatcttcaaaaacagcaaaagaataataattaacatatgaaaggtctgtaaccaagaaacctatgtttctctggcaagaccctgtctctacaaaaaaaaaaaagaaaaaattagctgggcatgggggcacacgcctgtagtcccagctacttgggagcctgaggcaggaggatcacttgagcccaggaattcaaggctgcagcgagctatgacagcgccactgcactccagcctgagcaacaagaaaggccctgcttctttagaaaaataaaaaaggagaaacctatgtttctgaaacatattgaccactgaacacctttttggcataacgccaattaacaacacatggagatgactttccatgtggaaacacatggaaataacatatctccaacacatggagataacgccgattaacaacacatggagtgagcagtgctgctccactcctcatccgacctgaaacctggaagtctggttcctcaaggacatcgagccttgaatttccacatgcaaacacctgtgagtatgttggggctgctgcagatcagcagtctcaaaattcatagagcatgagaatcaccaggaaggcttgttaaaccagcgtcctgggccccagcctcagtttctgattcagcagctctgggctgggacccaagaatgtgcatttctaacaaattcccaggtgatgctgatgctgttgacccagggaccccattttgagaaccactgatgcagacagtcaaaaacccctcacatacaagtttaatacaggaccatacaggaaatctgtctactttctgcaatgccaaagaaatcaagtataattcagaacttgaaacatccattctcttctgggacaagttcttaaaggaagcatttcatagtagttaagaaaatggactctggagtcagaaaagagcacgtttgcaagtcccagatctcccagtgcctggctgtgtgaacacagcaagttattaaaacttcccaagccacagcctctttatctctaagggagagaaaatcatggcaatgcctagttcatagaatttctgtgatgcagaaataaagcaagcaggatgcttggggaatgcctggcatctagtaagtgctcaataaagattggttattctttttaatgactgttatttaatcatcttatctggtaaatagctcatctgcgtactgtcagctgacctcaggatgtgactatacagtcgtccctgtcatgggcgaatgcaggctgatggcacaggggtaaaagaatttaccaagaaaatcataggtcaagaaaggcagatttattagagaaagtggggaaatatgttgcctgagagacaatgggcaagttagcctgagagaagctaacttccagaagacaaaagcttgctgcagattttagagaatggaacttgggctgattgataatgccaaggcagcagggagcttaacttgcattcctctgtcagcctggatgtttgataaattgaggtgtttgatggtgagcaggaagcccgggagttatgtatgttatccgggcatgaaggccaaatgtcttgggtcatatatcctgggccatatgccctgggccacaaagaaaggcagacctgtaacttatctggtttctcttttgtttaaattctctggacgtgaagaaaggcagatttatagcttatctgctttatctcttgctttcccctggtcccaccagcctgactccttttccctaattaggactccacagtccccccttatccatagtttcacttttcattttttcagttacccacagtacagtacaatgaggaatttttgtgctctgtaatgagacagagcacagtcacatgacttttattacagtatattgttataattgcacaattttattattcattactgttgctcatctgtcactgtacctaatttataaattaaactttattgcagatatgcctgtgtaggagaaaacacagtatatacaggtatcggtactatccatctgcagttccaggcatccactggggtcttggaatgtaacccctaaagataagggcatctactgtatttggagacagggtctttaaagaagtaattaagttaaaatgaggtcattagggtgggccctcatccaatataactggagcccttataagaaaaggagattagggcacagacttacactgagaagacagtgtgaagacatggggagaagacagccacctacaagctaggcagagaggcctgtgatgaaaccaaccctgtcaacaccatgatcttggacttccagatagtaaggactgagacggtatatccgacttgagccttaagtccaagccaccgttccactattaactcccaccaggacaagtgcagtggcctgaggggcccttctgcttccactcctgcccttactccctggccttactgttacaagagtgaacttcaccagtgttaaccagatcacacgcgtggctgcctaaattcctccaatatgtcacctaatactgagaaggaaatccaagctcctcaccatggccaacaaagccctgaaaaacggcccctgccagcctccccctacccagcatttcccccacccccaccatcaccacctcatgccctaaactccactcagagtggcgtttttgctgtttcagaaacaagcaagctaatccttgccaccaggcctttgcactagctggtgctactacgtggaacgctcttcccccaaatttcctcctggctggcttcctctgagttcaaatgtcttctcctcggagaggcttttcccatccatcacaaagaaaccctcagcatcatctcacgctattgtcttcctacaagttagcagtagcttatcactgtctccctgagagcagccaccgtagctatcgaatgcactgctgcctcccgggagcctagcacttattccaaggccttggagcttagtaaatatgtgttgcctggataatgtatgtgaaagagctttgcaaactgtaaagtgctgcataaatgtaagataatgtcacaaatatcaaaaagagccagccaaataattcaaagaaaataggaaacaaggggagaagagggatgaggaattcagaatgaagctgagagatttcaagtgatgattcaagaaataaaccaagcaaccaattttgttaaatatgtgaggccacagggcgagggaagcacaaaccactccaatgatccattcaggccatgtctgctccactcagccatagaaactgcataaattacaggcagcagcagttttcctggagccaggcagtagaacactctccttggtgccggcctgggaggaggatcctggcctggcaagcagggctgactcaagctcattgcattagccctcccctcctgcatctgggcccctctcaccgcagtgctgcctgcccaggacctgcactcctccagcgggcgggactgtgactcacagatggcctgtcactcccagtgccagcacagagcaccacccgtgcctatctttagaagtttcgcaggctgaaaaatcaatttgcccgcctggcacctgggtctggggcctccccgctaacatcagtggcaggcgaaatgtggcctcccctctgcctgccctgatgcgtcagaccttactcagggtcccgagggcctggcagtgccgcccaacagactcctgtgagctgctgcacccacaggtgtgctggtctgcccctcagagatagccaggcctcaccagaagatgcgggcaaacaccacgccctagaaaatactggcaagggggaagcgaatcactttgcatcctggctgcctgactggcacattccccaggtggtcatctggcacctaatccatgtgtggtcacagcaaactggcttgcccaggtggtacaagttcagcctcttcctccaagcagggaccagaggtaagagaacagcacacaactccacgccttaataaaaaggcccaggaggcagattcccaacgcagtgacaactcccagctggcccccaggcttcccaactactgaaaatggccacatgtgactcccacaagccaaagggaccctgtattactgggtatgcggagagagaaccatctcagacatttcaccatattaataatctctctttcaataaagactcgctgagcacctggcagtggcagggtgggtggaatagggtaagaataagctgaggaacaagagaaaggaaatctctggccctggccctgtactttctccttgcacctgtgggcgctctgtgctcagcctttgagatttccaaatcccctctgaccttctgcctcttcactcacgtctagacaccatttttacagaaaccaggagctactgcctgttttgtttttttttgttttttttccagtaatacagcctagggccctgcccaccccacctccttttctttatgagatacagtgaagtccagctgtcctgcagcagatgaaaacagagagagggctctcacccgctagctctagttgagaaatgagaatgccccagaagagcttaagggctcaaaagccatctctgagaatttgcagaagcacaatcctacatgtttgcttccttaatccaaaaaaggatccaaggtcatgtgtctacaggagccagcctgttacggtgagtgaggggtgctgcattcagcaccgggggatgggggggaaaggagagcgtgcaatggctctgcccaaaccaatcatcaccatgaggggacacaggcacacaaaggtacattttcaatcttttattttttcaaaaacagctagcaatccagatttttatccaaaatctcctttgtaaatataggcaattgatgaaaaaaaaaattaaaaaacaatgaagccacatgggctaaaccaaacacacctgtagactgccagtttgtcccctctcataggtaggatggggtgactgaattctggggagcacgttcagaggtcgctatctttctctgcttctccccagagaggtcttcctaggctgcctctcagacacacagcaccagccagagggcaaggaccaactgataagccaggaagtgtggctcccatcactttgaggagggaatcaggaactctttggaaacccctgctgtacaccttgctggtgccatttcccaaatatttgtggttcacccctcggctttcagtgtctctttccttctctgcctccccacccagggctaactcctctccttcctgaagactctgttcaagcatcagctcctccaaagagctgcccactaagcagtgcccctccctccagcccctgggctgggaggcttcccggcacctggcatatcatgcactctgcatgcccacacacaacttccaggcacttgattgaccctcactagcagggagctcctcaagagaagggctggttctcttccatccctgttatccctgcagccagcgcagatcttggaacacagagcagctccacacagaactgaaccagcaacttctccaggagcaaatgttttctgagcactggcctataccaggtgcatgcgaagggtgcataaggccactgagatgaatttgacatatccaggggcttcagaggatcacagtctcttgggtctgacagatgtttaagaaatccccatcatgtagagtacccacagcccacccccctactccgccccgccacagccaccctcctcccatccttcctgggtcttggccacacttgctcttccttctgcctgcaacatggccctttcctgaaatctgctccaaactccccttaacaaagagctttctctccatgcaccctccatagcactattttttcccattccctgtttcatttgtgcttgtgcacttatggccacctggcttctcctgtttccctatttgtcctgtctgtggtctgtctccactactagacctaacccaatgagggcagggcctgcatctgcttcgttttctgcagtatgcccggtgcagaggacagcgcctgacccatggtaggtgcacagtaaacagtggttacccgaatgaatttaagaatgagaaagtaagatacgttccaaaagctctgcatgctgcaaaggcctctgagcctctatatgctgagaggcagctggacctctgcctcctcctttgcacggtgggcagagcacctgcagaactttccacttctcatgcctcatcatgtgtctgggctccggctccggtgctgcaaagcaggtgaagggccccctgtgcaagtgtaagaggctaaaacgggggtgcctgtgtgagcggctggtgtggggtgggcacctgccggtgtacgggagactgaagggtggagagggcctctcatgcaggcatgtgtgagcagctgcaggtgtgtgagcaaatgtgcatcactggggaacaggtgtctgtggatgagggaggaagtgagggtgagggtgtttgtggacatagggatgtgtgttttttacaaaaaaaaaaaaaacaaaaggtgaggggaagccggcctgcatacatgtgcatgcatgtgaacatgcgtgtgtgaatgtggggaagggcgcattggtgaaaaaggtgctggtgctttttctccctgatgcaaactcaggctggagagactgggactaggcagaccctacccttggcactccaggaagagttcctccctctatgaagagctgcctgacctcattcaaggtgtacagaaagaaagcagtgtcaccggaacccaggcctccaccataaatgggccagaggcaattccacagcagtaaccgggcaggcaaaaccacccctggaaaacacaagctgacacgaaggatgagcctctcaggccccctgggcgtggggtccctggaatccctctgtccctggctcctagtgattttacaccaaggctgaacacatagatttgaggcaccagtgcagtgcaggacatgggcgtgttattaccagctccatggttaatgagcattgcatccactgggagcagccaggctggggatgctaagacctgctgggtggttctgctgagttggggctcatggggcaagaaggccagtttctgccagcccctcccagcagcagtgagacaaggacacagacactgaagggcccgtgttctcagcctctccccctccgactcctgcccatcttcctggtcacatctcctcccaccgtctgccttgcttgctgagtccatgcatttgttcatttccccattcaacaaggaggtatcaagcaccactatttcccaggcacattcctagggtgtagaactgaaaaacacaggtaaagtactgcctccatgcaacagacattgtagttgaggaaacaggcgataagccaaactgataagagaaatataaggtgtgttaagacaaatataagatggtgacaaatgccccagagaaaataataaaatagggaagggaggcaggaagaggggccgttaatcagggtagccaaggaaactctccagcagccagcctcgttccctccccagaggcttcacagctgctgttccacacacctgaagtactgttccctcaaagatcccccatagtttccttttccaggcaagttgatcttgttccactcattggccacttccttagaaagaccctccctggccaactacataaaacaggttccccattgcactcacatcactatccccttagcctgtttcatattctaaaaccagttctcattatctgaagttagtttattatttatttactatgtttctgcctcccccagtgaaatatgaggtctcaaaggagagaggatgtgtgtcttgctgaccactatatcttcagcacccagaacaggccaacacatggcaggccctgggactgaaatttcatagtccacttcttgttcctttgggttaagcaatgccctcccccagcatccatttaaaaatactctcaggcaagtgatacatgaagtcatgaacactctagtatgaatccgtcacttctctctaggggctgctcagaaatctaggagcacgtgttagtactgagggaaggggacagggccgaaggaagaagcccacaggctgcctgcccaagcacaggactggaagggaggaggcctgggtgtggtgccagctctgtccccagcttctgggtaacctctctaagcatccgtttcttcatgacttagagctgagagggagctcttggtcacctatgctttggggactccagcggggaggaaatgagtcaattaggaggacatgaagttggctgcctcctcactttgccatcaaagacaataggtctatgttctgatccctgcctcagacaaaatggagaaaacccaaagatagtgggaagccgcctgcactgtatgaatgcacgcttggagaagactgtctccctgctgcccagcacccactgtccacgcatggttactattagaaagttaatcatggaaaatgctgaggtctctttccccagccctgcacctctcagctccacactacaatttcatcttccatatagtgttaccagacagtgccattggctccgtccactcacttgtcccaggcctttatgacctttccattcaagccacacaccacgtctgctccacagagctgtaagacacactggcttcagcccgcctggcctgggccagcacgctgacattttccatgagtccacatcagccagtgaaatgctcagaggggattaaggcaaccttctccatcacccccgagttgctttaggaaagagaataacagcactgacccctccattggcagctggtgatatccacacaccatctctatccagagatgaaaggctccttctccatccttgacttgcaaaacagggattatttcccacctcacgctttctgaaatatcaccaaagatgcagctgtgtttgaaggccagcctcataaaaggcgtaggacccacgtgtcagtcaacactccactgagaagataattgattttttttttgttttatgattatttgcgggcactggttctctttccattagcctggataatcgagggaagactgtaaagagtattaatatcacggccaaggtcactcagctggctcctgctgccattccaacccaaaggctgaattactatggcttttactaataataacaagaacaataaataacatgagtgattataaagccagggaactctgcaattacctcaacaattaacacatcccttcgtgaaacacagaacagaaaaaattttcaaaggttcaagttagaaaacttctgcattctgtttggtgcaagtgacagtcagaaaagggccttgtttgagggtatgcagtgtgagagtatgcagtgtgagggtatacatgaggtctgcagtatgcagtgcagtgtgagggtatgcagtgtgaggtgtgcagtatgcagcgtgagggtatgcagtgtgaggtctggggtatgcagtgtgagggtgtgcagtgtgaggtctggcatatgcagtgtgagggctggggtatgcagtgtgagggtgtgcagtgtgagggtgtgcagtgtgagggtgtgcagtgtgaggtctggagtatgcagtgtgagggtgtgcagtgtgaggtccggggtatgcagtgtgagggtgtgcagtgtgaggtctggcatatgcagtgtgagggctggggtatgcagtgtgagggtgtgcagtgtgaggtctggggtatgcagtgtgagggtatgcagtgtgaggtctggggtgtgcagtgtgaggtctgggatatgtggtgtgagggtatgcagtgtgagggtgtgcagtgtgagggtatccagtgtgaggtctggggtatgcaatgtgaggtctggggctggctccagttggtttccaactttaccaggtgtgtggcccgggcaagtcacttcatctcagcaggttcctgcacataggggctggtgaggactcaaggataaggcacactaaagggcttggcacagtgaccagcaggtagcagcactctctaagtattagctgccattgttgtctttatcattaatgtaactacatcttaattaggaatgatgggatctcatttggcccccacaccaatccaggaattgagatgagaatagtgtttcctctaccatccatcagccaatatccagcagccaccccaggggaggccactggtcatcccacgccatataaagttcactgcccctggatggtaggctcaccccaagcctgctccctcatcctcattcccatcctcaacagagaggaaagtccaccactgtctccattttaaagaggcagcctgtgacatccaagagaccttccagcctcagggaaaggcgtgaacaagagctccagctgggtctttacagatgaagccccactttggtacctcttctcctaacaaccccagcttttggaagacatcaaaattccaaaggctcagctgcagaaagatcttccaaatttctcattatagttattccctgaaaggccaagagctttattcttcatccatttactcaacactttcatggagcaactgctacgacgtgtcagcctctgcaggaggcagctttaaactaagtgtgacagatgagaaagaaccataacacacaaagcagggagaacagtgattccagccaaagaaaacagcatgtgcaaaggccctgaggtgcataaaatttggcatgttctctgtggatagggttctaaatcatgtccaggacagggggacacctttgtgtcaccctcatctgaaagcaacctttaagaagccacaggacagactgtcttcaactcagaaaacctccctgatacccatcttccatcctccacccctacattctcactcttgtctggtttcctcagttaccatcctggtgcctaatttctggtggcagcaaagtgcaagattagaggcccacacactagtgcccggaagcttgggcttcaatcccagatccgccaattatggcttcagtggtttggggcaagtgatttaactgcctctctgtgcctcagtttcctcatctgtaaaccatggataacagagaacctctttggagatctgctgtaaggatcggacaagtaaaaagaagtgaggctcttggataaataaatatctaaggcacatagaagttccctgaaaatgtgggcattatcaatatttattttaagcatcatcatttttcttattatattccctttctccatctggtcccttgagagtgatgactcggttgaatgaatgacacccaccccagtttctcaccccatctcccaacaccaggatccttttgcctagtgggtggttatcacttagatgtgcccatccccaaacctcacttgatatagtgatttctggagaccctaagaggactcagggaccaggcacggtggctcatgcctgtaatcccagcactttgggaggtcgaggcaggtagatcacctgaggtcaggagtttcagaccagcctggccaacatggcaaaacctatctctactaaaaatacaaaaattagccaggcgtggtggcaggtccctgtaatcccagctgctcaggaggctgaggcaggagaatcacttgaacccaggaggcggaggttgcagtgagccaagatcatgtcactgcactactccagcctgggtgacagagcaagactccatctcaaaataaataaataaataaataaataaataagactcaggggacttcctgcacattcccatgagccatgagccatctccaacaccttggggcagagtaggggactctatgactccactggggaaggggtcctgcaatggggcctgagatgtgctttcccccagctgacactcttttccttatttaactttttcaaaaactcccccaaatgttttgccttttcatttgcctcgcctcctccttaacactctccacctgccccaaaatccccagtagtttcaaaattgaataactgtcgggaacagcatttaaagatgctaatttaaacacacgtgtcagaaaaggcaagctggatccctgctcctagcaacagcccctcacccacacctcacagctgctgctgcccagaaacagggcttgcttgagtgagctggcaggggggccggatacagggaagcagagttgtgggacctagctctgagcctgcttctggcctttccccttggatggaggtctttatccttgcagggcagccttcaaaggtgcaaactctgccaagctgccaattcctcaagaaaggggtcttggggcaaccaatggtttaagtaaacccattgtatcacattttgaacatacagaactgctaacacagagacctctaatttcctttaataaacccaaactcttccatttgagtaagcttcatacattaaatagcaacacctactgttaaagcataacaagtctcctttccatttttcacatcataaatgtaagtttgggtcccatcaaggggcagattcctctaagtgccaatgtaaagtgccccctcctctatgtagtcctcctgaatgaccctccatgccacaggtgggagtggtcttttcctcccctgaactctctcatgctcttcccagctatctttcattgtagcaagatcttggtcaagctcatgcatagcttatctccacttctagactgggacatccttaagaacagaagctatgtcttactcaaccttggacgtgccccccccccttgcaatcacaccacagaaccgcatagtaggtgcttaataaatagttataaattattaacatcagtcaccttggagctctccaatttaaagaaacagttttttaaaaatatgtatagtaagtagacactgccccaatagttggtcccattggtaaatatagcttttcatgtgttgggtttgcttcaaatggaggtataaaaacacacagaaagaccaagacagaagctaaaacatagggaatgcaagcctggtaacctctacctgggagagaaatttgcccaactgggcaatgtgcaggcaaggctgatgtcaagggaagatgctggagaagagaaatgctactgaaagagcacgcaagtgcctttgcatctccaggtaagtgcttatttcaagaaagtgtaaagcagctatgtttcttgatttggatgttagttccatgggtgtgttcagttttgaatatgcatatactttgtggtgtgttcaagttttagtatcatattatatagttcaacttgaaaagtaaaaatatttgtgggatctaaaaaatcaaattagagtagaaagagagttaccagaggctgggaaggggagtggcggattggaggggaggcaggatggttaatggatacaaaaaaatagaaagaatgaataacacctactatctgataacataatagggtgactatagtcaataataacttaattgtatattttaaaataacttaaagaatgtaactggattgtttgtaactcaaaggataaatgcttgaggagatgaatattcactctccatgatgtgcttatttcacattgcatgcctgtatcaaaacatctcatgggctccataaatctacacacctactatgtaacccacaaattgttttaaataatttaaaagcttttttaaaataaatgactaaacaatatttctcacatggaaacttatcctcgatgtccaagtgaagttattgtgagaataggggttgtggtgcaaaaattcactctctagagaacacagctgttaccacctataaagaaagcgaggtctccactcacaaaggaaagcagcaggagtatgtgagatgtcgaaggagaacgtggaatgcctaagtaataaaacagacacagaaaactttccatccccacggtaagagaagctttggcagagtttgctcttcagcctcagaccaacagagctccagcatccaaatgctgaagaagccaagaatgtgcaaactatgctctctcagaataataagaagaagaatattcccttctcctctgggactcttcaaatgttttgaagtttctgacactctcaaaaacatgcagaaaccgcagcctgaatttagaaacctcagcatggtggtatgtgtggtatgagttccaaattctcgacagccctagaaacctgtttctagaggagaaatgaaaataccaggcacactgatgcagcttgtgggttgctttattgctttatttagggtggcagctcgggactgagggacctgggtctcattatctatcagctacctccccactcacattttctgcaattgacatcatgcacaatgagagccacctagctggtaagagaaggctctaaagactactcagagggttatgcgggagggaagaggaggaaataatatgagcccatccacttcctctaaacactggggtcgagggctgtcatggatcacctgcacggatatgatccccggcctccctcagcaccagcaggctaagccgctgtcactgcctgaccccctaacccagtcaatacccaaccatcaagatcacagtcctcaaatgagctcactttcagtaaggtaccgtgttcgatttttctttggacaattttatctggacgatatctaccatgacttaattttgtagccaatgtatacacattaaaataagatgaaaacaatactttctggacctcatgcagttctaattaatataattccatatggatttatggataccagttgtgttctagacactgttgtaagtccttggaatcaggcagtaagaatatgaaaaaagagaccaaaatgagaattatctccagaagagaaagcacatccagcctggaatatgtccttacaggttggaacccgttctcttccagatgccttgaggcttctttaactttactctttctcataaccacccagaaagtgcagggttggagactcaatggttgatcaatacatttattgaatgaaaatgacaggccctacaagtagtttctggaagccctgccaacattttcccaccctgggttctggtactgctcccaggctgtgtggcattgactagagtgcttcaacggcccactggccccacacagctggtgcctggggcccagggtggatccatgagtttgggcaactcctcctcattcctggagctcagtttcttcatgtgtaaaatgaaaggattgaagaagattgtctctaatttcccttccaagttctagcattctgtgatgccatgtgcaccccagttaagtgagaactgccctttgctattcatggaggcaaaagatgtcaccctcctcctcgttactaacatggccccatcttgtccaggttcccactccttctccacagtgtcttgcacctcagataaactgaccccattccctcaccagctggtgggtcctgtctagtttacatcagggcattcccattctattgacactgactgatttggagccaggcaagtggcctggttttggtcaatgagaaaaatgggagaagtatcgggggctttggagaaagattttctctatatataaagtcctcaccagaagagatggtccctgccttgactctggacattgccatgtccagatgtgatgtccagaaccactgcagctatcttgcggccatgagagaaatcagacttggtataaagctgtcactaaggacagtagggtgaagaaaagaaagggcccagggcctcatccacatcactgaaccactgatccatccatagtggagcctttcctcccccaactctgttctcttatgggagatacatttccttactgtctaagccaatttgagtcagtgttcttgatcattagtaatcaaaagcatctaactaatgtagtggacccccaatttggaaagaatgaaaatattctgaaacactcaacactaaaactactgtacacagttgaatctttctaatgtctgagaaaatgctctacaacactatctggatggaggttaccctttcaaataaatgcctgacatcctttctttctcaaaagccaatagcatccagatatttgcacttttcggttgcttggtttctagacaaatgttagtggcccgatcattcctacaagaaatggcactgacttgcccttctccatggagacgatgagcacagccatgaactcaattcaaagagcagcagaagagtcaaaagtggcaccttgaaactgaattctctgttgtgttgattttctgagctttcaaagtgttattcatttttttctacctgtgaatgaatccttgatttctcaatctgcctactcgctgagatagatttcagcaaaataacagtagacatgggtttccttctcctctctctctctctctcttccccctctccaacttcccatcctccctctccatatctccccctctctaattcaccaaggtaacaaaagaaacaataattaagtcaatgagcatgctcgcatgtgcaacaaaaaatacctctcttattacattgccatttccttttcaaatcctttgggggcattgtgtacaaatatagtaaacagcattagagggaaataatgccgacacatacttctgggagctcgtcatgtccctttaagacaaggcccactgttcagttccattctaggccacagctcgggtttcaagcccaaggtccccttactgcctcatgcagtattaatatggccctggcatactcccaaatttacattatgaaccataatctgggccagctcccacaggacgaactggcttggggctcccctcttcatttccccagagggccttctccccatccatagccaggccacccccttccccagggatcccccactttcagcctcagccaggggaacacacaagtgcttttcaacaagtagttaattccctagcatggagtatcatctgtgggggctgcttacacaatggcagaggaattgcgctgtcctgcaggcagtcacagggggagaggggaagaaggcactctcagacattagagccagagccaactcagggtcacttctgtggcaggcctgaaagcaccaccaggatgtccaggccaggaggtcccatgggcatacccagatctgctgaaggaggcctctctgtctcttctctgtgtctcttcctctctctctccccagttataaccagaaggcaggtgcaatttctagaagagcccataaaccatttccatttattaaaagagaaagaaagagagagagcgagagagaggtgaggctggtggggagtgaggaggaggcacaaggaaggagtgcagaggggaggcaaggcaaggaaagaacacagggtggagggtggctgagtgggccctggtgcagccctcatccccaggggctggctcgggctccatgctgtgcgcacagcctccaaccaccatcaggaggctacaggctccatccaggatgttgtctatgggactcctgtctctgaggcaccatggggtgtgttggggagagactgcactctggacagcctgtctgggttcaattcccagaccctctactcacaagctgtgtgaccttgggtatgatgcttaaccactctgtgcctgcatctcctcatctgaaaaccaggaccaagaagagtgcccaccacctggggttgcttgtgaggatggaaaacaggacctggcacaaggtgtctagcccatgcctcagagcttgcacccaacagagcaagtaacaaggtcaaggcaacaacagagggtggacctgaaacacatcctcaagaatccagcaatttcctcaataagttaaacacagcattaccataggatctagcaatcccattcctaggcatataccccaaatcaaacacaggcctggcacagtggttcatgcctgtaatcccagtactttgggaggccgaggcaggcagatcacctgaggtcaggagtttgagaccagcctggccaacatggtgaaaccctgtctctactaaaaatacaaaaaattagccgggtgtgatggcggatacctgtaatcccagcaactcgggaggctgaggcaggagaatcgcttgaaccaggaggcagaggttgcagtgagctgagattgtgtcactgcactccagcctgggtgacagagtgagagcccatctcaaaaaaaaaaaaaaagaaaagaaaagataccaacaaaagctcgtacacaagtgttcatagcagcactattcacaatagccaaaggcggaaacaacacagatgtccatcaactgatgtatgaataagaaaaatgtggtgtggccatgcacagaactaaaggaacggagtactgctgcatgccacaacacaggtgaacctcaagaacattatgctaagtggaagaagccggacacaaaaggccacatatcctatcattctactcataggaaatatccaaataggcctcaagaagcagcaagcagatcacaggttctcaggctggatggaggagagaacggcagtgactccccattggtccagggtttccatctgcagtgctggacggttctggaagtaagtagcacagatggttgaacagaattctggttgtatacttaaaatctcacaatggtcaattttatagtgtgtatattttaccataataataaaaaaaaagaattcagaaagggcacagcactcagactcttctcccctgagtcctctcacgtggtgaagagccaggcaaaagggttgagggcattgttgttatgcactaagttcccccactgtgttcctgccctcccctctttttccccctgcaccactctgcctgtggtttcccagctcacctctgggcctttcctgtgctattccctctgccaggagtgcagcccctgccaccccagcaccctcccacctcagccagcctagctcctctcagcccttcaaacccagctcagcccctgcctgctgtagaaggctttcccttgttaagatctcctcctcagggctcccacctcactccccggcacctaccctttgtcaaagcaccatgttctgtgcatgctagacagagctccccacctcagctgtaagcttcttccatgcaagggccagatctaatttactcttatacccttagagccgagcacagagaaattatataaataacaaatgagttaaaactacagactattatctagaagtcatgagataggaaagaaaaattagttatgaagaagggactctcaattcctagataacttaaccccattctcacccctgatcccagaacctctccagggaaaagaatgaggacaccccaagcagagagtgaccaggccaaccaagagcccccacgtgggcctttgtcaggaaagtcaggggctgaagaaccatgacatcctaatcccagtttggagtggacagcctggccttggattcagtctccgctactttcttcaagggagccaagtactaggctctccccacctcttacctcattcaaacctgcagaggtaaaagccaccttatagaggaggaaattgagactccgggaggtcaggcgcatgccccgacaacaaagctaataatgttcaacaccacaggcatctgaggccaaaacttgtgacttttaaattcgtttcctcttcctccagcagtgtctacatggttgcctcctcaatcttctaactaacacgagaaggccagagacacaggcaatgctaaaggacagatccttgtggtgctggactaacccaccgaatgcagctgggtcctgttccaaaaactcacttcaaacaatgatgctattgaccaggatagacagagggacaaggaaagagagatccttggggaaagacacaaaatgattcatctcagccactgtgctcaactacttgtgtggctttgagtaagtccaggtctctctggggctttttaatttttcccttttgtaaaaaaattgtctaagtctaacataaaatgcagtaaatcatctccaaagtctcttctagctcttaggttctaacactattacaactaacagcttccccagaaggatctagaaaaagtggccatcttgtccacattcacttagtgcaagtcacgcctagagcagacagcgttgcctgtgagggtgatgcagtgcacaaagctaagtcaccatcaccttttctctgggagcttcttataccaatgccccaaacattccttgtaccaggacagacacaaagagaaagatgcatttattctgctcccaccacatgttctataggagacctgtagtgtaggtctcagtagtactccaaattctgtcattctctcccatcttcctgatttctgccccgcctgcctgcctgcactaatattcagtgcatattatccttgaaatcaacttgaaattgtctcgattttttcaaattagcattgtcctgggcaataatatctgtgaaatcacgagctctgatgtactagttctatttttccacaagtgtattcaaatacacaactataataagaaattcgtctgtgtccctcctcaaagcatcttgcatcccaccagcattgaggtgtggcaaaacacagcagtagctcacttagtctccaccagcaaacctcttaggccaaacaaagctgtttcctaccattttagaaaaaccgagacttggggaagcaagcgttcaaggtgacgcagccagaaagcaccacgcggggcttcaaacttgggtgtgcctgattctaagtcccaagtctttgccgctcttgtaagcatccagcttgtctacagcagatgggggtgaatgaaagtcaagagattgtaaataatgccaatgacctttatcacctattctacttaatcctgtcctaagaacttgacagcaagattttccacgataatctgaaatgagagtaattcatctatgcataaacaaagctgacagccagcatactgaaatggacagaaggagagcactgtatgagtccagaccagttagctccctgggcaggtgcccctcacccacgccagcaaggtcaaggtttattcccactccaggcaacgctgggttcaagctgtcccagttcagaggctgtaccaccgaccctgccagcgctcctgcaaatgcacagcttagtcacaagggactccggctgtgcatgtgcgtgactcagcacacatccctcagccctccaaggaaaacaatgacaagagcacatgggatcagcagtgtcatccgtgaacacagaaacacccggcccttcatgcataaacccaccaaagaaaagggcttccaacctagcctggaaaattcaagaactggaagggctggtgctcaaagtcatctggtctgacccctcacaagacagcaaggaaaaaccagagccaagaaagaggcaacaagggacttgcccacgggcactcagctgtgtcagtccagggctaaaaggaagtgcccctacagcttcctgcagagtcagcagccccaggcacagtacttctctctgcccacgtggcactgaggaaattgccaattacagagctatgccctaaattcaggaatcaataaagtgtaagtggagagcccagttacccatatgaattcaacaacaacaaagaaaaatgaagaggaaaactacccagctcattatctctctgaagtgttttccagtaacaactcaatacgaatcagaaataatctcctacgagaagcagcaactggggggaaaatgcactgaactgtgcttggagaaagaaggggctggccatgcattccagcacgatgagaatccccccgtgtgtcacgcaatatgccaactgcaggaggatcccccaagcaggcgtgtgctaacacgtcatttgactccaacacgagatgactttgagttcccaatgatgtgcgcaaaagggacagattctccccgccagtacagtgggctctctggaccttctgaccaagccaggaagggaagaggttggcagcagatgagggactgaccagcgaatgaaaacacagcgatgccagatgcaaaggacactccttgggtgggaaggaggtagggttggtttattttttcccagactttttcactcatttaagcctggagaatacctccctccaaattttatccaagaaccagccaatggccaaaccccactcaaaagagaaaacatgaacactaaaatattccatgtactgaatatttttaaagcaaagttaggattttctaggtttgtttccatgggggaagagggtggtaattaaatgatttacagaagaattttacaacctcttcattttacagataaagcaagcaagacataaagaagcaaatggttttttcaaagtaaccctgatagtcaatagcagaaccaaaaccagaatgcaagtgaaaaaatccagatttgccaaaaccttcctattggctctatgagagactaacttctgagtccgggctatcctgatgatactgacagggtccccaaaagctatcatgcctctctgagtatgttctcttggcaacctgaaatcactctcttccttagctcctctaccatctgtaattaattattctataacttttattgaagactttctcccctgcaatagtagaagctctactattatgctgggaacataataaatgtttgaaaatatttgtagagtgaatgcatatgtatttctgacatatgaacactcgtgcattcaacaaaccagggctgaccatccagggcatgacagtgctttcatccctcagtgttgctaacatgcccagtgttgagacaccccaacaaggtcatactacacatgcaggggattcaacaaggtcagacacaaccagagccccaaggagcagagtctactgggcagactagccaacacacagaagcggctgcatgacacaggagaaagggcacccgtgaagctggagctccgggtctagtttcccttccctagtcaatgattacatgacttaggacaaatcatttaacttctctagaacttgtctgcttcatttgcaaacacaagccaaacaagaggaaggcaggcatcccgggaggaggaacagtaaatgttggaagtaaaagccctaaggatcctaatctccttgagtacagggaccagtctttcttcccgcatcccaccactcttccccagatttgtgtgccaggctctgcccctcccccacctccatcactgcccggcaagagtcaccaaactctgacagcattattcttccagccactgacctccaaatatccctctgataaaatcaaatcctaacaaaggaggatgaactccccctgcttaggctttgtgggagagaactgcctgttgctcattggtaactcagggcagaaatatcagaaggatgaactgtggggaggctataaatgtgtgactgttccttaccacctcatggccacctgtactgtctctatagagccaaagctctaaaaggtactcatttgtcttagctccatgcctgaatgttctactcctgattacagagggagaacccttccctctcttgctccatctatgccaaagctggcccactatgctgcttggtgctggcctctaggccagcagcccctgccaagggcacacttgagccaggcagccaggtaactccaggccaggcttccccctcagggcgttaccaggctcctccccagcttctccctagcctggcaaacatccagccctatgctcatcccagaaacctaaagataaaatcattaggaaaacttctagctcagagatgattattgctatgttatttataatagccaaacagcagaaacagcctaaatatcctacactagagaaattatggtgcagccataccaagtagaatgtagtcataaaaagggtttacataggagatgtttgttatagtaactgggaggcagaaggcagcatacaaaattggcagagggtacagtcagagctaaagaagttgaaataatttaaaaaattggtacaagcaggcttaaagaaaatgcatcaaacgataaccaactggtgtcctaggaagaaactagatacgaggtcctttctctatccacgtttatgtgtatttattatagcgaagcataaacattaccactgaaaagcatctcatttttcctgaaggaacctaatatactcaggaagatcagggatttgggcatcaaaagttctgggttcaaggtccaggtctatctatacaataggcacaaaaatacaggtagatggaaggaataagatctagtgttcagtagcacaacagaacgactacagttaataataatttactctacatttcaaaatagctaaaagaaaatatttgagatgttcccaaaacaaagaagtgacaaacgtttgatcaatgttctttctgtttccagcctacaatctatacctacaacccacagcctacaacccatacctaccatttacagctataacctacagcatataactacaaactaaaacctacaccctgtacctccaacttataccctgcaacctacaactgcaatctataccatatatacctacaacctataacccataatctacaacctatatctacaaccacacctacaaactacagggatgctataagggtcgtggagattcaccaagtgccaatctttacatgaatatgttatatgaaggtggcgcatgaattataatttcttaaattctacacacatgcacacactccagtagcaaccacacatcagttactaagcacatcttaattccagaaggacgctctaacatcccaaaatactccaaccagggctcaaaagtcaaaaggtcccaccattgactcctgttcatctaccccacatatctcaggactcatcagatttggtccaagaagtttattcccctccttccgaaaaatacggatggaagtagttataattcagttttttaaaagacagctattatcaaaaagtctgaaaataacaaatgctggcaaggaagtggagaacagggaacattcatacactgttggtgggaatgtaaattggtacagccactatggaaaacagtatgaaggttcctcaaaaaactaaaaatagaattaccatatgatccagcaattccactgctgggtatatacccaaaagaaaagcaatcacacagaagagatctcttcactcctgtatttattgcagcactcttcacaatagccaagatacggaatcaacctgagtgtccatcaatgaacaaatggataaagaaaatgtggtacatatacacaatgaaatgttattcagccatacaaaagaatggaattctgtcctttgcagtaacatggatggaacaggaggacattatgttaagtgaaataagccaggcacagaaagacaaatatgacatgtccttactcatgtggaagctaaaaaactatctcatggagcaagagagtagaatggtagttaccagaagctgggaagggtagtggggaggggatattaagagggattggttgataggtgcaaacatacaggtagatagaaggaatacgatctagtgttcagtagcacaacagggcaactgtagttaacaagaatttattctacatttcaaaatagctagaagagaatatgtgggatgctcccaatacaaagaaatgataaatgtttgaggtgatggtatcccaggtgcccagagttgatcattacacattgtgtgctcacagcaaactatcacaggggcctcataaatacataaaactattatgtatccataaaaattaagacaaagaaaggaaaatgcactggcatgtgtattttgcggaattatttggtttggcaactactctttgtctagagatggagtttagaattgtccctcaggtttgaggccacagttcctggcatctcggagcaggaggacgccagcatccttcttgttagaatcagacagcatgggctttcccagagcttacttcctgctgtggtctttcttcccagtgttgggagaattccctcacttcactgatcttcaatatcctcattagtgacagtaatgccaatatttttatcatttagaatgtgctagatacaaagctaagggcttcatacctacgaactcatctattctgtgcaacagccttactatgaaaataacattaggtacgttgactgcctcccccaggtagagatgaggaagtagaggcacaaagaggtgagtaacttactcaggttcccacagcttgtgggcaggatgttggggttggaattgggtactctgtctcccgcactctgatatgtctgtcagctggaagcaaaaaggcccacttcagaagtcattgactaaattttaaaagccaatgatctaaacaccatagtgcaccctcaattggtgtcatcactggtctcctccccagagctgccaacatccacacctttctctcaacagccatttgaacacagggagaacacatgattcaccacagccaatgactgggaaaaaccaaacacaaagctcaccgcatggagtgtgatgtcttgtgtcccattcatttcccagtgatttgcaggaccttgtatggtgtctgggaaaaatgtgtattgactttagttcatttccttcgtaggttcagcctcttattattttatgttcatatttattttccagagatagccctaaacacgggacatcaccagttccagtgaaatctccagggggagtacatagagccccaggacagacaggaactgtgtcacctaacccaacactcccaagacttctgaatgctcctagaaccaaactcctcttctgctccattgcttcccctccacccccctgctcctttaatttcagtgacaggaaatgccttccgtttggtccatcctatgtcatgcatcactgtgccaactcaggggacacattcttcagccacaagaacaccaccccagcagaaccacattgagcctacagtgcccacaccttgctccaaaagtcacatccttgcccccacccagggcccaccttccccaaaccatggacaaatgccagaaccaggcctgagaagggctctttcagagtccaagacacatgagcttccttggaaagcatcttccctatggaaattccccccatgactgcagaaaaattaaaatcactcagaattctctatttcttcttagagtttcagaattgacttgaagacacctaaaatcctaatctcaccaactctccatctcctcctctgcctctaaaggaagaaaaaaaaattttaaagaatggacctagcattgagaaacagagaacaatctattattgtgactataacaactcctaaggagccatcagagtctcggtggcaccgctggccccatcgtcacccaaatcatcacagtgggccgttcggactgcaacacgctgcctgctcctcccggcgcacattcttcctggctctccctcactgattttttggcagggctcagcaggaatggaatgggcttccacgcccgttatgatgatggatgggcaggctgctggtggagtggggcctttggggaggcactgtatacacacgcacatacacacacactcacatactctcacattcgtatactctacacgtactctcacacacactctcatattcacatactctacacacacactcacacacatccacatactctcacattcacatactctacacacactcacacacacccacatactctacattcacatacacactctacacatactctaaacacacacacatacactagacacactcatactcacacatactctcatattcacatactctacacactcacaaacacacatatactgtcacactcacatactctacactcacactgcatacatgtgctataccctacaccctacacatacccatacacactcacactcaaactcttggccagcagcacccaggtgaatccactgtggtctcgtgggccaggattctccccaagatccttggtcgctgaagcagccccaaacccgctttgtctgggtctcttccaactctagagctttcattgccatcattacccccagctggacttctgagtcaaccagatctgagttagaatcccagctccacagcttactagctgtgtggccttggcaaggtcacctctctgaacctcaatttcttcacgtgtgtcttggagaatgccagtactaaactcccaggctaatatggagtcctcaacagcccagctagatggtgagtcccatctatgatccatcaatggcaccccctcccccaccttggtccctctgccacagactccatggatctccttaaaacctaaggatatggagttaaaatctgacccaacagagggcctctatgaacctgttctcgtgccacaaaaggcatctaatcccattgctccctgcctgtgaagggctggttgtcaagactgattcaggggacagtgtgtgtggagtggttagcacagggctcagcatgaaggctctgcatagtaacagctgcctctgaggctaggaggctccgtacataggtcccccctcctgctgagcagtaacctgtctccttcatgtcaccacccacggtcctacatctacccaagaggctgaacacactccaatacaggctggttggtccgggaggaccctagggaagaagctggagactctgagacttacaccattcataaaccagctcccccaccctaggtaagagcatatgtctctgaggaacccacttttctcttttctgttccctcaagagcctgcaaggccattctcttatttgccattcccaacttcccaatgagctagcatgataggtactaacgttctgcattttaaagacaagcaagcacctaagtcaggttgcttgtccaagataatgcagagatggagatgggatcaaaacctatgagtcatctcccaacaacgtatccactaaaatacctgcaattctagttttacaggtaagagaatagacatgggtgggataagtgagtggcctggggatacccagataatggagcatggaggtgaggcagaattgagcttggggaccgaaactctatcctcttaaatggcagatttgggagacattccctcaagaatgaacccagctctggcagggcccctcatccccaggtgtccccaccaaattcctggcccctgctattttggaagtctatcagagatgggcaacacagacactgaggagccacgggtgaattcccagccctaattttctgttctgtgctcagtctgtgggccctgggcttgggtatcgccctctctctgcagagtgtgtgcaccacccaccaatgcaaatgctgttggccgctgggagaaagcaaagcaaaacttgctgccagcccagctctgcttcgtaatctgccctttgcattgctggggaagcagtgggaatacagttgcagctacctgatggtacatctaaaaaaataaccagctaaaggggcccacagactcccacctgtcctctcctacccaccactctgggagagcagcgaagagctgctgtttcttttttctcccaccccaaggaaatcaatatgttgtgcaaaaacaactccttccagcaaaactccactttacacctacctccatctggaccatcccttggagcatccccctaattcaccaataattcctcccagaatcatcatgattgatttcacagacctgggttgctgcctgtcctgctatgtcccagccaggtggagcagagcagtcacatccacactcagtccccaaaagctttggatccagggtcacagccaaagagacacatgcctagaactggcttgcagagcaataaggcaaagctggggtgttttaaaagggaagtccaggttggtatccatataaaggctaacagtgattgagcacctactgtgggctaagcactctgcagaacttacctcattgaataatcagtataacattttacaaatgagcaaactcctttgggaaaaactggcactgttcagactataatttgttcatataactttcacaatgttcatcttcttgataccatacttatggataaaaataatacttagtggctctttgggtaaaaatggtaatattaattgtagtgctggcagtagtaagactagcactagcaattggaatttattatgcattttaatgactgtcaggcattgtgctgaatattttgaatacattatttgagtaaaaatactgttatcactttcaatgttcccagaattatgaaaatgtatctcaaaaatttaagagtaatcactaggagaaggctgggcatggtggctcatgcctgtaatcccagcacttcgggaggccgaggtgggctgatcccctgaggtcaggagttggagaccagcctggtcaacagggcgaaaccccaactctactaaaaatacacaaaaaaaatagctgagtgtggtggtgcacgcctgtaatcccaactactcaggaggctgaggcaggagaatcgcttgaacccaggaggcagagatcgcagtgagccaagatcgcaccactgcactccagcttgggcaatagagcaagacttcctctcaaaaaaaaaaagagtaatcactaggagaacagaatatgatctacagcttatgaaccaacaaaatttaaaaaaagaagaaatatggaacaattcctttaatataagacaggaaagggggaaagaggagcaaagaaacccaaaataaaacagcagaaaaaactcacatattgtatcagtgagtatattaagtataaacgaattaaacgtacctattaaaagacagagattatcaaaccagatgaaaacattaaacaaaattcaattatttgatgattgtaagaaacatatagaaaagccttattaaaagattgacaataaaaagacaaaaaataatatgtcagaaaaactctacccacaagaaaactagtgtaacatgtaattaatatgatatgaaactaattttgttcctcaaaacaatgcaaggtagaattaaaatccctattttgcatgagactgtgaaatagagaagttaggttacttgttcaagctcacacaagcagcaggggcagaaaaaggacccacacttggatttctattactccaaagcccattcttgaaactacgtgactctattgttctaagtaacattaccttagaaactattcagtgtgtagaaagtacatgttccaaaatcaaggcttgagataggagtaaggaaaatggagaatggatcatgagtcactaaaaaaataagaaagaacaatctactggttctcagtcttggaagcacgctagatagaacacctagggaactcaaagaaaaggccagtgatttggccctaccctagaccaattaactccacatgcctaggggtgaggcccaggcatcaatattttaaaagcttccaaagtgattttaatgtgcagccagagttgagaacaacttatccattcactaactcaagggcaagtttgctaaaacatggagggtatctttaggtcattgtgacaaagagaaatgagaagatcctccaaccttatccctttgcaatggtttgaatatttgtgtccctccccaaaaatttatatgtagcaattttaacccttataagtgggattactgctctataaaagaggtcccagagagctgcctggtcccttccatcatgtgaggacacagaaggctccatgtatgaagcaggaagtgggctcttaccaaaaaccacaagcaccttgatcttggacttcccatcctccagaattgtgagaaataaatttctactgtttgcaaatcacccagtgcaaggcatttttattatatcaacccaaatggaccaagacaaaaggaagaattggcataaagagagacataagcccttcttctgcatagtgagaggatgccatgcctgagaatatgacagaatccctgtgctaacaccccctccctgtttcttaaagagaacacaatgaaccacagaatctcagcactggaaagaatcttaggggaaacttaaaatggatcccagacttggctgattgttagaacgccttggaagttttataaaaatataaatttctgtggccctcccctaagggaatctaattctatagctctgtgttgagcctaggaaattgtatttttttaaaagatacgcagggaggcttttggagaaagatggcagagtgtcccaatacataatcagacaaagcaaaacaaaaaaacaaaaaccaataagtgaaggagaaaagcaagcagcaatcaaacaaggaactggcacacactcatactatcaacatctaaaagacctggggtgagggtgggggcaggaacaggatttggcagaagttgtcaggttcctaaccccaccccatgcttcagaagtattattgctgaggccaaaatctttagacttctcactaattactatatatttgcagagaagcagactgtgagtgtgacatcatttcttcctcttttctgacttaatacggagagagttggggaaacagattgagaactattagaaaaagagctataaaacagcagcatgaacaatcaagactctctctctttctctctctctcattctctctctctttctctctctctcattctctctctctttctctcacagaaacacaggttccagggctcaacgcttaattgaggggatcatctaaatggcaaggacatcccctcctatatcccctcattagtggaatgagccctggaacagcacatttaacaaagtcatgcaagagttaaatgtggtcctacccaaaggagcacacagctctgagtctgaccaccctcatctcccatgttcccctataatgctcccaggcatcagaaagcatctcaaactggagctgacaccatggcagaggtttcaggtaagtcacaaaaggagtcctaaagaatttgccctcaatatcagagtgattagaagaagtggacagagctacccaagttaaacatatgcaagataaaaaaaatatggcacttgtgaacacacactacaggaggaaaataaggaacataatagcatattgtgctattatgatgatgaagaacctctctagaagaaaacataaccaaagaaacaaagaaaattcctgcaaatgtttaatgctatagaagaaattaacaaaaacatatattcaatgaattcagaaaagttagcaggtcaaagaaaacaaatcaaagaccaaaataatcccattttagattgtcgagtaaactagaacagaaagaatacaactggaaattgaattcctacgtaggggacatgcttgagactaaacaactcagggacttgttagatattatcagccttaacaatgtaaaaataagctataattaaaataagaaagggggtaggaggtaggaagaagcaggtgattgctaattttttcatcatttataacatgggctcaaaagtctaaaattgaaactaggtattaacagaaagcaatgactccatcttcttaaaatttttcataaccttgatgagctcttctaaaagatatccatttcaatgaagacatatttttccagaactcagaacttcctttagatgtacttgtttcctcttagaaatttaagccatgtacgttaatactctttgttaaaattgggatgtagagtgtgatcccattattctaaaattattcctgtcaatctgtgatctacatatctttccagctgtgtgtgtgtgtgtgtgtgtgtgtgtgtgtgtgtgtgtgatgatagagagattacgtgagttttcttaatgttcatgatggttatgtctaggaagtgagatttttgagtaatttttaaatttcttctctgaactttgatattttcaaaaacaattgttataattgtttaaaggaaaaaattcccaagtggttgagagggtcacagctaaacttgaagagcacggcatctagcccaggaatctgattcctgaatctccaaaaatcactcctgagaagaagccacacaccaagctgctgtcaaaatctccagtgatgatgaagcactcactatcctcatatgccccatcccactgcagggcaacttcaattttacaggaccacaaattttctttctactgctaccctatcttctagtaataatatccacctttcactgaatttccctaactgtgagctaagcgtattctttaaatcttcagagcaactctatgaaggtatgaggtttcactatagttttgcccgtcttcctgttgaagagactgaagcccagagaagtaaattttcctgaggtcccccagctagtagtttgcagagctgggcttcagcttttcattgtggttgaatacaaagcctgtgtttttaaccaaaattctttgctagaaagtattgcatcatattgaccccaaatccacttttctataacttctaaccaatggcactgactctgctccctggggacacagcaaaaagtctaatccccttccataagcattgtcttccaacataggaagacaaaaatcatgtgaccctcatctaccccatcttcttcctccccaagtgatccttctgcaggtgcaaaatgtaccgagaagagagcatattttttctgacccacgatgaagtcactgaatgattagtttaaatggaatcatgaagtttctaatatgtacttaactatatgctatcatttaagttctgctttgaaggagttcctaatagttgggttcctccggaaaatctcctaagagggtttcatcccacagacaactcccaactccctgggttaactggaggggtgcagtggtgtggataaagtaatttatgtctgacacggaaatgtattatatgcatttttcaatttatcttcctaattaaattttttcatagactcatatttaaatgagtttccactcccctaacacatgaggactgacagtgagtggagggaaaataggataaaaatgttaagtagattttccaccaagtgtgaatcctccacacacgaatcactgagggaatcgctggcactctgtgggctgggtggaggggttttctttggtttataaactccccagaacctgattttcacatgcagacatgagagcctgtccagccagcagagtatatactgtccagcatctcctgtgccaggagccacaaggcagtggggcatggaggtgccccccgggccctgcctggaacatattctcccaggactttgagcttcctggcagggtcatgttccaggagccccgatttcagggaaatattctgctcccttggtttcacacagagggtagcaagcctccaccaaaatgcacacctgtgttggcagcgaggctgtggactgtggcctggaaaacatggcctcacgcctgggaaagcatgcctcagcgtaggaacagagacccaatatagctcagctcggactgagtcaggcactgaccccactaccctgtccctaaatcccccctgcagtgtccttgatgtcacctccctgatgtcctgaaatccaagccccccagccccctggggcacaggcacggctcttcactccctccctatggccattccccagttaccatctgaactcacttattccaggcccaggcctggctgtcccttggagggaaggagagacacccaacaccacagcccagaaggaacctccacagggagtcagtcaaaagccagacactaaaattacattttctcactcccttctcatttggaggaaagtctgtgtggggctggctgtgatcacacactttcatcacacactttctgcataagtgagagaactgtctcaactgcctcctcctcttcctcctcatcctcctcctattccctctccctcctccactgaattcccagctcactgcctcccactagttcacagtgtgctagggccctccagccccaccgagaagccacaggaagctctgatccacccccacagggaaaaagggatcagaaccaccacccagcacagatataggggccttgtgtaggggaccagccagggagcccctccatcttgaagaatctaagtcacgaggacaagcacaggagcaaagcaggcagcctgagctatccatgtcccaggccactgccggcctgttctgaaaaatttcacacaaggttatccccaatattcccagacatgtgtcccttccccggtgctgcatggcccccacactggctgagtatctccagtgggagaggaaaggacagaccgactcttaggaatgcctgctcactccgtggtagcatgtccccttcaggcctcctttcccatctttgaaagtgaatcctgggtggctccctgtcaggggagcacacagataacccagccccaaagatggcggggcagacctgggcattagcaactggagttctgttttcccttctaggctacctactatgtgtcgggctctgtgcttggtgctttgtaaacccactctcattccatcacccagcaacagtgagacccaaagctcagagaagtcaaagactttgcctgaggatcttacctacaattaatggcacatggtcaagacacaaatctcattccagaaaccaagatctttctaccacaccaaatgtttccctaaagagagcccataactccacacaggaacccagcccagcctggataacccatcagaacagaggaagaaaactcctctgtcaaaatgaaagatgctaatagcaagggtgtttactaggagtgttcaaatttccattaaaaccttcctgtgcaaagatgagctacgaaaatttccttcttggaagcttgtacctcctggaatccagacatctactttcaagctgctgaaggctcccactgcctccccacagggctgcaatcccgaccatggattattaaggagtccacaggcttggctcaatgaacagaacggctccgttatatttcaacctacccactaagacttaaatatcacaccctagttcagacagccctcgcctttcatttttcttggctttaggaagacagggagggagggcatacagagccaagaacccaagtgtctgagcttttacagtaacccaaactcacccaagacaggctgcccaaccgggcccacctctgtgtggcttctccagatcaacagaaatttggggtgaaagcctgcttttctccatgcagtaaggcatctgcatgaaaggcacatgtttccaggaccttccaagctctttcttgagtaaatattctcttaaaaaggttttgaagcagaggctaaggagaggagtcaacatggaattttatttctcttggattatctgactcaagcagcacccaagactagcaagaccaaagatgggctgacccaaagataaccatttacaacaggagtcagcaaaccaacagcctaagggcccaatccagcccgatgcctatttttataaataaagttttattggcacacagccatgctcatctgttctggggtgtctgtggctgatttcatgctacaaaggcatagttgagtggctgcaacagcatggcccagaaaagcctaaaatctctattatctggccttttacaaattaaaaaaaaaaaattgccaacccttgatttagaaaaactttcagatgtagttaggcctatttcttgagcctttttaagagcaaataatatctctggaatatatttggtatagtcttatatggagggaaaaggatgaaaaaaaatggcccctgagtttccttccaaatccacaggaagccaaaaaaggaatgaggtgcctggtacaaatgcctcaggtgacagacatcctatttacagaaaggcaatctgtgcaccacctcagggaggccaaaccaacatgcctggtgcaatcatgcagccttaccctgcaaccacgcccaacacttggaagcctaacgtggacaacgcctggtgcaagagggcatgtggtcagatgttccacccccacttagctcaggggcagacagaaggcttctccaaagctgtcccttggcaggatttcatgtagcagatgccactagtctacagtctctacagcctctgactcccagcatgtacacatgtaggtgtgcacagaggcccagagaagcagggtcaatggaatccatgaagctgacctggtggcagctcagggtttattccctgcttccaacctaccagcaggcacaactcttgatagatctaacagcacactggggatggagcactgcatcaggactgaggagactcagggtcttgccccagctctgtggctaactcctgatgcaaccttagaagagtcatatcatgtctctgggactcactttcttcttctgtcaaatggattaatactacccactccatctaactcacagagctcagtcatgcaacaagtaattattgggcatctactatgagtcagacattatgctaagcacttgggatatagtggcaatcaagatggacaaattccctgccttgtggagcttacactctggggttggtatggaaactaataagggatgcatagatgaatactttgaaaaatcatgatgtgcttcacttgagtcgtggatggtgatgctatcttcccactctgggccattcatggactagactcacacactgagcagacctgctgggaacacatcactgataaaagtcattcattgggaactattctaaatgccttgtatgtattaacctcaccatcacagagagtcctcaacactgaagtaggaactctaaatatgcatactccacaaacaaggaagctgaggcctggagcactggagctaaaaaggaaatatgtgtcctgtcccttatgatatctcccatactggctggagatgttgaatttactatattaaattcttctccattatcttgaggagtaaggccaggacccttcagatggagaggaagtctctctccctagatggggaagggaagttctccttccctagttcaatcatcacagaaaaggaaagcatctaacaggaaagtagcacccagaagagaggccttaaactccttggaagaggtgatcctcctatctgcctctttgggctgaactctcctagcaggggatttttagaagggtggataaccagttgtgggctgcagtgagaagagcgaacccagcccatgaagaaggccaaaaaaatgaggactctggcagggtctgtgagctaagatgagctatgccctacagggcagttatctagctctgtcagcctccattcatttccttttttctgtctccacattttcagtaacgtcctgtctaaacatcccaccagactctcaacgcaacatagacaattagcgaaaggttagaaagtcatgcacccaagcttggcccaccacagttagaggaaaatggcaccaccttaaaactagtatgtaggtgttcgtactaaatacgtgagaaattctcccaaaggaaggtgaagctggagagagtcagggtcatccaactactttttgccctctcagagcattttcctccttgccaatgctggacaatgaaagcactagtttattcagggaaatcacagtttcctttttagaagagcaggatgctaagaagggagcaagaataagttgaaaacaaatggagtaagattcagcattgtgcacgcacccccagcccagccacccaagagattctcccaagccaggcagtgatgctcacatctggtccttcaccaccaggaccaagtcagagcaaaggagaaaagaagagaaggaagagacaggagcgcactggatgggagagtgaagggttggagaagagagggatcccagcctactcccaagcccagtgggatcatcttcccctaggaactcccatctgatattggctctggttggggctgcctctctcccagcacctgctgggtagacttccccatgtttggtcctgggaggtgctgtagcagctggagctgtcctctttctgccgctggaagcaactggaagtcccaggggccctggcgctccctctgggatttcaccctattctttcctgtctcgctttctcttttatctcctggattaacttactgttgtgccatctacccagttgtcagtgtgcctgtctcagctttgtgatctcacgtagatccacagaacctaagagctggaacgggccctgaaaacattctggagcaggcgtctcggcagactcaggcatgcctctccccagggaaccaggccgcgtctgggcagaagcaaggcttgggggagtggcaaggattgtgtgtactccctcgaagcacatcttcagaagtggagcattttcaaggtaggatgttgacataattgttaggtccatgaaggcagatgctagaagcagtgtgaaaataagactctgaggttgtccaggtggggggctatttttatacatttccccccacaacccaagcagtacatgggccctagccctcaagcttcacctcccagatgtaagactccaaccaagattttggagtcaggggcatacaaagcccactcaggggacacactcatagagtattcaactgattcagagatgtgggaagaacgctattcctatttatttttttgtagaaacagggtcttgctatgttgcccaggttgctctcaaactcctaggctcaagtgatcctcccacctcatcctcccgagtagctggaactacaggaacacgccaccacacccagctaccactatttttatattaaataaaacatgtatcatggagtgacaggaaaaacctatgcaagtttaagtaaatattgtacttaaagtgggtgactttaaattatgctcttatatgtacaggggaaggacagaggaagggctcatttaccttcattcttctctctccctagagaattctgtgtatccaattttaaaaattcatcatatgtcacagacagaggcacagaccccctgagccatggtgggaagatacttctggacaaatgtatacccagcaaaaatctcaaaagctccaactttctaatggcttcattttactgatgagaaaactcagacctatagaaagaagagcagaaacagactggatcccaaatccctgtgccccacagttgatgctctttccacctccaatctgaggcactgctctccatgtggccaggaaccgtttccaactaaactggtcctgcctagggcctggaaaaacacactgttaatatgcagccttaattaaatatttctgatgagcacaatgatgcttcaaaattctagctaggattcgactgatgctgcagcctggagccatcaaggaagagcctctttcccctaagcatggtgtgtgtggagcttgctgggaagactgagaccttccaatccaacctggccagcacatctattcaagccatcaaccagaggacagatgtagaagtcaccttctccttccagggaccactcttggaagcagatttccacaaaggggaccgtacagttctaagcttacagatggttagaacagaccagccccactggaaggccagaagtgacgaggatgaggtcaaatgtcagtgacagagaggctcagacctctctgagccatggtgggaaaaatctctctgacccatggtgggaaaaatctccctgaactaatctgcaatttccaggcatttctgaccagtaaggaaaggatttggttgcagaaggctgggaagctagattgtagaccaagagatggagaaaactcttcaaggggagagcccagccactacaaaggggcccagcatgaggtgtgctggaggtaccctgagggccgtggctgcctgactgacttatcctctactttgggaaaaggcaactcagtgcctggattaaaccattagctctggaggatgcctgtctggtttgaatcttaatttctccatttcccagctgtgtgacctcgataagattacttcatcctctgggtctgcttcctcatatgaaaacaggaacaagaagtgcataaacacatttcagggatgtagggaagactaaaagggttaatatagggcaagcacttagcacagtgcccagcatagagcagtactgtctaggctgtagctaccacacatacccagtgaaggcactcaactaccaggtggacaagcaactgatacatgtgtgtgctgctctctgctcccctttggacatttggaatttcaagtactgggacttaataccacagagggcagagttttgtttttcctgcctttgacatgatgtttatgatcttcttttcttgtgaacaccccagacctagggaccagcggtggcctggcttcctgatgcagcccatgaacacatttaagaatccaaaaaggttagccaggcgcagtggctcacgcctgtaatctcagcactttgggaggctgaggcaggccgatcacttgaggccaggagttgaagaccagcctggccaacatggtgaaaccctgtctccactaaaaatacaaaaattagccaggcatggtggtgcacacctgtagtcccagctactggggaggctggggcatgagaatcgcttgaacccaggaggtggaggttgcagtgagctgagattgcaccactgtaccccagagcaagaccctgtctcaaaaaaacaaaaaacaaaacaaaacaaaaaaacgccgggtggcggggtggggaggcggggagaaagctgcctctgcattgcaacttcccaaacagcacagacattaacattttagtgatgaaataacaaagctgatattctcagtatcattcctttattgagtgaaatcagaaatataactttttcttcttttttttcccccgtgggactccataaaactatttttgttgtaaatgttttaaaaggcagcctgtcaatatttcaaatgttcctgaattggagctcatggataaatgactcttcccccattggccaagtctcctctcctgctgcagcaaggaaaggggcacttgggagctgagaaggcaggaaccaggcgccgttgacactcctctagtgagatgaatgttccctccactgggtcagcagtgagcaccagcccaagaagtgccctcgcctccctcctgctgggcagtcaccaggcaaccctgcaggcagtgcaccaagctgttcctccataatgcacacccagtcagggcctgggcacctctagttactcagcagtgagcccacctgctatgtctcaggggcatcccacacccagaaagctgcttctacttcaagcctactcccaggggatgccccatcagggactagagggtcctgctgaacccaccccaggttcaaggtcagcagcaggctgtttcaccaggaaggccaggagctatgctcaaggtaaccaaaaggacagaaggccccacccaagtgtcatcttgcccctcctcccagcttccccattggctagtaaatgagtaaacagacatggttctaaaacctagaagagcatcagaactccctgtggatctgggttcaataacacagatttgatattccactcctggatattccagttttgtaggtcttgagcagggatcgactttttttttttttaaggttccaacagatgatactgtggctacgatgggcagctcagatgtaggccactggcaacacagagtggaaggagaagcccacagggttcctcactgggcgacacaagctcttcaaagcaagctgagtaaatctcttggtaacaagccaagccggactgcccacagctatgggcaggtctgctgtgtctttcgcctgctgaaagcccaggttgcagcacagggaacagcagagacaggatcaaaggctctctgaggacagtctgtggcaacaaagtagcagctcctctctgatgaggtaaggaagagtccaaagaaattacttttgggctgggtgtggtggctcacacctataatcccagcactttgggagaacaaggcaggcagctcacttgaggtcaggagttttaagaccagcctggccaacatggtaaaacctcctctctactaaaatacaaaaattagctgagcgtgctagtgtgcacctataatcccagctactcaggaggctaaggcaggagaatcacttgaacctgggacgcagaggttgcagtgagccgagattgcaccactgcactccagtctgggtgacaagagtaatactccatctcaaaaaaaaaaaaaaaaaaaaagaaagaaagaaaagaaaagaaagaaagagaaagagaaaacacttttgaaatttggaaatgaggaagactaaggaagagtccaaaagaaactttgcctctgcccaaggagcccacaaactttccaaggccttcctgttcctggaaacggtgccatctccaaagactcctccgcacatggaagagcctgatctctcgggcacagtcaaccattacggcccattttctcaaactaggccctcctgggggtcttagggaaagggggcaacattacacaaggcaggtgaaggggatagccaatcacagaggggtgcaggttggcattgacctcttcctaacttttctcataatatgaaagtgacttctcttctcagaagaaccgttcataatgaaattcgagctgcctcaatcttccttgatcatctcttcactcttaccacatacacacacgcacgcacaccacaggaaaacgcatcagatgaagaacttccccagtccagtgcagatttaagaaagaggacactgacatagggaggtgggctggggagctggggagggggcagacaaacaagggcatgtgactgatacacttcagggcgggagtcagacggccccctcacaggccagggtgacatgtgacaaagtcacaaggccctgtggtatttcttgaaacttgatttcagcccaagtcaaactccatggatcaagggtcatttctggctattataggatgagagtatccaggactgaagacctcatggggcagaaagaaaaaaaacagaaaggtagctcttggagaaataacctaaagattagaatcaaggaagagccaacctctcttctaacagggaaaaaaaatttactaaaatgacacttcagcatcacctattttttcaagcttgtctttctgaacagaacttgaaaacacagttgtaaaactgttttactagttcagccgacttagaaaaacaaaaagagcttctcacagctttaaacagagtcctgtgctgaagtgttccaacactccagccccactctggggttaagaatgacagatgatgcaatgtaaaaacatcattttccactggacacagagaacatggtacaatactttggaggttaaacagatgagaagggaacagtacagagacccaaacttagctcctccatgcctctagcacacacatatgcctcatggaaggcatctggagaggttagtgctagagaggccagaaatcttgtttctggttctgtgctggaattaactaggtaaaccctggatgaactgttacatctttgatcgtcactacctgagaattaacttagacaaacattgacactctataaagcagcaattgcaaaatgtgggttttcaaaagcactctgagttcttttcaaagaggatggcataagaatcgacacagctgacatatggtgtggacagagagaaatagcttgggcttggatttccggtcagttcccctttctgccagttaccatcagaggaaccatgggcaaattacccaatctctctgagcctgtgtcttcacctttaaaaatggtattatagttctcaaagtaattgcgaggaattaaaagtcaattcagggtcaggcgcggtggctcatgctgtaatcccagcactttgggaggccgaggcaggtggatcatttgagtttaggagttcgagaccagcctggccaacatggtgaaaccccatctctgctgaaaatacaaaaactagccaggcatagtagcatgtgcctgtaatcctagttactcgggaggctgaggcaggagaattgcttgagcctggtaggcagaggttgtggtaagccgagatcacaccactgcactccagcctggacaacagagtgggactatctcaaaaaaaaaaaaaaaaaaaaaaaagggaattctatgccctgtaaagtgcagtctatggaagtgatgatgatgaagaccaggatacagtacaataaggactctttatgctttcaaaaccgtgattatgctgcatctggtggaagccaggactctggaaatatggcccagacacacccagaactgaggatcaagatgagcgtggatccctgggtcatgagcatcccaaccaagtgcctgatgcccaactccagggaaccatcttccctccgcacacaatagtcattccatggtggtgcacacctgtgagtcaaaaacaccctaagaaaatgtaatccttggggcatttcctcagctccagcctccggcccatcaatcacaagcacaatcaaactgcaatgcctcaaaccaatctcctaggacccctgccagggcagagactgaaagtcactgaggcaatagagcatgtattatattgatgatcctctagctgcaagacctgattggtttgagactcccttggataatgctggcaattaattttggcaaaagagcaaaagatagatgtgacatccattgaacacagagctgcacaggagtcaggtttctggaaggtaggaagaatgcaaggaaattaactccagagtggtttgcagggaatgggggctccaggctcattatttcaatcttgaaagctgtcaatcactgtcaaaaggcagtttaatctcaccctgaagctttcaagaacactatgaatccaggcctacaattagcagtccaatgttgggctgatgagttatgggcattttccatctgggagggcacaagcttctcctatccagggcgtgccctgggcataaaggatgtgtggacaaatacaaacactccaccagccagaggtgacagaaataggcctataatatttgcccaactgggtttatgagacaagcatgtagttcaacactgtttatacagttcatgagagaatcttgggcagtgacagagaatgtaactctcatcctccttagggcttccagaaatgaacagaggatatatatatttttttaaaaagtggatcctccacattttctaaagtttttaagctctctggggcaggttaagaaattcagactgcccaggaagtgattttttttttttttttttttgcatggaatttcgttcttgtcacccaggctagagtggaatgcaatggcatgatctcagctcaatgcaacctccgcctcctgggttcaagcaattctgcctcagcctccctagtagccaggattacaggtgcccgccaccatacctggctaatttttgtatttttagtagagacagggtttcaccatgttagccaggctagtcttgaactcctgacctcaggtgatctgccggcctcgggctcccctctttacaccattctctaagcaaataagctaacatcccagaatggaattatagaaagattgcaccagtcaaaaaaggcatttggtatacatattctaagaaatgctacataataacaatatgaattaataataaattaccttctttcaccttgaactgaaggatttgcaaattttctcaagttctctttcatttgaccttcacaacaaacctgtgacatttcttaccccctatgaatggttaaggaaaagactcagaaagtgggttcttgcttcttcagatcccagatgactcctgaaatattcataattctgatcttaaaaaaaatataacacagatggtaggacatgcctcgtgaatcaggtaataccctggcagcatctcccttagagcgtagaattccacaggcagggatgtgccaaacacctctgcacgccaagctgggtgtagcaactccatcaaatccattggatcacgatgatcctggtacagggagaggggacaatggaacaaccaaggccctggaagacagcaactgaaaattttgacctgtggttcaccagcttgaatccagcactgggatgtcgggggtggggtgttccagggaaaaagaccacagcttctggatggttccaagaagataggttccctcattaaaactggtatcaaccaaccctcttgtacacagacccctgtggtgggtgtcaaggggaaagaaacagatgggcccaggatagataacacagatgcccagtccctgcccccaagaaagctgcccctgccagttgagaacactgctgcatctcatctgaagagaagcctacacagcagtcctggaattccaaatcaggtggaagaaggcagatggcgcaaaataaactcaagaaacagacaatgggaagtaagcatcaagccaggtaccttgacacagtacctctggcatggtccccaacagctggcctgttggcctccccaaacaatgcctctttctaatgagtctttctttaaagtggtcaccgactatacaccttagtgtagagctgctggtacaacttcctgtaacatagcagttgcagtgaagctccagggctacgctgggagtatgagtgactggctcagccccagaaggcaagtcactctccgtgtcctggtcagcccagcccctgtcactgggcaacatgtggttgtgttcagacatctcccacctgtccataaaaggtgaggtctaatggtggcctctttgggacaaccttagggcaatggggcatacgtccaggactgaggctgagaagcacacactggtgcatccctaccagggtgaaaatattgaaatcctttttacatggtggtaagtagcagcttccctgaattcctgcatgcctactaccaccacccagcctctacaatgggactccatgcctccccatgatccagcgactgaagggttggacctggcacagtcgacacttctctaggactctgtcggtgcccaggcagctgtgtaattgtgaaatgctttgaatatcctccccacacgggcccagtcaatggtgctgcaccttaacccaaacacctcactagtagaaaggctaaggaactcaccttcctaagaacctgttgaggccacaccaccagctgtcctccactgggcaagaaggtgtcacccccagctctcctctctagctagggatcctccattcctgctgagagggacaatcctggaaaaagaactatagcccttcaggtattgtatccatacctctgagtctatgtgtgtttttgagaggaaaaaaaaatgcttctggtttcacctttagaactaaaaatctggttgatctaatatgctagacatttcagcaatctctggcccaacacagagtagggtgccactgttctctatattcctggcccagctgaatcacagcatcatagcatttaagcaccctcaactatattcagcccgatatgtttaaaactgcaggttatggccaggcatggtggctcacacctataatcccagcactttgggaggctgaagcaggtggatcacgaggtcaggagtttaagatcagcctgaccaacatggtgaaaccctgtctctactaaaaatacaaaaaaaaaaaatcagccaggcgtggtggcgggtgcctgtaatctcagctactcaggaggctgaggcaggagaattacttgaaccctggaggtggaggctgcagtgagccaagatcgcgctactgcactccagcctgggtgacagtgcgagactctgtcaacaaaaacaaaacaaaataaaacaaaaaccctgcaggttatgacccatcagcaggtcacagaatcaactgaatcattcacaatcagcatttttcaactgaaacaacagcacagaaaacagagtactgcatattaaaagggttgctgcatggaacttttgtttaattacatacatgaacataagtattgggttgagaaagaaaaggtatttcttattctgggtttcaggggaaaaagcttttgaaagcccctgatctagctaactccactctatcattgatgaggaaactgaggctcagagaacagcatggtcaaggccactcagagaatgtgcagccaggtgaggtggttctcagtccatgcagcctgcggactttgcttttcttctaagcagctctggctctggccatgggcattgggattctgggatgctaagtagctggctcctcagttcctaagagctgtgctcaagtggtctctagtgccattgagattttccccagcagagtaacccttagcactagatctcctgaggctgaccaggaggccctgagaagagatgccagccaagcaccccatcccccattcccacagcctggtagtgggtttgggcccagcctctacatctcattctctctttataaagtctcaagcaaactgtgtggctgggactttataataaacttggagccttcttcaagctgaggctccagcaaacaactagatctttctgagcagatgcttctgctctttaggcaggcttcctgtctctacaggtggtctagccctgggactactggaaaaatgagggagtgagggtgtgctttgtgagaggctgggacaggggaacggctcctcctgacaatgtatggaaacacttttttttttcaattaaaaatagcatagatcacagatgagaaactaactagaactatataaaaatacaactttttttttttccaatgggacctgcttagatagaagctaacattccctgaaaactatttgtcaagcattgtgctatgggcttcacacacattatctccctggatggtatagtagttatctcacttgatataaaataaagttcagtgataccagtgaatgtattaatgacatacacagagctatcacttctacagtgcttattctattctaagaattttgtgtgttatttgatctcatcatcagcttgatacagttggtgctattctcatccccactttgcggattatgaattgaggtaagaaaggctacctgacatgcccacactcacatagatactaagtggtggggccagggtttgaacccagatggtccaagctttggaccctcctaattacctccactacactggttatgattccttccactttctggcgcagaagcagagactcgggaaagttaaatcatttgtgtccactccacccagaagctctccacgtacaccagagggatggaaaacatttaacaatgggtaaggcaggtccatgaccttcacaaggggcaccattggctaggctggagacctcctgctatgctggaaactgagccattttaggggctgcttcaaggggaaacccagagggtttcagagaagggataaggtaacagggacactcacagcacttagggcaatgtctattttaatcagcagggaagttttccaatatgttatcaattttggccactgcaaacagccaagataagacagtgctaaagctcttagtcgaaactgaatttttgcatgtttcggggctggaaagaactcttgagccatatagaattcaacagcctcattttaccaatgaggaaaccaaggctgctatgcaaagcatggtgcccaaggtcagagaactagtaaatgacagagtcaaaatgaaaatccagggtgcccagatgcccagattggtacttagggtgtttggtggtggtggtttgtttcttccctatctgtgctgattatattcaatacacagatgctgatgtgcatgcacggggcccagcccccagctgctgtgccacaccctgacaacctcaggatcttcagagaggctcagctgctcaaagttccaccagggaccatacaagcttcatggatattcagattttttttagtaagcacctgaattttgtgtaactgatttccacacccattgaaggcggcttctaaatttagaattaacatccaaagcggtctgttgcacaaatgtatacttcctcgcaagctgttgtcagaaacagtaaaactgacatccataaaacagtttcttcataccttaataatattgaactataaaaatagaggatctcaagcaaacaaagctgtaaccataataacctttacaaagtctactaccacagtcaagtactgtccagatctttttttaatgaaaatgtaaaggtggccccagccttattctcacatgacaatgcaattccctaggcccagcattccctctagacacttgtcactgcccaatccagaactttagtaattgatcatttggggtaataacctgcaccttatacaataaagccacctttgcagaaactgcagcttcactttcatcacttcctcctttgcctattccaattagttgcttagattcagttagacacgtctccccataccaagcacattcagttgtgccaggaggatggaagaagtctttctttcaagacatcttaacaaagtagacattgcaacgcaataaagtagtgagactcatggttgatgcttacacacaatcttccaacagaatgctttatcatcccttgcccagaacagatggggaaaaaattacgctatgccctgaaattttccattcttgatctcagcccaaaggtgacttttttatttttaaacttgagacttgagcaaaaaaaaaaaagttcaactatttttgattcatgcccaggctaaagaaacacatggtaagattctttttttttccaaacccgtaggtagctcaaacagctaagcttcaaaagctcaagctttccaactagcactaatagtgttcacagaggcagcacctctgcagtaattgcaaggccaaaaatcaatagccggggtgagaaggagctgggattccactttctggacacattgtccccagtacctctaaatacttaaaagaaccgcatagaattctcaaatgtttaagcaggatggttgggcctgaagcttttcctcccttctgggtgataaggcaacccgtcctcatcaccattttttcattacccatcctttgatgcatttcagtcctctcgagagtccaggctacccagagagaactgacaggtctcctgactgccctctgtccccagaacttgctctcttctaccccgtccctcccagccctagccccaacactgactcctctactccttctaccctccctccatcctgctattcccagtctccatagaggaaaaagggagtgtcatgcctagatgaaaagatttggggttcaagtcaccccatgtacctccctggttccaacgaacctccggaattctagccacagatccccctcttgccctctcatcctcccctaacacatccctacacattgcaggcccaggggggagtccacaaaatgggactccatgcatccatccttctgtggggccgcgtagcacacccacggcaagactccagtccctggtcccggctctgccacttatgaactgtgtgcccataagcaagtcgtctcttgctctgcagactggggcttatcacatttgtcccacctgtcccagagagctgttatgcaaagtaaggggaatcacagatgtgaacaggcttcagaatcagagctcaatataaatgtacctccttattattaggcacatggcacagtgccaggcagtgtggtatgttccttggggctaaagtccaagagatattggcaataaaagaaagtgaattataccgggcagaaaacaaggaacaaaaagagaagaacagagatgaggattcaccagcctccagagaagagtgaattcacagtgacagtgcaatcaataaaggcttcctgcaagaggaaggctttgtatgcagcctgaagtggctctcaccacgctgatcaaaggtgatttcatggccaggcatggtggctcatgcctgtaacacgagcactttgggaggccgaggcggacagatcacttgaggtcaggagttcaagaccagcctgggcaatatggtgaaaccccatctctactaaaaatacaaaaattagccaggtattttttttacaggtggcacatgcctgtaatcccaactactctggaggctgagacagaagaatcacttgaacctgggaggcaaagattgaagtgaaccaagatcacaccactgtactccagcctgggcaacagagcaagactctgtctcaaaaataaatttaaatttaaatgtaaaaaaggtgatttcatgcatgccccttcccaagaccaagcgctctttgagggcaggtgacatgtctttatgtctcagccttcgcagcttcctcctggcatctaggtgaaagaaagaatgaatggagccttgaactaaccaggaactcaactaagtggaaaagaggagagactcccagatagcagagggaagacaagctggggtcagagggcggactctttggcttaggagtagaggagttcagaagttcaggcttctgatcacaaagggaggtaaaaggagttcagaggagtcagtgacatcatgaaatcagtatttggggagcttaattgggcagctgcatgcaggatatgcagcagggggtgaaggaaagctggcagagtggccaggaggcaagggcaatgagtcaggcagacggtgagaagggaagccactgcctctcggccaaatcgccctctgggagcacccatctctgtcccagtggaagccccatcaagggccactctcagtgactgtcctctttaggctggaccttaagtgtcccctagtcctcctgccttgcacccagcactggcctcctgcaagtggttaccttccccttgtgaatccctccaggctcagggattccagggattccagggattccctcccattcccgttttagaggacaacgcggatggtaagcactcccttaaaggaagcacagtgatgcagcagcgggcggggaaacagggagagagcttttacttctgagcacattttcccaaattgctatcttttcaacacttttataaggtagtatgttaatatgacagttaagatgatgataaaaagaaggtagaggaaaaaaatgtggaagacaggaccagtgcattcaacacacagctcagacatgattgagaaacagatcctggtgctgaagagctggggacaggagcctggtgatgggcagcctcggttccagggcaggccctgccaccaacgcactgtgtgaccttaagcagctgtgctcttcccagtcactctcttccacctgtaaaatgatgtcagagatagttcccacccaagagggtagttgtaagaaggaaatgagttgatctggtgcagtgcttagtacttggcacaagataagtggttagtaactggtatctgtgatgggcaccaggctagcagttactgcctctaacatctggagacgcaaaccctagcactgcagctatcccacaggaggtgtcaaatgtgagcctcccaccccatccccctgagatccccacatgaatgcacctccccacagccctaacgctctcaccagggacacacagaacaagccagtgcctcctcgctttacagaccatcagaaatgcaaaggcagttgctgtgcctccacggaatattctctcccctaaaatcttcatgtttttctctcctcttatttctcttctattcacctactgcacaaacaagatcaggcagcagtgataggcaaggaaagatggaaatattctttaagtggaatagcaaaaataggctttggaaattaatgcctagaaatttaccctgtgggctctctggagaccaacccaaatgaaatcccattgacagaaagctgcagccctctggggaatgtccccccatcccatcccccaggatccttggtccaggaaacatggaagttggcttctgatctccctggtctcccagggatcctgctcggggcaccacctgaaaagtccctcggcagaagcacttctcgccatgcgtgaatgctgtggaaagcatctgaacatgaagtttccaattactgctggcatttctggagtgtcctgatgctggctgcagctgtcccacggaaggccagtgatgtcatcagcaagcctgacagcactgagttccaaggctggctgggaagaaaggttccctgcaggctgagcccccatcactggagagggaggaacctgccatttcccccgcaaaggtgggcactactcaggtttgctgcttcccttcctgggtagaattccattgccataacttggactcacaccaggaaaggttcagaagctgcaccaatgtccaggatgattccatctgactgcttctgaaaacttactatgtgtccagagttgttccgggtggaggcaagcccaggtgagacctactttccaaatgttcatgtactcacttcgtggcatgaaaacaaaatggtcttgcattcttcggctacagagagacaataagggaagtaaaaaagggaaagagagaaacggagaaaaagcaaaagaaggaaaaggtgggaaggaaatgaaaagaggaaaagagagagaggggaagggaaggaaggagggagaaaaggagggaagaagtttttgtcctgtggctagttttaccttgaacctccctactcaagaccttcccagttcctctctcctcctctcccttgctcagggagctcaggccctgggggagccctggcagataccgtcctctagaagagctgaccaaggagacagagcacgggatgcctgcagagcgatgtaacagattgggccctgagccctacagtagagttcaagctcaacgcaatgttcagatttcccaaggcgggggattagattaattggaatttgcaggctgtgcccaaccaagatccatatctgtcaccatgttaaccacattcaggcccctcttaaaatcagaaccccgccatccatcaccaccccggtggagaggcacggccagagcctcgcagtccaagactgaccttctggctggcagcctaccttttagccgccagcctcctccatgggcttccagataagcgtgtgtaactcttgagcaaatcctagcccctggaggaactaccggcagttatgaacacagtccctttgttcatctcaggagctgatttaattaaacgagaaactatggacccttcctaagggagaaactatttagtatccagaaccaaggaaagtaaaggctaaagggaaatccagatcctttcaaaaactatctaattgaaccttgggagcaaaaccatgcagtcaaattacacaagaggatccaaggggctgcagtgtaacccaaggtgacacagccattaagtgaaacactcaggtctgagctagggcaccctttccaatgcattatgacacatttaatctgtaaaactgtaaattattttttttaaaaaaactgtcttgggccaggtgctatggctcacacctataatcccagcactttgggaggccaaggcaagtggactgcttgagctcaggagtccaacactagcctggccaacatggtgaaaccctgtctctacaaaaagtacaaaaattagccaggtgtgctctacgcaaataaactagaaaatctagaagaaatggataaattcctcgacacatacactctcccaagactaaaccaggaagaagttgaatctctgaatagaccaataacaggagctgaaattgtggcaataatcaatagcttaccaatgaaaaagagtccaagaccagatgcattcacagccgaattctaccagaggtacaaggaggaactggtaccattccttctgaaactattccaatcaatagaaaaagagggaatcctccctaactcattttatgaggccagcatcatcctgataccaaagcctggcagagacacaacaaaaagagagaattttagaccaatatccttgatgaacattgatgcaaaaatcctcaataaaatactggcaaaccgaatccagcagcacatcaaaaagcttatccaccatgatcaagtcggcttcatccctgggatgcaaggctggttccacatatgcaaatcaataaatgtaatccagcatataaacagaaccaaagacaaaaaccacatgattatctcaatagatgcagaaaaggcctttgacaaaattcaacaacccttcatgctaaaaactctcaataaattaggtactgatgggacgtatctcaaaataataagagctatctatgacaaacccacagccaatatcatactgaatgggcaaaaactggaagcattccctttgaaaactggcacaagacagggatgccctctctcaccactcctattcaacatagtgttggaagttctggccagggcaattaggcaggagaaggaaataaagggtattcaattagaaaaagaggaagtcaaattgtccctgtttgcagatgacatgattgtatatctagaaaaccccattgtctcagcccaaaatctccttaagctgataagcaagttcagcaaagtctcaggatacaaaatcaatgtacaaaaatcacaagcattctcatacaccaacaacagacaaacagagagccaaatcatgagtgaactcccattcacaattgcttcaaagagaataaaatacctaggaatccaacttacaagggatgtgaaggacctcttcaaggagaactacaaaccactgctcaaggaaataaaagaggatacaaacaaatggaagaacattccatgctcatgggtaggaagaatcaatatcgtgaaaatggccatactgcccaaggtaatttacagattcaatgccatccccatcaagctaccaatgactttcttcacagaattggaaaaaactactttaaagttcatatggaaccaaaaaagagcccgcattgccaagtcaatcctaagccaaaagaacaaagctggaggcatcacactacctgacttcaaactatactacaaggctacagtaaccaaaacagcatggtactgttaccaaaacagagatatagatcaatggaacagaacagagccctcagaaataacgctgcatatctacaactatctgatctttgacaaacctgacaaaaacaagcaatggggaaacgattccctatttaataaatggtgctgggaaaactggctagccatatgtagaaagctgaaactggatcccttccttacaccttatacaaaaatcaattcaagatggattaaagacttaaatgttagacctaaaaccataaaaactgtagaagaaaacctaggcattaccattcaggacataggcatgggcaaggacttcatgtctaaaacaccaaaagcaatagcaacaaaagtcaaaattgacagatgggatctaattaaactcaagagcttctgcacagcaaaagaaattaccatcagagtgaacaggcaacctacaaaatgggagaaaattttcacaacctactcatctgacaaagggctaatatccagagtctacaatgaactcaaacaaatttacaagaaaaaaacaaacaaccccatcaaaaagtgggcaaaggacatgaacagacacttctcaaaagaagacatttatgcagccaaaaaacacacgaaaaaatgctcaccatcactggccatcagagaaatgcaaatcaaaaccacaatgagataccatctcacaccagttcgaatggcaatcattaaaaagtcaggaaacaacaggtgctggagaggatgtggagaaataggaacacttttacactgttggtgggactgtaaactagttcaaccattgcggaagtcagtgtggcgattcctcagggatctagaactagaaataccatttgacccagccatcccattactgggtatatacccaaaggactataaatcatgctgctataaagacacatgcacacgtatgtttattgcggcattattcacaatagcaaagacttggaaccaacccaaatgtccaacaatgatagactggattaagaaaatgtggcacatatacaccatggaatactacgcagccataaaaaatcatgagttcatgtcctttgtagggacatggatgaaattggaaatcatcattctcagtaaactatctcaagaacaaaaaaccaaacaccgcatattctcactcacaggtgggaattgaacaatgagaacacatggacacaggaaggggaacatcacactctggggactgttgtggggtagggggaggggggagggatagcattgggagatatacctaatgctagatgacgagttagtgggtgcagcgcaccagcatggcacatgtatacatatgtaactaacctgaacattgtgcacatgtaccctaaaacttaaagtataataataataaaaaaaagaaattacttttgaatgggaaaaaaaaaaattagccaggtgtggtggcacatgcctatggtaccagctactctggaagctgaggcaggaggatcactcgagcctgggaggtggaggctgcagtgagacaggattgcgccactgcactagaacctgggcaacagagccagactctgtctcaaaaaaaaaaaaatactttctttgatatatctttatgagaattgctatcttaatgttgctcataaaaataacttacacaaatgtgtgccaattgctgaagatcttcagtttcagttattctattttttatttctggaagtcctatttgtattcttcaaatctccacggattttaaaaattagtctattgtttcttcctcatttgtttcaaacatttaaaatacattacctattccattggaactatatctgaaaccctcgggaatctgattcttctgtctgttgtttctgctgactttcactcgtggtgactggtttcctcatctgttttggattttgagagtgaaagctcatgcttgaatggctgggttttacctacaggaatccatcaaggcttgagctacaagtatgtccctccagagagaatgtgcatttgattctgacaggaactctggtgtgaccaaccccaaactacctccagttaattttgcagcgtggagtctcctgggtcacccaggcagtacaaattcaaaccccaaacttgcatgaaggcagacttatgattacaaattctcacagcaaacattgttccatcctttggcaagccaaagccaaaacagataagggcccctgtcttctccctttgcccccctgcagatgtctgctggaccacctgtctgtcccctagggatatatttctcctgtaggggaaagcttcagacagaaatctcatttccaactccccacctggcaagggtcccaggtctggctccctgggtattctaaaggccatgctttcaatcctggcttaaagcctgacacgccctcaatctgatttattgtaaacacagcgaagtctttcttagagcctagatctgtgctttttcccgtacctaatttaaagctagatacacctttctttggtctttggagcccagagttcccagggccttctaaggaataagctttcaaaactttgaaatgtagatgtatttataggaaaaggaaagcagcagcaacaaggttttaatgacctataaggctaatggaagggaggaaaaaacgcacacgcctgtgtagtcagcagttccaattgaggagcatctgaaatgctgtaagaaggtagaacaaagtgggaaatattagaacagagcagagtggatggggaaagaatctacaaagactgtagagacatttctctctgtctccgtatctttctgggtcattcttcgtcacaggatgtcaacataagaggtatattttaccctatacacacatgatgtgggccaaaagttgaaaatgagtgtaggattagaaactacaattcagaattttaaaaagaaaccagaccacacacaacaacttatccaggtagtttccagaaggcttcatagccatcactcagttcgtcctcacaaaagccctcaaaagtgcattttataaccagtaatggccaaccttctgataaccagtctactgtactttctcacatctgtcactacttcttatcaaaaaaaaattcattgattaatcaataatacgtttgggaggctgatatgtctggatcacttgagcccagaagttcgaggcagcctgggcaacatggcaaaactctgtcgctccaaaaaaaaaaaaaatccatatatatatatatatatatatatatatatatataaattagctgggcatggtggcatgtgcctatagtcccagctactcaggaggctgaggcaggataatcgcttgagctcgagaggtcaaggctgcagtgagccatgatcatgccactgtgctccagcctgggcaacagagtgagatcttgtctcaaaaaaaaaaaaaaatcaataacatgcacacactgcaaatatatctccagctctatgattcctcactcaaaatcttcaaaaccagatgtgttttagaattccaattgtttcgggttttaggaaattattaaggtgaatctctgaggtttgggctgcacatcacagtcacacacactaacatttcttcaatgacacacgacaattcagactaagctggatgaatgaagaccataaactgcctcgcagttcagggcagcttccactcaccaccagcccctccatgaattaggtaaaaacactcacttttcagagtttgggggacttcaggttgggaatgagctggtgtagaactggatacataagtcatctctcaaaatatcttatatttaaatccatcagcttaaaagtccttcccactaagtctcaaaatcttcactctgattctcagaaggggcagaaaagaacagtgatcagaagaggagaggagcatgaaacagttgatggccagagagagcccagtgggcctccccgggagccatgatgtgtagtgtgtgcatgggcggtggggatgtgtaggcataaaaccacaggataggtcagacatgacccaggaagactcttaacaaagcctcaggtgtaacagcaggggcaggctgggcaggggtggccctcagtacagttgcatttggcctcagatttgtgactaagagaagcataatatgaggcaaaacctcagcatcctcctctacagcaggagagctggactacaacagcaatttcagatggcaggcctcaaccccctggttgaccaggaaatctatgtaacaggttataagcaattattttttaagaaaatggaatggaatggaatggaatggaatggaatggaatagaatagaatagaatagaatagaatagaatagaatagaatagaatagaatagaatagaatagaatagaatagaatagaataggtctgtacctcgctcaacagggacagaagcttctgtactcaggacccttccagactcaccctgtatacctgtccacctgcctgttcatttatatcctttataatactctttttttttttttttttctgagacagggtctcactctgtcacccaggctggagtgcagtgacacaatctcagctcactgcaacttccgcctcccaggctcaagtgattctcccacgtcagcctcccgagtagttaggactacatgcgtgtgccaatgccaggctaatttttgtatttttagtagagacagggtttcaccatgttggccaggctggtctcgaactcctggcctgaagcgatccacccatcttggcctccaaaagtgctgggattacaggcatgagccactgtacccagacctatcctttgtaacattctttataatgaaaagattatgtcaagctgcatctcatgtggtaaggacagccattgtttcaggaacttttctttctataagatatatatattaatatctatgcgtgtgtatatatatatatatataaaatctagcagaatgtatccacatgtatatataacacatagatataatacacatgtatatacacaatgtatgctttgcacacacaatgtgtgctttaactgtgggatgtggtctaaaaaatttaggatttactgtgctagatgactgcctctgaatctttttaacacaaacatcctgtggattgttttttctggtgttactgaatccaggcattctgtattaaaatcatcccagactgaaaatcaaaaagaagtctcgttaaattctctctttttcaggatgtactttagccactgggacctgacttctaaggtctctgccactcactcattatgaccactagggcatttatctaatctctgagcctttagttccttatttctgaaatgcagaggctgaccatcacagacctctgaagagcaactgctcacataaaattggagaaatgacgactcctagctcatagaatggtcgtgaggatcacatgaggtcatactttgaatggtgcacccaacacactgtaagtgccatataattttgcctctaagacaagactatgaatgctttccatgtctggtgcttcatgatgcttttgaatccagtattcattttgcacatgcagcctgcttggagtgggagctgatggctttcaggaggccccagggcctgaccactgcaggggctgggaccacagatcgtaccaccaccctttgttcctgcctcctcctagcccttgggaggcaaagcttgtcccctcaataaatgatgaccagaaccctgtgtttgttgcccagcctcctgggagatgggcagtggcatagcaaagggattactttgggtaaatatttctctaaacctcattcttgcctccaccagtgcccagaacgagccggccagctccccaacagccccaccgttccaatgctaggacagtgctgacagcatcagctccctgaatacagggcaaatgacctcactaaaggtaagccccagaattaagcagtggtggcagaggctgggaagcacaagaggaggagaatgcatgaactgttctctcaaggcactagcgatttccttttccagagcaggttatcgtctttacagcacttagtacttggaccaaacagccaccacattgcaattccacctgaggccatggcgggcatccaatcctgcctcctccaaaacgggaatcttggctgcacctttctggacagatggaagcccactttctggtgtgccttccagaacccagggagctaagtcttaatgctccccaaggcaccttcccatcactggcaggcaaacagaggttagtctacccaactgatagctgagaacgctgagatttagttcacaggcctaaaatgctggttcgcaatattggctgcacattaggatcacccggggagcatctgaagttcccagagtccctgccatacccagaggctattcggatttgttccaagcatttgctttatctccccaggagtttccaacgtgcaggtgctctggctcttggttatcgatctcactggtgcctcagagccactggaaggccagttaaaatagagccctgggccccacccccagaggggagtccctgacttgggggttgggcctctgaatttccatttccaacaagctcccaggtgaggctgatgctactggtccagagaggaaactagagctttgagatccagtgctcaaggcccatgtttctagccttaggcttctcagccatggattggggagaatggctcctggcttgagaagctctgttctagaatagcactcctcagtcttctgtgtgcacatccggacgcatctagattcatgcccaggaggtttgggtggaacctgtgctgctgatcctctaaccaccgtctgaggaacaaggccctagactagcaggcctgactgccaaatctacattcttcccacttcaagcaggtctagggccaggcaactcgcccttccctaacagagatctgcctccttgaaacctccactctgagagacttgctctgagccacaggacaaagaaaaagacttcctctcccagaaaggcacccaggtatcctgtccccacctctacctcttagcctctctttctccctacgaaacaatcccccatcctttaactcctcttgctatgtcacaacaaacaaaacctcagggatcttggaagcaggcggactctcggcctctcccagcacttgatggggcagtactacgtgacatttaagtcccctccactggagacgtgcttcctaagtgtccaccacatgctgcatatggtcctcagggcttgggacccagctggggcacaatgacagaaacacaggaagcacacagccgtgcaagaaagctcaccatgggattctaaaaggagtgacgctaacagctggaacaagaagactgcaaaggaagaagatccagttcccatctgcaggccaggggtctcaggactgctagccttctgccctctaagccactggtcccattctctagcctagagagctacaggatatcaagcctcgagatgctggtaacctgtccaagtcatttaacgggaggaggaaggacgacaatggcttacactgtttcccatgcaccatgtgttaggcactgtgtgaaatgctctgcaagtattatttcattcaattctcactgaaatcccatgaaatgctcattgctatggcaccacagtttaacaggaaagaatggagaagaatggagaattacagatgtgaagtagcatgccaaacaggaggtaacagcagtaactgaccccatgttgacgagcctacacactctctttttttttctttcctcggctcactgcaacctctgcctcccgggttcaagcaattctctgcctcagcctcccgagtggctgggattacaggcgcccaccaccatgcccggctaatttttttgtatttttagtagagacgggggtttcaccatcttggccaggctggtcttgaactcctgaccttgtgatccactcgcctcggcctcccaaagtgctgggattgcaggcgtgagccaccacgcccggctcacactctcttaactgccatgtagttgaagcagttaacttgccttaactgcctaaagatgaggcacttaacttgcctcatcaaggaccgggagagaccgagactcagcctccttccaagatccaggtttctatgcaagatggtcccgtcctcaggccatttcatatggtaataaataacatcaagcaatataattgcacttaatacaccaggcaactctaaactacatgtgtatacacatatatacacacatacgtaacttatgtatagataaaaacatacactcattccatcctcacaacagccttctttgtaaatatctagatttccattgtgcagatgggaaaactaaaggacaaagagcttgggtaactagggtctcccagctagttggtggtgaagccagaatttgaactctgacagtctggtttccaggttgtgctggtgacatccccctgccccctccacagttcacattggctttggtgcctaaactgaataaagagcacagttcaaggtgctttctgtgcccacattgcacccagtccagtggccaaatcctctgcaggtaccttgataaacatccagtaaggaccaaacaggtgcctcctgccctatttatagctcccagcatggccagctagctataattagcaaagctcccctaggactggagctaaattaaactggtgggattagaggccagcagcttcggacagtgcctctggacacctccagcaacacaccactggtgatactaagagaagcctcttcaaagaagtagtttggcctcaccagtgggcctttctcctgagtggtgtgtggacccaaggggttcctttaatggcctcctcccaattctagtggctgatctgtcctgagatcccccaattaaatcagaagaagatgagtgatctcatgctctaagggtcagaaaaccagaactctggtcccggctgtgccgctgatcagcccggtggccaagggactcaactgctctgggtttcagctttgcttcttgagatgaagacaggcctatctctgaagtccttcttggccggaaaatcccagacatctcacagatctcaaaaaggggcttccagttaagtcctgtggtagggatcaaatgccctctagagaagggtctgagggaagcctgcagcccccaacgagggaggaggactctgacttgaaagtctggtgtaaactcttaggctgctggtgctgtgagcctggaagaagagaagtgacaacctctcaccacctcctggagcctgaagaggacaaagaaagagatctcatcttccctctcgctccagagtatccagccgccaagggctctgcctctctcgggactcagatgtcacctcctcagaggccttcctgggttccttatctagaaaatccacctgccaccacttcctagccactggccagggcactcccaagacatggactctcatcccctatatatttgttaaaatgtgcattaactgtctgtatctcccactgggatgtgagccccacagaggcagggcctgcatctgtgctcttcacatctagagcacctggcatataccaggcactgggtctgctgactcagtgagccattttggccccaggcctcctttctctgtgctgagcgcccagctgccaacctcccggagtcgttgggcttctgtttttcctgtccaaacagggagggagccactaaaccaaacaggatgaaagggaaagaggggaggtcaggaagccttcttggagaaggggatttcttcaaggatgagtcagtgatgtctagccaaggaagcagcaaggatggagagaagagaaggggcaaagcacagaggtggaaatggcccatgcagggcatctgccggcagctgggagttgctaagagcatggaaggttatcaaagcaggagggatcagggaggcaggggtgtcagtgacaaatggccacaggtgtgtgcgaagaagcctgaattttatcctacagctcaggtgtgggcaaacttctctgtaacaagctgtcaatctgtcacaattactcaactctgccacggtaagcttgaaagcagccataaaagatacatcagtgaatgcagatggctctttcccaataaaactttatttatagatatttgaatctgaatatcttatcatgttcatatgtcgaaaatataatgtgtctattgtttttttcaaccatttaaagagatagaacccatccttagctcatggactatacaaaaagaagtggccggtagactcctgctgtgggcaatggggaagttttgggaggttttaagaaaaagaaagacaagatctgggttacgtcttcaagaggcctctctggtggccagtaaagaacggaccagtgaaggtgttattccagaggctgggagaccctcaggaggcccttgtgatggtttaggtggaagacagaagggatcccagcaaaggaaatgagtcacagaagctcccctagaaagtgatttccatctgacccattggggcagtgaggcaggtgtccccggatgtttcttccatgaacagcaattgaattgaatgccaaatttgaatttggataacagcctctcgtcctagcaaaccagattaatactaatcactttccctccccacacatatccagctaactttccataaaatgctatccttaataaatccagaaaacaaacaaaaaccttcaatgtctacaataagattatagtatatatataagaaatgtctggccgagcaccgtggctcatgcctgtaatcccagcactttgggaggccgaggcgggcagatcacgaggtctggagatcgagaccatcttggctaacatagtgaaaccccgtctccactaaaaatacaaaaaattagccgggcgtggtggcgggcgcctgtagtcccagctacttgggaggctgaggcagaagaatggtgtgaacccaggaggtggagcttgcagtgagccgagatggcgccactgcactccagcctggacaacagagggagactccatctcaaaaaaaaaaaaaaaaagaaatgtctttattttcagaaatgcaaactaaaatctctagggatgaaatcctgtgatattggtaactgactttcaacatatttcagcaaataaaaaatgaacgcatcaaaaacagctccaatctctactgccttcctcctggcccatgacttgggaaatgcagggcagggtcagcctgccccaggatcccacacacacttctaggaggtaggtgtctctggatccatgtggcctgtgcatgtgatgaggggcctcttgctcctgcagaagagccatctgtgctttgcaaaagaggtcagagtcccaagccatagcagccaagggcagagaccaaagtccagacctgttcctgaagctaaaccactgttgcaggtacctttgctctccgtgatcttttgccaatgacccaaaaagaagctgtgaatttctgaccctgcactcataaatgctggtgtccatcaagcccttaccatgtggcccaatactttatatgcattattatctttcctaaacttcacaacaagcctatgggaaatatactattttctccactttgcagatgaggaaactgaggcttagagtacaacctgtgccatcatacaggtccccacacctgggaagaatccatgcttggcttaatgctctgctatcaccatcataaaattcttcatacattttataggaaccctacattcgcattctgcacaggaccctgcaagttacatagccaatctcactcaggtctcacggctcactggtggtgacatcaggggtaatgcaggcagtaggactccagcacctgcctgccatccatgacagtgttagaaatttcatgtaagtggctatttgattccaggctgctaaaagccaaagccaggacagacaccaggctctgtttgatacccaattctcaacacttttttttttttgagacagagtctcgctctgtcacccaggcagagtgcagtggcgtgatctcggctcactgtaacctctgcctcccgggttcacggcattctcctgcctcagcctcagtagctgggactacaggtgcccgccaccacgcctgtttaattttttgtatttttagtagagatggggtttcaccgtgttagccaggatggtctcgatctcctgacctagtgatccacccacctcagcctcccaaagtgctgggattacaggcgtgagccaccacacccagccccaattctggactcttaactcaggcaggacaaacagttggtggcctgggcccacccaactgccgtgctcagttgccttactccctccactctcagcctccttgagaagcacctttcctctctcggccacttctgtttcctccacagtgaccttggaacggtgactaggagtgctgcaggtggtggccttagaaggacaggggccagcccagtcccactctccggctgtcactgaagaagcacatgctcctcaatggaggaagacagcttcaaagagcatctgagttttaggaagggtaggagacagctggaacagaggccgattctgccagctgtcatcggtctctgatctcctggcaagaaagctggccatagagtaaaacctctttttaaaaattcagcaaaccaggagacataccctcagggtgtagctctgaggttccaatatacatattttcccagggctgagaagactggaaatttctccagcaagatcaaatgcaatgcatctcaacccagacccaccagggcaaaagcagaatctgtccccgaaggtcaacgacatcatcactgacattgagtctagctcaggctctggagctggtctgcctgggcttgaatcctagctctgatgctcgctagctgattggccttggcaagttatttaacctcttcatatctttgtttcttcctctgtaaaacagaaataatgatgcctgcatcagggttattatgaggcataaacaacttaatatatgtggaagaggagcttaataattgctagtgattaaagttgatatcatcattttcaagctctgcttagggacctgaagaaatgctcattccctacctaatgcaagcggggcttaaaacctagatgacgggttgatgggtgcagcaaaccaccatggcacgtgtatacctatgtaacaaacctgcatgttctgcacctgtatcccagaacttaaagtaaaatttttaaaaaatgttcattcccccggaagtagccccaaccttgccatgccctaaatccgctgctctaaaatccctaacacaagcaagaagtattgcctcttcttgaccaactgcaaggaagtgcctgcttctccaggacacctacaagggcagctcacagagccatgcccctcgggggacttcttgaccttggtggtggaggccttggcagacgctcaggtgtttggttccatatttgcttccagataagactgtttagtagacatgcaactgcttagctatgccccaaggcatggggcaagccaccagccagggagggcccacttcctctgactcatctgcacacatgacaggccaccagccccatccgccaatagcaaggcaaagctgactcaggcaacatgagattacgagagcatctccctcccctcctacttcagtccacagcaatctgtgcctccaaccttctttgtgctacaaagataactcactggtccaggattatcatggtacctctgtgacaggctcatcagcagggctgctcttgccaatctcttactgctcagagcctggcccttgtagctctgcctgctcttccctggtcctgaaccttgcttctgctccttggactcccaggttgggcttcttcctggtcagtcttatgcaggtctgaccacaactagtcccactatgaagcccatcagaaatgaggtcaatgcatcactggcccagtttcacagaaagatggacgggggcacaaatggctgctggaatccaggtcctgacaaatagagacttgatagagcatggttgaatatttctcacatagggacacaagtccagaaggcatatggcatctctgagtactggatgtcataccaggagagtctcatctcaaaaggaggtgatgatcatgtatttggccttcaaagcccatgctgctataattttctaagatctgaaatctgagtaatacaacagcagtcagcttcatgaccaagagcccatccttgagggaaactgactcttcctcctctgatgagtgacttgactttccaggcaagtaaagcaggattgagcttactcctgggtctcagggttgcctccctggcctggggcagagcagatgaagaggaagtgggtgttgattcttagtggtttggggcttcaaccttgtcacctacctttcaggcctagcctcagtcctgactcaacaggagaggccaacacacccaactccacttcctaaaggctttggtgcccaaccccaagtcctgatcactactcaggaaggaaatacaaggaaatgccttccaggtaggaaaggaggtataaccatatgtagataaaaaaggaactttccatttctgtaaattgaagtcttattcacacaagagacagattgcagggggctggatttatggggtaagatgattaaattctgtgtcctctttcatatgtcatgctttatcacgcattactaaggatctgatttggtggcaatttgttgatttcttcagttcttagctcagttacaaaaacgcagtgagcaggacttgggtaccctgccagtcagctccttagggtcagagaaacaccgtcagtccacagtgctttataaccacccaaccaccttagacggggccttggtattcactacccactcgtcctcccctagcaacaagcaccaacaatccaacatatacgtaagacttgtgggaagcccttatttgtctttatagccacagaatgtggtacatttaagttgttccataaatgtttttgtttttgttttgagactaagtctcgctctgttgccaggctggagtgcactggcgcaatctcggctcactgcaacccctgcctcccaggttcaagcaattctcctgcctcagcctccagagtagctgggactacaggtgcatgccaccacgcccagctaatttttgtatttttagtagagacagggagggtttcaccatgttagccagggtggtctcgatctcttgacttcatgatctgcctgcctcagcctcccaaagtgctgggattacaggcataagccaccacgcctggccttgttccataaatgtttttaaagaagaacatgctccctgaaatccagcccatacgccattcagtctctgactctgtctctgacagagacactcaagagtgagctgggagaaggcctggctgtctgacatcacctaggaggctgaggtctgacccagtcttccagaccctaagaagtctcacagagaacccagcactcggctgcacttaaggcttccacagcacgctgttccagcatcacctccagctccctatgggaagcccacacacctggccaagggacactggagcatgcactccctgcacagtcctctcagccactctagccctttgctcacgttcttctctgaccccagaacaacctccctacccttctccaagctgtccctcaaaacccattgatcacttaagaatctccatagcagatcttttgtacttggcatactgaactctgaccacatgctgggcagtttgctggatgacaggagtaccaagaggacgaaaacacatgcctgctctcaggccactcagactatcgggggaggtgaacagaggaacaaatggctgcaactcctgcacagtcagactggctggggtgagtctcagccccacaacgcactagccgggtgacctgaagcaagtcgcttaacttaaaatgtctgtttcctcttctctcatatgaggacaagcatggtactgatttcaccaggccgttgtcgcagttgtatgaattaatataattaaagacaacatttattttactcaaaaattactggagtaagaggagtgaaggtaatgcacaagctatattacttggttttgtaccaagctcttatcagattgctttcactagattggtgccctgtgcacatggcaggccctcaagaaatgtttgtaacccttccttgaacatgctctgcactttacccagcttttctgttctcatcacctcttcaacattgtttgtataaaaattatgtattctgcaaggatgagatcagatgccacctcccctaattaggtttacatgcttcatgattcccagacgaacaacttccctgtcttgtttttggatttctcaggcatctaaaaacaggtcctcaccaccttcagttatacccatccatataggtatactatatgctcctatcagaccacagctccttgaagacaaatactgagattcatgcattgttatttggggccaaggctctagcgacagaacaattaaaaagcagtgctatttctgtaggggagcactccaaaactcctttccaaaacctttttctcataagcccatgagccagaatggctttccagaacctcatttttatcaaaaatagaaaccaatctgaccacgcacactttatatcagagtgaaatggaacatcccaaacttttatcaacatgcattttctgttcccggtatataataaagggtcccaatgtttatctaacatttttctgaaatcagtatgtaacactctccacttctgaatctgatggggcaccagtcagtttcatagtcatcactggagagactctgtgccagattttgtcttcagttgtaacacaggatcacatggtcactctactgagctattcccacccacactcttggttctagggatgatgaagggaaaaacaaaatggttctagcacctggatgcagaccgttgcatgttcgacgtccttttcttgtgctccatatgaaacatgtcccagatccttcacgagcaaccctccactgttcagtttcataggagcgcagaaaacaagtccagtttcaagtaggtagtaatttctgtttcatttcatgaacaaaatagagatgcagcaataaattacatgatttgagccctcattagtagacagtaaatgtcactgtttattaaaaagctaataatccattcaattttttaaattaagcaataagactctaatataataaatttgaataattaagcctaatattaatggagtgaaaacatgagggaagaaagaagttctaaaatctttatttttccctccacataaaacatgttaataatgatcccacaggtgaaagaagtttctatgtgcataccagtggagtacttatttgtcaaagcaagaactcacacgtatgcttagatggctggaaatctctagggaagtacagagaactctcctaactcagccctcactattgactcctagctctatttttacctgatctgtttttattgctggactccactctctttccattacatacagcctaagaattttctactccagctagaaagagctctgactaggacacaagtttacaaccaggatggttggtctgtacgtgctgtcttctccctgctcaataaaaggagagcatccttgtgttagaaatagcttggtatctgcggccataccaccctggacacacctgatcttgtctgatcttggcagctaagcagggtctggcccagttaatacttggatggaagaaacaactttgcacaacagttctaaacaaagcacagtttgaacttattcttcctgccacacagccttcccaccacgtgaggccgtagcatcatctctgcttggaaactctacaccaagattgcaccatcacgccctgaagaaggcaagaagccttttctcaggccactgaatataggcttatgtaaacaggcagtataactcagtaggcggagatgaaacatttgcacttctctccaagcattataatgagaaagcaaaactctttatacaagctaaacccttttctacattcttaagtgtccaaacaaacttttccccagcagcctgcacttctatggctttgcattattgggataagccaagagggagggaacaggagcctttcctcctaagctcagagagatcaaagaaaacaaagctagagagtgtgagggattctgcttggtgagcatttctcagcagagtggactttctgtgtctgggctgcgggcccctgagtgtccggtgctctgaggacaccttcagtggaatctgtggaaggtacacatcagatctgctcccagtaataatgccctgctttgcagaggctgttttgctttcccaggtgctttcatgtcttttattgatcaacaagcaaacacttactgagcgcctatcagatgcagggccccaggtggagttatctcaccgacagatcatctcacggccccagtcttcagatatatgtgccactctgaaaagaaaataaggcccagatctgccttcaagatgtttatagtttatttggagacataagcagagtcccacagaaagagaaataatactgcaaagcactctattttaagttagtcttcctcaaactttgatcataatcacaaccacattaggagcttattaaaagtcaaaggggcctggatcacatctttggagattctaattccatgggaatgaagcctgggtccctgtatttttaacaagcagccacaaagattaaaaatttaaaacctaagacagtgcctaagtggcaaatgagacagtcactcctgttggccgaggtcaaaggactccagcaaggtcagacataaaagagacctgcaagggcagacaggaggctgagagcagaaaggcagaaaggggcaaggtaggaagttaggagggagagggggatagggtcccaagaacaagtgcaatattcatgtaggggacagaatgcagaaaattctggatgtaggagaaggctgccctagaggattgagagatcaagacagacaggtaggtctggagtccagggccgtgggactgcagtctgggccctgatattttatcatatcaaagtaaggaggatcatgaatgacaggtgtttactttagcctggaggcaaagggtgcctcaggaatggcagggccatgagagcagagaattttagacagaggtcccgtgctaggcctggattgaaaccatcaggaagaccggaagctgggcccaaggttctagtaagatattttaatatcctgttctaccctcaccacagatcaacgaactcagcaagatagataatattatcttctttctgtagagagaaaactggagcacaaagtggccaaacagcaagaggaaacctggggaagccagaacagccatgtggctggcgctcatctttgacaaatcaatccactgcatttcaagcctattcaacatacatttattgagtgcctactaccagcaagaaacaagaagcagcaagataaacggagtgccgttcctgccctcagggagctcacctcccaggggaggagctggcaaacattttctgtgaagaaccggatagtgaatacttcagactgtgcaggccagttagtctctgtagcaaatgctcacctctgacatagcacaaaagtggccatgcacaatacacgaacaaatgagcatatctgtgttccaataaaactttatttacaaaacatgcagtgggccggattcgacctgtaatgtaccaatccctaatctagtgggtaaaacaaaccccttcatggctacttataaaacaagagaggtgtgttataaataaaacgactttgcagcccaaaggaaagatagagtaatttagtctggccatggatgactggggaggcagcactggagtaggacaagtacttagttttctaggtctcagttaaaacgatggggctgaatcagaagcacatggacggcccttcttgttcccgtgttctctgacttggatgtggtgctcctttcctgcccagagtcttccaactgcacaaacaacgtggcctctcccaagctccctgggcctctcctcacctctaccatcaagttttgaatgtcaattaaggaataaaaattcctaaatgatcctggaaggctgaacacacacacacacacgcacaaagtgtgtgtacatcctactgtgtccggaattggtgggttcttggtctgacttcaagaatgaagccgcagaccctcgcggtgagtgttacagctcttaaggtggcgcgtctggagtttgttccttctgatgttcggatgtgttcggagtttcttccttctggtgggttcatggtctcgctggctcaggcaggagtgaagctgcagaccttcgcggtgttacagctcataaaggcagcgtgggcccaaagagtgagcagcagcaggatttatcgcaaagagggaaagaacaaagcttccacagtgtggaaggggacccgggttgccactgctggctgcggcagcctgctttcattctcttatctggccccacccacatcttgctgattggtccattttacagagagccaagtggtctcttttgacagggtgctgattggtgcgttcacaatccctgagctagacacaaaggttctctaagtccccaccagagtagctagatacagagtgtccactggtgcattcacaaaccctgagctagacacagggtgctgattggtgtgtttacaaaccttgagctagatacagagtgccgactggtgtatttacaatctcttagctagacataaaggttttccaagtccccaccagactcaggagcccagctggcttcacccagtggatcccgcaccggggccgcaggtggagctgcctgccagtcccgcgccgtgcgcccgcactcctcagcccttgggtggtcgatgggactgggcgccgtggagcagggggcggcgctcctcggggaggctcgggcagcacaggagcccacggaggggcagggaggctcaggcatggcgggctgcaggtcctgagccctgccctgcgggaaggcagctaaggcccggtgagaaattgagcacagcagctgctggcccaagtgctaagcccgctgagcccacacccacccggaactcgcgctggcccgcaagcaccgctggcagcccctgttcccgcccgcgcctctccctccacacctccccgcaagctgagggagccggctccggccttggccaccccagaaaggggctcccacagtgcagcagcggtctgaagggctcctcaagtgccgccaaagtgggagcccaggcagaagaggcgcccagagcgagcgagggctgtgaggactgccagcacgctgtcacctctcactaccaccgccagatgctaagtctaaatttatttaaatttctaaaggttttctccctccttcccagaacctctccctcctgaaaaaggtccagctgcttctgtaccagacactctagcgagactcaaatgttcttcctgaccaaatgcccacctcaagaagaacctggagccaggaagaaaccaagggtggccacacacctcatctgccctgctgtgctggtgccaggcgagaaaacagaaatagagccacggagctcaacagcaacacctcatatggtgccagcagacagcgagcaaggcccaggcagataaacacattaaggcaggctgtgcagcgcaggccacgtccaggcctcagagggacttcatctcagccagccaaggtcaactccattctaaggcttagtcagcctcctcctctgggggctcagactcccctggccaagatcactcatgtaccaagaggattggacaaggccacgagtgaggccaggtgccagcagggcaaaggcaggcaaaaggcaccacagatcgcatgtggtggcagcaagccagctgtgtatagattcaagcctcagacccacctctgaaaatcctaccctactcaagcctgaccacctcctccaggaagccctcctggctcttgctaattagcagtaaattgtgtgttctcttaacatctagagtaatacttctcaacatagggttgcgagaccagcatcatcaataagcaccacctgggaagttgctggaactgctgttggaagttctcaggccccacccaggccaagcaacttagaaactctgagggtgggacccagcaattggtgttttaataatgtcctcctagtgattctaaagcaggctgtggtttgggagccactaatccaaagtctagattctaaaccactaactggacacctgtgttttacatgcaatccctgtgctcctggcttccctgggaatgtggttgcatttcagagcctggatcgcacatgcccatcaatcccccaccttgcccagcccaggatgccacagcaagtacttcctcagcaaacacctgtggaatttaattagcttgagttcagataccaccatcaggttacaaaatcacagaacctgaatgctgaaagaggctttagtgcccatccagcccaactgcccatcaaggctctgccaggacccagcttctccacgtttctctcaggtcaggtcagatgctccactaatgcctgggagttcagtctcattcgttcgcccagcaaatattgactgagcatgggtgcgaggcacacacagatgttcctgcacacaagtgaacgagaccaatgagaatccttgctcggagggagcagatattccagtggcaggagagacccaatcaatagcaataaataaataaaacaaaaaaaaacccatatgctttaaccattagaaaacatcagacacaccaaaatatacagaccgcctatgaaaataactaaccagcactcttcaccaatgtcaaagtcatgaaaggtaaggaaagacgagtcacaaaagcacactaaggagacatggtgggtacatgcaatgtgggaccctggactggatcctggaaaagaaaaacagcatcagtgggaaaagtgatgatatttgaggaaggcttaaagtttgacatgcagttttagaccaacatgaaacttgttcttttctatagtgatgtaagatgtgaacaattacgggaaactggctaacaggtagacaggaattctctgtactaatttgcaaattttctgtataatattttgatggcaaatccagttgggaaagatggtccaaataagaggtgaggtgcagttggcatccttaaatagagaagtgacatgtgggcaagatgacatttgggcaagacccagaggcaggaaaggggccaaccagtggcactgtgaatgacatgaggccaaactcagtcttgccaggatgtttacccgtttgtgcttgttcttctatccagatgaattctgaccacgctttgaacacttacaataatgctggaggaccctcagtcttctctttagaggaggcctcacagtcctgcagctgtgcccactgagtgtgccccggcagcctgagcccctggagtggacagtaagagagagcgcacaaaggcagtggggtccaataaagaccaaggttgagaccaggagcacctccaccttctttgttctggaattgccctggtctctttttcttgccagcaaaccactttagttcctactttctcctctctttgaccctgtgcccaagcttctcagcatgtgagcttctcctctaagcactgtccacatgcgcccagaaccttgagcagtggagctcagagcagggttgacgtgagtaagcagacatgagtcaggctgagactccacctaatgactaaggatcaacgtcccacccaaagttcccatgtctagcccttcagaaaggacagggaaccataatccaaagtaaaacagcctactccctaggaatgacagcccacagtcctgagttctagggacctcaaataagtctctcccttccaggcgccaggtcaccatctataaagcgatacatttggattagttaatcctcaagatgctttccagttctaacactgcataatcagtaatgtatcaaatgaaattgtgcaaggtaattgcagctttgaagtacaatgtggggtagtaatggtagcagtgatgagatctatgggctcctaccccaagtgaatcaccagaattggaaatggtaattgttactattaatataataatgtcttaaattgcagagtgcttttccatttacaaagcatttttatacacattatcttgtgtgatcctcataagaacccagtgaaagtggtaggaaaaatgttatttctttggcatagatgaggaaacaaagttcagtggccattcaattaggagtgacggtgctcagccctgagcgtaggactcaatgcctcatcttctttctgctgcttggtgctgtctttgctactccaacaacctgtgcaaccatctgtgattttgtctctctagtttttgaccaggttagttcaaggcatctgcacaataaggaaacccaggcattcccctggaggggaaagcatccaaattgtgcccagagctgccttggctcggtccatccattgggctcctgggagcacagtcctcgccaggaggggaggtagcagtattctccatttgtctccctgcagctcaaaatagaacagatgatgtatcacagctgatctcactgcagcatcagatgttttaaaataattaaataaagagaaatgggagtgtgaagaaaaaggccccaatttttcaacgctagtgtcccatgaaagtgaaaagaaagggacaatggtcaaagtcaaggtgagggggcagctcccccagaggtgccaggtttacagccgttctgtccctgccatccaagctttcctaccagtagcaatactgtcacccctcaccattcggttgcaatttgcaaaaggcaagagacaacttcctttcttgccacactctaggatagaagaagcactccagccagccaccaatttcccctcgctaagcagcccttttctcccatgcccactacatgcagagggtgacccaggcacacccagagtgggtgctcttgtgtcctgtcggatggggccagtcagcatgagagctctttgttcaaaccccgtctccctaccatttgtgtccctacctaagtgcctacccttgcccacgacacttatctccctagacctcagtctccacggttctgaactgggagttagaagcactcatcttacttcctcatagggttgtcagtgctatgaggatggagtgagatcacacttgagaagacacttcaaaaacttacaagtcccacagggcactaagagaccatggttcaccaagcacctggtcaggactgataacaatggcgtatggctggcctttcccagcctccctccagttagatggactggaagatcaagttctggccagcagaatgtgggcagagtatctgctctataaagccttcacacacgatcctgctccctctttttctcctctgccagctgaagacccagaggaggattctgggtacctagaaagggcagagccacagacacaccctttgattgtgttacatggctggagttgagggttgcttgctacagcagctaggccacctggactagcaaaatgtcccagtggagtagctgcctagaaaatctcacaatgaggttgtaaattcaagtgagtggaaaaaaaggttttagtggtcgggcgcagtagctcacgcccgtaatcccagcactttgggaggccaaggcgggcagatcacgtgaggtgaggagttcgagactagcctggccaatatagtgaaaccccatctctactaaaaaatccaaaaattagccgggcatggtggtgggcgcctgtattcccagctactggggagactgcggccagagaatcacttgaacctgggaagtggaggttgcagtgagccaagatcacgccactgcactccagcctgggttacagagcaagactctgtctcaaaaaaaaaaaaaaaaaaaaaaaaaggttttagtagcaaacagtcaagtttcctcataattcttccacccagtaataggataaaaatgagaccatataaaagatgtaccccggcacatggacttcggggccccatagttctgtgacgtctgtgttcaacctgtttgtggaacagtcagtacagcacacaccaaaatgcagctcccatctagattgttgctgaggtgctcttccttttctcaaacacctattaatagatttacactcctgacaataaagaagcgcggatcaacctctaactagccagacaggctagtttttgttttgttttgttttttgagatggactctcactctgttgcccaggctggagtgcagtggcgcaatctttgcctcccaggttcaagcgattcttctcctcagcctcccaagtagctgggactacaggtgcgcgccatcatgcccggctaatttttatatttttagtagagactgggtttctgacccatattggccaggctggtctcgaactcctgacctcgtgatccatccgcctcgacctcccaaagtgctgggattacaggcgtgagccactgcccccagcccagataggttagtttatccaatcacagtatcaaatgccctcctaatgtggacaggccatgctgggccacataagagactaataagccactagaaaaaaagtgggggacaaaggacatgaaagacaattcacaaacataaaacaaatggcccccaaacatgtaatgttcacccttactcatacaaaataaatcacgtctcacccattagactggcaaaaatcaaaaagggtggcaagatctcgaattgccgaagaagcagggaaaaggcactcacttgtactatctgtggacagggacactggttcctctccagagatcaatttcataatatctatcaacttgtaaatggcaagtccctttcaattcagcaattccacttctagaaatctatccaaaagaaatcctcatacatgcataaaaagactcatacacaagattattcattgtttgaagtgcaacagatgggacatggcctaaatgtccaacagtacaaatcacacaaatacatttggctactaaacagatgaaaagtctaccccaaagtttacacgatcctgctccataacatccggagattgggggttgggggaactggcaatcaagcgcatacccacagaggttgtaccaggatttacatgcgcacaagaagggatgctatggggaagcattatccttaagatgctacgggagcacaatccaatgttcgacaaggtgtgaatctgtttccatgcagttccttggtgttgtgcttattttaaacatatggaaaattagccataatgcaaataacacagcaacagctgtgttttcatcttcttggctattttgacgtcacagccatcaaatacaagctccaaaaaagagcgaatgatattgttcccagcagcacatgccaaaaggccacacaccttcccacgggatgaaggattccagggacatctctttttataggtgtgacttcccctctttgcagagtagctatttagcaactagagggcaaagccaggcaactgagacttaggaacagaattatatcagagaaattggcgacaacctttctggagcgaaatctaacagtgtctattaatattctatatagacatacaccttttgacttaggaattccgctctctcaacaccagcatgaaaggcaacatatatgagatgtagtggagaaagaaaccataccctgacaacaacctgaaagtccatcaaaagagaatgattgaaaaaattatggtacctctataccgtgaaaattctgtaattatattttaaaatgagatctatatctacaggaagatatagatctcatctctcctgcctcaggagagatgttcaggatgaaaaacgtagttatcaacaatgtattgtatatttctaatgcatatttcaaagtagctagaagagaaagaatttcagatgtccccaacacatagaaatgataaatactcaaggtgatggataccccaaattccctgacttgatcattatacattccacacatgtaacaaatatcacacataccccataaataggtaaaatattatgtatcaataaataataataaattgaaatttaaaaagaaaagcaagaggcaggggacaagaatgtaataagatcccattttcattaaacaactgaaaagccatatacaaggctcacaaggccctacccaatctgccctcctccaattccttcccctccttctgtgacttcatttcctgcctttattcctgtcacatgctctgctctgtcccattgacaggacacatttctaggtacatcctgccccagggcctttgcacttacccttggcctcagtgctccttccccagaaagccatatggctttctcccaagttccttttggtctctgtgcaaaactgaccttctcagtgaattctaccctgatccctcctttaaaattacaaaacagggaggaactttatcctgttttatttttctccatagcacttatcattggctgcattcacttctctgtaagatatttttgttttgttttgttttcatttttattgagactgagtctcactttgccacccaggctggagtgcagtggcgcgatctcggttcactgcaacctccgcctcccaggttcaagtgattctcctgcctcagcctccccagtagctggattacaggtgtgtgccaccacacctggctaatttttgtatttttagtagagacagggtttcaccatgttggccaggctggtcttgaattcatgacctcaagtgatccgcccaccttggcctcccaaagtgctgggattacaggcatgagccactgcacccggcccactgtaaaatattttaatcccctggactgtcagctccaagagggcaagggtttttccctgtcttgttccctgtggcatccccagcacctagcacacagtaaatatccagcaaatttttgctgaatgaatggaaaacctgtttgcctatcttgacccgggcctggggaaataagtggaagggtccaccctaggccctaagcacttggccaggaaagctgcaggagaggagtgcatggcatccgagagccatcaaacagtaaataagaaagactttctttttctccatattatgattccaccagttgctgtgaacatatgctatttttataacttttgaacacacattaaataaaacaaaaaagcaaagatgtaagtcagactcagaggagcagtgtggaggggaggggagacaacgcaaagagagagggacccaggccacgccaaacaaccgcctggctctctcctccctcagaagaacccatccctgccccgcatccagtgcagcaagcgtcctgggaaggtcaggctgtggctcatgaaagacactacagagtagatgctaacccaaatccgaacactcccagactctccctcccacccagctcagctggtactagaggcagacaacgaaaagctggcagaacaagacaaatggtggagaaagtaaggtctgaagaaggtggggtgggtagaaagcagcaaaaaggaatgagggttggtccagggggccaggccccagctcagcctcctagtcactgagtcagcttgggcaagggtgctctaacctctgagcctctggttcttcctccctaaaagtcaaaataaaggtatctgccttgccccagtgggctggatgtatacgatactgctttatcatgctgtacaaatatcattagaaagagaatcagcagcgtggatgcctcactggataatgcaaaaccccgccccacacggagccttggtttcctctattgtgttttccaattatttgctgttggtctatcaaaaatgcatttaatatgcattttaatatctgacctttggccacctggctcaactctgttgcttctaataatttatacattcggagtctacgatttcctccagccagatgatggctgcaccagaaaataatgatgccttcatctcttcctttccaagacttatgtctctattggttttctcttgtggtattgcgctggctctgacctagggtgcaaggttgaataagagaggtgatagtgggcgttcttgtcttctttttaacctgaagggattgcatctcatgtctatctatcaggaataaggtttgctagagatttcagtagctatctgtcttcagattaagtaagttcccactgcgcagagttgacgatgtgtgatcatgaagcacctactggatcatattgaatgtcatttcagcaattagagagatcattacatgattgttctcctttgttttaatagaggtctgcaaaacaaggggatgcctctacccaatactgcctttcagggtcaggaggaacaaggcctgggacccggaagataatgacaccactcccacctcagccgccagcctgagcccctgatggtccgtcctcctgtgtgccacccctcctctcctcaactctgtagctctctgggccaatctccttcacctccatcctgaactctcactagtccttaaaatgccacagacttgtccctgtgtgaagtcacaagagaaagctcactgccaaccatctccatgtcacaagaagtcaccctgagcatacgctgtgggaagcaggctgatcgcatcattttttcaggatgagcagttcaggattctgatgcaaagactccacatccaccttggcacatgctaagattcacatgaagctattccaaaatggaacaacatacctaggaggcagtgagctccctgctaccaaagatgagaatgtccccatgacatttgctacagaggtatttctacaaaagatgaagagtgacccagagtcatctgtaaaatgaaggtaatcagacctatcaaaaggtaatggaggaggaggaggtggcagcctagtggggagagcaggaggtgggatggactgacattccaagcacctgacatacacctcgtcacttagtcctcacagcagcccctgtggctatcaggacacagagaagttgctacaaaacacacacacagaggccgggcacagtggcttatgcctataattccagaactttgggatgccaaggcaggtggatcacctgaggtcggcagtttgagaccagcctgaccaacatggagaaaccccatctctactaaaaatacaaaattagccgggcttggtggcacatgcctgtaatcccagctactcaggaggctgaggcaggagaatcgcttgaacccaggaggagaggttgcggtgagctgaggtcacgccattgcactgcagcctgggtgacagagcgaaactccatctcaaacacacacacacacacacatgcacacacacatatgcgcacatgcacacacacacatacacagacacaccttgttcaaggtcacatagtcagtaggtgacagcgcccaggcatgcaccaagggcttctgttccagtccttaagctcactccactccaccactccccctcccaggctccagggtatgcttgtcaaactgcctaacacagtgacagccacataatgggcacttaatgattctccccagattcagatggtcagacatccctcccactgagcaaagtcaattttctcatctgcgaagcaaaagagagacttcatcttggcccttcacaggcaggaaggtctgactgcctggcttttacggtcagcccttgccacctttgcaaaatgtattcagaaacatgatctcctttgagcttcacacctctaagaggcagggtctcggcagagaaggtcactggggctcacgtggggaaggttctgcctgaggtcccatgctgaactagcacactcacatccagggacatcagccacctttactatctccaccccaaagcctcatgagtgaaaaggacggacgatctctaagatgtcatgaaaacacggagatacaattgaacctatcttcaaacccaaatgtgtgccattgactaatgtgtgatgtccactctctaaatggtgaagtgaagaagcagtcagcataagattccgccaatcaagcacaaataacaccatcgccttagactcggaccatgtgatgacctttatacccgtggattacatattgactctcctttcataatctaggcaccaaaatatctgctggcagcttattcccatcagctgcaggacaaagtagcttctgcatttggttccaagacaggagtcagcaagacactggaggccacagtccaatcccaatggtctgtttattgtctgaggtcattaccatggtgtctcctctccccgggccctggtaagcaccaaggccactttatttgtcagtgactcaaccaggaaccacatggacttcaaggcaacctcctggccctcaaggacacagagtagctaagccaaggatacagcaaattttttggaccaagagccaaagcaggtggcgcagactctgctaatgatcagatccaggcagtacagagttctgagcaagggatatagcaggagtccagctccagctcccttgatttcgagaagagccacaccacctaagaaactcaccttgctcctcatcaaaactgccctattctaaatggcactgagaatgagactgtcctttatacttttcaccatcccagttggtgggaggggtcttttgaatgtattcccacttgtgagggacacaaaactcaccaatgcctgacagcaaaatctgggggcaggcttcccaggtctcccatgtctgccctggcactgaagcctggtttgggggagacggggatgcgcttgtgataatgccaactcttcaggttctgagcactctcatgtctgtcatagaataggataggggttcactattgtagcatgacacgggctcagaaaggccacctattgtatgagcacatttagatggaatggccacaaggggcaaatccgtacagacagacagcagttcagtagcgtctgaggctggggaaggaggggtgtggggagtgactgctcatgggtatggggtttgtttcttttaggttgatgaaaatgttctggaattaaataatagcaatgattgcacaactctctgtatatactaaaaaccactgcaaatgagtaaattttatagcatgtgagtgatacctcaataaagctcggtttttaaaatttgatggtgtagaagaatatggaggtagcacactaggaggtgcttccctgccccacaagctgtctgtcatttgtcacctgggcactgggcacatatcagtcctacctagcagcccttgcaatcctaccataggagaccagcaccccacacgggcatttgttcagccctccagcagcccctcctgccagccaaccaccctcatccctcccgtggatttcggggttctgagtaaccaaagcaagcatgggaacattctcagagcatgtccaggggacacctccgggaatatgcattcatctcagaggggagctgagtgcttatttgacaagcacaatgtaaccaagccaagaatggggaagggtatgaaacaagagaggcggccctcttccttctcagggaagccggggctggcaggaagtggggctgcaagtccaacagctgacaccatcgtctatgttcctctgagctgtgtgcaaggaagagtacagtctggggctgcaggcatgacagacttcagagggaaacaaatcaggcataaaaactgctagaggttccattagcaagacagagcaaaaaataggattcccacatcccccctggtgccctcagggctccttgtaccactaaaaataaagcaacaggcaatggtgtttttaatgccagcgttcgcaggacttcctgcagagtcaggcttgcacagcttccttcggtcccccccacccatctccaccccctcagccatggatttctgcagcaccaggggccagcaaggagcccaggactgaatgagatgcgtccatggatcatgaggctgagatagatttccctctgttgtcccacttcaaggatgcagtctggagcttgcaatccaaacagggagacaggttctgtgtcccttcaggagaacagggtctgagcatttgtgtcataagcagggaaggagagggacctcagatccagtccatgattggacacacctccctctaacctctggcatcctggcaggcatctgggaggaggagttagaagaggaaacagctggggccgtaagtcaggcgagttcacacccaaccacctgccccattacacagcagaaagcacctcccttactccttccacagcccacaccccacaacccagcccccagggctgcccagtactagctcttgacagaggactctagtctctcagatcaagaacagccctcagaaaggcaatatggctctcagtgattctaagtgcagacactggcattgggctgcctgattcaaatcctgcctctgccacttgctacatgtgtggccttagacaagttacttaacctcagttcccctacctgcaacatgaggttaatgacatttcctgcctccaggactaatgtgaattgctcacaacggtgcctgacacataaaggtgtgtgataaaggccagatattactggggaccaactaacactatctttcctagggagccactggcatctgaggctggcagccttctcttgattctccaggttgccctgtgtgcagcaggatgccaacttgtcctggccccgaggaagtgaatgctaggagttgctcctctagtctaggtgacaatcaagtcagttcagtggtagggacaggattcaaaccaagctttgtctgaccctaagcccatggctttcactaccattctacactaaactatcacctgcaaaacccacagtgggcataaaaagcctcttttgtcaaggacagtgagggacatagtaacagaaactgaaagagaagaaaaaaagaagtctcaagaaaaaacaatcagcaggcatgatatttattttagtttttaaaagttgttggccaggcacagtggctcacttctataatcccagtactttgggaggctgaggcaggaggatcacttgaggccagcagttcaagaccagcctgggcaacagaatgagacctcatttctacccccaaaaaatttacttaattaaaaaaaattagctgggcatggtggtgtgcacctatgtcgcttgaactcaggaggtggaggctacagtgagctatgattgcaccactgcactccagcctgcacaacagagcaaaaccccatcccccgccccccaaaaaaaagagttgcctaattcttcatctcaggtcccttttagaaaaacttatgtcatatcccataaaccaggctatcattccttcctaaagattagtagacctaagtaggcaactagaaaaacaacacatccgtctgaggtctcaggctcacctggaaatgcaggtcctggcctccctgcctccaccctcccccaccccttccttgtcaggcagcttgggccacccaccatatgccgctgcagcccataaagactctggaacatttcaaaggccttggcccccatcaggtgtggctccaaaaaacacagggtcacctataaaaggttgagcacaaggaaacagccataaaacccgcagtcctaacagcagacacccagtggccagaacaaagcagccagctgccgggctttccaggaaccacagagggacatccctcccaaggaccgcgcccagccgcagcccaggggcacatggctgaaaggtcctcagaggccacctggtaagaagggccctgtgttgggtgcttgctagttgccagggactgtcccggatgccctccttgaagagggttaaggaggtaacacaggaaagagctggcatggtgcctgcagccctgagggcctctaaaagagatgcttcatctttcctgagcttcaaagcacccggcaagtgggacgtgattcccatcttttaggcggcaaaactgaggccctgaggagtaacacaactaggaagtgagcttcaagccaagtctgtctgttcatctcatgctttctcgtgggttcctggagaggtcagatgatgggctgtcagtgctcaaaggggcctggagacctcccagccctctgctgggtaccctccctacacagtgcagccaggcttccaaggcagcctccctcctctgctgggacagtcgtcaggggtgtttcagaaggagcaagccccgagcagcctccccacactctggcccagttgagggaggtgacagggcgccatctcctgctccctttctggaaagctttcccacatcccaggccaggccctgcaggccctcaggctggctgatacatggcaatgacaacagaaatggctcacacttggtaggtgcttcctaactgccacatcctttacacacaactgcacaaatgctctacatcagggatgcccatgttatagaaaactaggacttatggaggatgtgcaacttccccaaggtcatgcagctatcagcagccgagctggaactgaatccatggtcctcaccatgccacgctaccctgcttctgcctgaacgcaagcaggtgcagataagccgcaacacccatgactatacccacacactaccatcttcccagccgcatggcagtgctgcggcctagacccatggctcaggctctgccatccacccttggtgcagccctccagcctcccagacacccctgcatcagcctctctctaggtaacagataatactgctgaaataccaggctggctttaagttttgggtcccactgtcccactgtcctaagtcccactctgacctgtgggactaaaaggagggatgggacaatcattgctgtacaagcagctcctccagagaaatgcccagacccagagcagcaacccctcatggccctcaaaaaggcatctttggccaggcacagtggctcacacctgtaatcccagtgctttgggaggccaagaggggacgatcgcttgaggctgggagttcaagaccccatctctacaaaataattaaaaaattagctgggcacagtagtgcgcacctgtagtcctagctacttgggaggctgatgtgggaggatcacttgagctcaggagttcaaggctgcagtaagttatgaccatgccactgcactctagcctgggcaacagagtgagactatctcttaaagaaaagaaaaaaggcaccccttcctagagtccagaaagacgtctgtatctggcagtgcccgtcttcctaagtcctttctgagggtcctgagctgaggggagccaaggatgcagcttcactccatcactgggtggtctcctctgggaacttggagtattcccttcctgcagcaggaagagccaccaagagtttatcgtgttcagtccttttagtcacctaatgcccacaggcaccttgacaccatacaaagaacccctctggggaagccaacaaccccaaaacccgtgcaacccttgcaccctctgcagccagcccttggtagtggccttactgtactctccctctccatgactcagtttgcctccaataagccctggggcctcaagttcagactcacccaactagacagaccagaagtgagcctctgccctgacatcttcaggcactcttttgtcaactactcacaaggatttatcagataggaagggaaaaggacagaaagaactgtgggataaggaaggctctgaatgtcagaaaagggtctgagtaggatgatttgagactgaagaagctacgtggtatcacttaggagcaataaaggaaagattagggcaggtgaggaggataatggacagtggagcctggccagtgccagctgacggactagaccgatcttcctacctctgcttgcaaaaggcattgcttcctgcttagcatgcctcactgattcccataaaaatggcattcatctatatgctgaggtgggctgaatcatggccctagaagatgtccacgtcctcatccctggaatctgtgactgcgaccttaactggcacaagggactctacagacataatttaattaaggaccttgagatgaagagattagcctggatcatccaggtgggccctaaatgcaatcacaaaggtccttcaaagagggaggtagagggagatttgacacagaagagaaagtaagagatgtgatgatggaaactgagatggagcaatgtgctttggatacggagcagaaagccacaagactggggatgcaggtggctactggaagctgcaaaaggcaagaaaaacgacttgcccctcagagcctccagaaggaaccagccctgcagacgctttgactttaaaagcccagggaaactgatttccgacttctcgccttcagaactgtaggagtatatttgtgttatcttaaggcactatgtttgtggtcgttacagcagcaagggaaaactgacacccacactcagccactcgagaggtcccttctcctgctcaacactgctagccattaggggttaagtaattcacaaaagagacccatccctgccttcccgtaacatattgtcatcctctttcctccatcctctttcctagggtccctgtggcctggactatgctgctttctgcctaagtcctccccgtccttccagctctcattccttccatgaagctttgttccagcctcagagtcttcaaagacaccattcctctgcacgtccccctgcacccacccctggctaatgcctcttcatcctgtagatctcatttcttttttttggagacagggtctcactctgttgcccaggtaggagtgcaatgatacaatcttggttcactgcaacctccacctcccaggctcaagcaatcatcccatctcagcctcaagagtagctgggactacggggatgtgccaccacgcctggctaattttttgtatttttcgtagagatggagttttgccatgttgcccaggctggtctcaaactcctgggctcaagcgatccacccgccttgacctctgaaagtgctggggttacagtcatgagtcaccatgccgggcctgtaggtctcatttctgcagggaagccttccctgagccccggccaaggagaggatgcacccccacacacacacgcattatagtccatagtctctcatcacactccaggctgaagtgtgcatatacgtgtgtaagaggggattatctgttcaatctagtcactgatgatggaattgctcagacctctgagggcagggaccttggttgtcctgttcaccagtgaatcaactctcagcctgttatagacacttgcattgatctccctctgcccagaactgctttatttaacatctctatcaaaaagaaccgttgcatagacatttttccaaggaaggcatacaaatggcccacaggtatataaaaaggtgctcaacatcactaatcatcagggctacacaatcaaagccacgatgagttataacctcacacctgttaaaatggctataagcaaaaaaagagagagagagagagcaagtgctggtgtgggtataaagaaaagagaaccctgttacactgttggtgggactgtaaattgataaagtcattatggaaaacagtatggaggttcctcagaaaaatcaaaaatagaactaccatatgatccagcaatctcactactggttatatatccaaaggaaatgaaatcagtacgtcaaagagatgtctgcattccaatgttcacagcagcattattcacaatagccaagaaatcgaacctatctaagtgcccaccaacggatgatggataaagaaattgtggtacatgtacacagtggaacactattcagcctttaaaaaagaaggatatcctgccatttccaacaacatggatgaacctagaggacagtatgttaagtgaaataagccagggataggaagacaaatactacgtgatctaatttatatgtggactcttaaaaagttgagctcataggagcagaaagcagaacagtggttaccaggggctgggatgggagaggaatgctggtcaaagagtacaaactttcagttaaacaggaggaataaattcaagacatctattactgtacatcatggtgataacaattaataacaatgtattgtattcttgaaaactgctaagaaaagagattttcagtgttctcaccacaaaaaataggtatatgagataatgcatacgataattagctcaattcagccattccacaatgtatacatatttcaaaacaacatgttgtatacaataaacaagtacaatttttatttatccagagaaaattttaataataagtgttcattttaaaaaaaaaaatacagccaattggcactctcaggcctgcgtcaggaacaagaggaagtcagggctcaagtttcaaaaacacagactgaaaataaagccccaaacatactcaaggatggaactccccacagcctgtcagcagtggacaaaaccttccatagcagaagctgcaagtaaaagatgtctgtgtgggaggaaccatttagaaaaagcagtaacaaggcgatgaaaacagaaacaaggcggccagtcacccaccatccccaattcgcccaaaggccaggtcaccctgttcccaccctgcaccagctgctcctctgcctgcggctttctggcccaaatcctgtgtggccctcactttctcctcagtcctgcctctgccatatgaccatctcctcctcaaaagaggcttctctggctacccaccaaagcagcccctctaacacacacaatcccatcccctgttcagtggtctcatggtgccactgtaaattatctcattcattgatttactgaagtgttgattatctgcaccccccaccacacacactgaaacccaacccagccctttctgttgcagtttcccagggcttcagacagtccttggcacatagagggtgccggagaatccagaatgaccctcactgtgcatatccatagctgccctcactgagccgcagcctcgggctgccccaaaaggtaagcggagtacaagggtggaggctctctctctctctagcacagaatctctttcttccagagtcggccagcggtgctgtctcttttctgctgggaaagataggaatggagattccttgaggtcagacacagtagatcctagtcagaaactcccattggctaagtgagagaagccagacacaaaaggccacatattgtgtgattccacttatatgaagtgtccagatcaggcacatccagagagcccacacagagtagaccagccagggactgggagcagagggaatagggagtgactgcttaatggtacaggacttccttttggagtgatgaaaatgtagataataatgatggttacacaactttgcgaataagctaaaaaactaccgaactgtatgtacactttaaaagaaggaattttatctcaattaaaaaaacaaaaaagcacttattgaaaaatgccatggagtggttagcagagcaaagctctggagtccaactgtccaggctcaattcctggcttaagccatgagctatgtgaactgagccaaattacttggcctctctgtgcctctgcttccttgtctgtaaatgggggtgataatcatgccaatttcacagggatgctatgaggattaaatgcaaccacccatgtgtaggggactttggctaactcctttccaaacttccaccttccccattccttgcagaccttgttttccatttgagatccataaggttctgaggatactgacaataatccctggcttcagccagttcagttacagcaactctcagaacctgtgctaggaatgctggtgcaaaggtgatttatttcctgacaaggttgagcagatcagcatgtgccctccagagctgcagcagccatgtgtgaacccagaggcaaaccagcctcaggacaaggccaactgtaaggagagcagattagagtgacagaaagaaactgggtccatggagacatcgttgagccaccggatcaaggctcatctgaagtcatccacctttccaactatatgagtcaatggagtccctttaatgttaagcccattgaagtgagcatttctgctacatgcaatcaaaagcttatcactgattcagctacgtaaagtccctcatacccagcccggcacatagcgagttctccattaagtgtgacttattatcatttttttttccaagcttctctgctgttccccaaggccagtgttcacccagatgtctagatacagaaactgttctactggtttatctagatccaatcctatgtccctgtaatggcaagccacagacaactttaccaaaaacccttgctgtgtgcaaaatcagtgcacacagcaagcattcatggggcgaggtactgtgtgctcagacaagactaggtacgcaggggacagcacatcagggaaggacaaggcactctgatcataagtccaaagaggagttcataatctaatcagcaaggcaagatcaaggtccacaaaacagtaaagtatatatttgactagtgacatgatttaagaaatgcaacagtgcaagctaaaggagtccagagaagaaagagatgggaatcctggtggcattctggtttctcctggctcccaatgctcccaacacatggacctaaccagatccaaaaacatcctcccaagaacatatggaggccacaggacatcagagcccagcaccagaccttgctcctgcaaatcccaaagataatgtgcacatttcacggacatggccaaagacccaggcacattctaggtcatggtcacgaaactggctgaactagtcaagaagtcctatcatcttttcttctcccaatttattttctttttccctctttttctcccaatgcagtaaaaatgtgatgcatgaaacaattattcttcagaactcaggggcaggtggggagcctcaaatctggagaaagcaaaatgtaaatgatgcaaaaagagatcaagatccatgaatattcatcttcctctcccttctggtggaaactagatttggaggggttcattgcgctccatttcctctgaattcctaggagcgcttgtggtcggcatctcctcattctgcctgaagaccacatgcaactcatagggctcttgcctccaagaacaggcggctgcacaggcgcatacattgtaccaacctgtacaccttatgtctgtgcatgccctacatgtatgttagacttcaattttaaaaaatgaaagtcaaaagactggtcaattccttctggtcctcaaggcatatttccaatgtgggggtaccttcctctcttcacttcacggtggaggatgattctctactctacctcctcacctccctgacacacctccttgccccaaaacaaaacagtgaaaatgaacaatcccctctaagccatttgcttatggaagacaaagctggagctgactcctttctggattctctctccctactccccccacccccactgagcacaggcatgcaatagatgctcaataactgtttattttgggaataaattacaaatggtatggaactatctcacacacaataagtctgtaagttcctggatgtctgagcttgtcttctacctcttgggatgcctgtgtggccctccccaaaaccccaccaccaggtgatttcttaacctctatgagtctcagctcctgaaccacacttgtccttcaggatcactgtgagaattttaccagctaagatgtaaagtggccagctcagaatgtgatatattgtaagccctcaataaatagtagctccctggacccaaccttcccccacaaccttccccagttgcagcacagagtttaaaacctcccaggagccccataaactgtggccgaccaggactgaccagcttcagctctgggtgctctgtgcctctctccaatacacacagtgcttcattaaagaactcaaagcttatctggcccaaaagcaatgcttttatctaaaatcagaccacatgggcaacaagtgaagcaggaagcctatcaaggcatttgggccaactggttttggctgccaagggagccctccttataggaggcggttcagaccgcaggccggctcacatacaacactggtgtacacggaggggttaattagcagtaaacagatgccatgattcacctctgtgctgttatttccccgtgtgcagctaaaactataatcactctgttctccgacaggatgtttgcgttcaagccaaaactgcctcctctatccaacttgctgcagttcggttcagcacagggcaatgaggaacttggctcctctcacgatagctggtggctggcctgacagaggccccttcagacagggaaggaaagaggagatggatggggtagagaagaaaaaaatgaatttgtcattttatcaaacacaggtgaaggctgtctgctggtgggaactgctcctcaacacttaacacccacagagctcacaaaataccctttcttctgaggcagtcaggcatgagaggcttcaggagccctgtgacaagtcattggcaagaaggagctggggcaaatttgcaggccaatgcctgggtcacaccctccctaccactgcccaggcctgggtgggtgtctagtctacttggagcctgggacctggtaaaggtggcctgaaaggctcaacctcagcttccagaaaaaattaaataccctgagagagccagaaaacaaagagattcagtgcccaaaatataaatgtaaccagtgtggagtattagtcaattcatcagcaagaggttactgaatgctcgtttgttcattcattcgcccaccatctaccaaatgcccaccagagacatgccacgtgtttggtgctgggaatacagaaagaaatgaagaagatgtatgtcctgtctcagtggcccacagaccagagtgtgccaaatcctgaaggatccagttaggagcttacaatctagctggaaagctaaagaagggaagcatgcggaattctccggggctcatcgccatccctcacctaaccagtgctttgtgtaagatagactcaaaggtgagcttgaataaactgacttctgctaaatgccattattctacctggatacatcacaaaaatgggagccattacctactgagtatttttcatgtgctaggtggaactttctctgtggtcttcaccctacatgtaatggaaactgaggcatgaggagggtagacaacttgcccaagaccacacaggggaggcaagagaggaacccaggtccttgcaccccaaccccatgccctttccacctcactgcatgagcagaggaaggagcccccttgtccatccctcacccagccccagctcagcttgggctcccccaagcaagcaccacatgactgacactcttggaatcctcttcataacctggcccaggtatgggacaagttgccaatgagcaacatatttgcttaaccaaatgcctgtggcagaataagcttgagataaaagggagtgtgaagtggaaagaagacccggaagtcttcatgaaggaacttggtgtacagaaagatgttttgggtgcctcagaacacataatccctgatagagaaaagagtctggagacaaataccagatgttaagcaaccttaacacaggcgcctgggctgcctcagcctatcagagtagcacaggttcctaaataggggaaagtgccaactaaaaagcccaccaggcaggagggctgggtctggagcctggcctttcttctttgttcagagcccaaaaggtgcctctggtccattcaccattcaccaggccccagagcagccccaggatcaccagatgggtccaccaggtccgtcctgctctggctaccaggcttctaagcctcttttcagaccctcagccttctgggagaaaccattccatgccctccagcactttccaccccttctgttccttttgacatcatctccaactgcctgaggctgcagaaggtgggtggtgtaggggcagaacaggcaggagcacaatcacaattcttataaaaatgcaagggactgctggagccaccagggaccctcagaatggcctcatccaatcctccgttttacaggtggcaaactgaggcctcgcccctgagttaaccctttcaatgcctgacatctcgtactgcaaaattcttcctttcctctctctccattcccctctccctcgtccttcctatagtggtataggggtgtgccgtgggtgatgagaggcagagggaagggagcatttctcaccccattttcctccaaccctactttctgcctccatctttagcactacctcactgtccgtcttggtgctcactgttggcccctggctaccctgccccttccagtggtctcctgtccctcagttcagcacaatcctggttatattgacaaaggagagggatctaaaataaaggccaacttcatcataacagggccatttattgaggacttacaagatgctaaatgctattatactcacaaaacctttacgtggctggtatttttagtattcacagtttaccaatgaagaaagtgagctttgcaaggttaagtaaattggccacaaccaccaagctaatgcaaggtagagccaggactcaaacccgcctttgaccaattccaaactaggctaagagcctcacaagactgaatttaagagaccaaaatgaacattcaaaatgttgcactgtggatgcaaagatggaaggcacagagtcctaggcttcagagatgctacattccagcagggggtggacattccacagacgtgcaatccaacctggatggactagagtggagacttaccagaaacagagtgaccaatgacctaggaggttattgtcaatgcccacattaggggaaaatgtcacagtctcccaaagatgaccaaatgaaagtaacagtaataactaacactttcctagcccttggtttgtagcaagtgctaccctcagcatttaacacatgatcctcccaacaaccccaggcagcaggaggataatgtggggtgacatctcccagcatttgaaagtcaatttgaagaccgggtgcagtggcacatgcctgtaatcccagcactttgggaggctgaggcgggtggatcacttgagatcaggagttcgagaccagcctggccaacatggtgaaaccccgtctctactaaaaatacagaaattagccggacatggtggtgcgcacctgtaatcccagctactcgggaggctgaggcaagagaatcacttgaacctgataggtggaggttgcagtgagccgagactgcaccactgcactccagtctgggcacgagagtgaagctccatctcaaaaaaaaaaaaaagccaatttgatactaggaactgtttgagggcgttttcagtattattttattcccactttccaagtgagtgaactgaggcatgcagaggtgaagtggcttgcccaagatccaaaggtcagcaagcaacacaactatgatttaagcctgagtaggctggctccagagggcatgtccctgatgaccacactgaactatctagaatgagagacgttgctcattgagacattacaattctggtccattggattttagaaaggcaaccgtattacttatgttactactcacgtttgagaccctgttttctcagcagtgaactgttgaacttactttgctgagacataaaattggacatgggtagaaggggctacagtgaagtgcatttccaaggtgaagcacatcaccacaggagtgagacaagaaacccgggaagcagcctctgtcatccatgagccttccactctcaatgctccaggcaaagagccacgccaggtaagattcaaagtgggagagggcagactgggagatgatgcattcaaatcatgagggcaggctcaggtaactactgtcaattcaccacccctgaattagggccaacgtaaaccagtgacaatctctttgaaacatgaagcagggaggcagttatgccccttagtccctttatcctgaaggtgtttaagaagctgagtagctttcaagctgcagacagggataagaagaggcagagctgaaggcactccagagcagcataggaagagggtaagagttaacaatctgaagacagaaaaccctgggttctaatgctggtactgccacttattaaggatgcctcttgggcaagtgacatcacatagccattgcaagccccagtttttgtacatctgtaaaatgggaaaaatacagatagtatctacatcataggctgatttagaggattgagataatgcatataaagtgcttgacaccatgtctgacacctagcaaatacccagtaaacattcagttttctcattgggtcatgataatggttctggcagagccagctatggacagcagaagccctcagtgtgggactcgggagccccttcagcagtccaggtgttctccaaatctatttcaatctcctgggtgcagtgctacatttcccaggatcccttgcagttaaaataccatgtgatcaagttctggccaatgaactgtgtgggtagacgtgatgtgaatgacttccataactacccctacaaaactacccctcatgatccttacttctcatcccctatcatccggacagatgcagagggtccagcagagaccttcaggggcccctagaagatttcaggtccacaagtgaaaggagccggggtctttaatgactgtctgaagtgtgtcttcactgcaccctccacacacaccatcaatggtactttgtatgagcaatacgtaaacttctgctgtattaagtcattgacatgttgacctcttgttacagaggtggcctagctgactaatacacagtttatcaaacctcaagatggactcacaggtccctgttgcctcaatgattccatcgccactgcacacaccagagtctagataccataaatatggtccaggagagaaaccagcagcgtggtgtggtaactggcaactggccaggtatggtaagcataaggtaaagcctgcagcaactcaagaaatgcagagggaagactactcgtctagaagaaacaggatggcccagcagcaatattacctgtgctcatagctactggttcttcaggagaacaggaaagagcatggtctcaaaggccaagcatatcagaggccatatctgcctgggatctacccagaaaagtgactgaactgctctgggcttcagtttccacaactgccaatcatggataacaataccctatgttctgtgacatcacactggtatcttcaaaccagccagggcaggaatatttataccataggaattgacgaacaccgtacatagggactttcttctctagaaatcccgttgttaatcacttaccagcacatccctggataaacaggagtcagctaagtggaaggggagaaggaggacaagaaaagagaagtccggcagtgtgaacagcatgtgtgaaggcccagaggtaaaaatcaaaaggtttaacgaaatgaaggaagtcctaagtggctgggtgtggagagcttgggaagatgttaagaggaacctagaaagagggcaggagctggaccttgtgaaaggacttcactaaatagtaattatttgttccagtcatccatggctatgtaacaaattaccccaaaatgtagtggcttaaaacaatcatttcattttgtttatgacttttaagtaaggaattcatagagggatcagctggtgggttcatctccaatctatgtcaactggggttggaggatccacttccatgatggcatcttcacacatatgcgtggtgccccagtagtgtctctctgtctgtctgtctctctctctctctctctctctctctctctcgtatgcccacgcacatgcttcctctcactctcgctcttccccctgtagtggccaacttccctaagaagtagcattcccagataacaaatgaactgccagggttcttccaacatagcctcagaagtcacatagcatcatttccaccacaatccatgggttacaagcaacccatggattacaggggctagctctgccccaaagggtacaacccaagaggatgaacgtgaggagtcgtggttcactgagggcctgctttgatgaccagccaccacattgagcgacccctggtcactgccctctaggaccacctgccaggcacagatccagaaagaaaccaggaccagccctgtccacaaggagctgtctgcagaggagacaggatgcctgtatagaaaatagggctgcagcatcagacggctgctccccacccaggatggaaggacaaacagagaggacgcatcagggaagggagaggcagagaaagctgactagggtaggtagagaaggcttcccaggaaggcggcattcccagcaagatgagctaagacttggaggatggaggaggtggagggttggaagggaaggagtaggccatcactggggccacccccagccttctatcacatttggatcactatggaccacgccaggtcatctccgcttttcccagcagggatgttgatcagacctgggcactctgcagtgatgatcagcagctcaagagcaagggtggctcctgaccgtgaggggtcagcaccaggcccacaagcctgtctgttgcaccagtgcccaggaggggctgtcgactgcagaactgttttctctggctcgacctcacccagaaccagcggcagaaaggccagttatgcaaccatcctcaccacagcctgccagcctcagaggctgggcctggccgccgggcctggccgccaggcctggtaaggagactgctgtggcctgcacagcacaaggccatcctgggccccaactgccactttccatgcaggtgcaagacgctctgctgacaaatacctggggaaagcaggagctgtgggagggaggtaaaaatagcacagttggcaacagagaaggcttttctaagtcctcagggtcctattagtccttgtccatgggatacacatgagctggcactgagcattctctcttctccaaggctcatgcttagaacaggcacagaggcctgggaggcctcttgtatcatgtcaggagctgcacagtgatcagaagttagggagagcgcctgttgcagaggctggatttggaggatatgctggggctgccgtcataaccccacatccccagtgggttctctctggccactccctctacggccagttctgttttctccccatttttggaaacccaaattcttgatgtttctgttattcacattgccattaagaattatgggctttgcactgtgtttttaatttgttgtgtaagggttttacacaaacacagctagatgcctagaaaagacaatgtatatgggcatgcaggctgtgcactgcacaactccagagggcttcattcatgaccaggatgtgagtggcgccctggaatcatgcaatgtggttaccggtattgccagagaggaaatgatgtcttacatgaccccatatccccgggaaaaggccagccatgctaataaagatttgctaactaaccaatttgtctcctgcttccaaatattccatgcacggggtttggcaggcacacggccacaatgcgcaatggcctagaaagagagccatattgaaatataataatgtatttccaggccacggaggtggagaggcacaaggaattgatctttctaaggcaaggaagattcataaccactgaatgagttaaccactaccttcttctgagtgtgcagattaaattctctgtcgcaccaacatccaagtgcgctaaattttaacagacctggaatttggatatatttatttctctttcacagaattcccattcttttactaacacagtttcagagtttgagatatgagcatatctcatgtgggataataaggcatcattccacaccaggttgcacaggcccatggtttaatgatgagacttcgctggtgggtgcaaactttgctggtcccccatgctctcttgaatctgtgtgcatctcacacatacgtacatgtacacacacacacacacacacacacccctctctcaagtttttaaaaacctacttaaattctgcatcctacctccaatatactctgtgtacagtgtaagtgttaataccaaaaatagtgtttttctgctgggcacagtggctcacgcctgtaattccagcactttgggggccgaggcaggtggaccacttgagctcaagagttagagaccagcctgggcaacatggcgaaactccatctccaccaaaaatacaaaaaattagccaggcatgatggtgcatgcctgtagtcacatgcctgcaagtcccagctactcaggaggctgaggtgggagattgcttgagcccaggaggtggaggttttagagaaaaatagtgtttttctccaaaacttcatggaagactgttgacactcagaaaaatgacccaatattgattctgtgcctccacataccccccagcacagagatgtggcacatgtgctgtggttcataaaatacatttatatgtcatctgatgtgaatctcatagcagtcctggagttgtacattgagtaacctgcatgactgtatatagcccactgcctgtcaggtagagaaaaggtgattatcccattttccagcaagaaaaactaagactcagggaatgtaatagaactagacaacatttaaggttccttctcatcctgggaattgacatacctgagaattcagtagtacaaaactctctgaacttgtcaagggacctcacatctctccaggaacaacacaccactcctcttttcagtcctgtctatgtcatcagagtttccctcacactgtggccaggaagagctaaggaggtataaatgaggtgtacagtgtgggattaggtgcatgggatccacagcccacctgcctggatttaaactggctctgctcctcacctgtgtgtgaccctgagcagttactcaacctctctgtgcctcagttttctaatccataagtgaggataataataccaccgaattcactgggttgttgtgaggattatataatacatatagtttaaaaacaaccagacacacagtaatcactcaaagtttgttatccaaaaaaagaaaaacattctcattctctatgcatccattttctaacctgtaaaatgggaatttaaaaggggactacatcacaggattgttttgaggattaaataacagaataaacataaggagcttaaaacaatgcttaatgcatagaagccactcaaacaagtttgttctgattttttttcccctaagaaaatagtaactccaattcccacagaaagacttcccaaaacaaaagtaccaataagtctgaaaataaatgcaagacctgaggaggaatcattgctgttttctaaaaccagtgatagacaggctatcttagagaccggaggttcttgctttacattcattttctgaggtcaggaagtaaaaaggaacatgggtgaacaggcactggtgagatgaggaagaaagaacaggaacatctcagttgctagtttctgttttcaccatgaaaatcattttaaagccctgcctagaatttaaatagcatcatccctggagatagctgttttagtttcattacagtctgtgttcgtagagtacaaatagaaaccttcgtgattttattagtttccatgcaacttaggagagatttgcatgataacatttcatctcctgactttaaaaagggaccaattaaaaatacagcacttgcattgcctgtcacgggaaaatgaaaaggttcacagagttttaaaaacctctgccatatctagtccatggtcataaatcaagtattcagtactacggtggcaatcactattgtctaaatttttagtttattttgtaagaagtacttggaacagctgggtgcagtggctcacacctgtaatcccagcactctgggaggccgaggcaggtggagtacttgagatcaggagttcaagaccagcctggccaacacggtaaaaccccatctctactaaaaatacaaaaaaaaaaaattagctgttcatgatggtgcatgtctgtaatcccagttacgtgggaggctgaggcaggagaattgcttgaacccaggagacaaaggttgaggtgagccgagatcgtgacactgcaccctagcctggacgacagaccaagactccgtctcaaaaaaaaaaaaagaaagaaagaatatttgcaggatgtttgcacccctgaaaagagttaaactatagtacagaagaaacaaaatgtacaagtaagtatttttgcctggattgcagcaagtcctacacaattaccaacaccccaaagctacctggtactctgtggatttgtgaagtgttaatgtaatgtatctgtgacaagttaaaatttaatgcatggctccggtagcataatcgaatcgatgttatgtaacctaagagaactattccagtaagttctgatgtgctggctgcttacggttcagggggagtttttttcggaggttactgagtatttaggaatcatcccttcagacacttgctcttttgccacagaagctgcagttatcttatccctgctttcggcagctggaatgctccgtggaacagggctgagatgaacgttctatctccaaggctgcgttttggggcaagttaaggaaaaggatcaaagtaagttgatttgcatgaccttctctttaatcagatgtttctttttatgttcaacctcaacaaagccagcctatcatagcacactatttatagtctataatctaagatgttctgaaccattcccccacaccaaaaattaaaattaaaacctcaatagtggtgtggctatatcattagaagtaatagtagagtcacaaaaacctatttctgagactttttttttaaatgacaggtttgatggtatttccaatggggcctgtgtccctagattgtaattcttaaatatgtcatcaaagtcaatattgaagttctggggacaagtcaatcaaatttcactcttgtgttttatagtagaacaagaacttctccctggattcactgccctcaataacttaatctttggttctttatcaggtaaaaatgatagttttaaaatctgacttaagaaatggctttatattgaaatcatgaaatcagagaatttgttatatgcatgagaaaactaaggcctggagcctatgacttgtctaagacactgtagctagtcacttgtcatatgtcaaaatcaaaaatccggcgctcccttaacttcactctaagagtagacaccattaaaccagaccccacaggcagaaagagggttgttctcttcatttgtctgctctcaatgtgggcagggcctacatcaaagtcagcctgggtgcttctagaggggctgcaatctttagaggaagaatatcagctgcccaccgagaaaacaagaacgccaccgtaaagaacatgtcagggaaggaaatgtgcccaaagataatgctggtcatctcctggagggggaatttggaggaatgtttttcccttttctcaaatgtttatttataattgtggtgaaatacacagaagacaaaaatgtaccatcttaggctgggcacagtggctcacgcctgtaatcccagcactttgggaggctgaggcgggcggatcacgagatcaggagatccagaccatggtgaaaccccgtctctactaaaaatacaaaaagttagctgggcgtggtggtgggcgcctgtagtcccagctactccggaggctgaggcaggagaatggcttgaacctgggaggcggagcttgcagtgagccgagatcatgccactgcactccagcctgggcgacagagcgagactctgccaaaaaaaaaagtaccatctcaaccatttttaagtgtgtagtacttcacacttaaaaatgtgcatgtttcacattgttgtgcatcccatctccagaactttttcatcttacaaaactgaaaccctatacccattaaacacttccctccctctggccctggaaactacccttctactttctgtttctatgagtttggcaactctatgtacctcatgtaagtggaagttatccttttgtgactggcttatttcatttggctgatgtcctcgatgttcatctatgtggtagcacgtgtcagacttgccttcctttttaaagttgaataatactctgttgtatgtacctaccacaattcgctaatctattcatctgtgaatgaacccttgaattgcttccacctttggccattgtaaataatgctgctgtgaacatgggtgtacaaatatctccttaagaccctgcttttaagttttttggatatctaaccagaagtggaattgctggattatatgataattgaatgattaatttgttttgagaaactgccatactgctttccaccgcatctgtaccactttgcattcccacaaacactgcacaagggttccaatttctccacatcctcaccaacactggtgattttctatttttttttttttacagtagccatcctaacagatgtgactgtgtcctttttgtttaatgcccctgcacggcctacgttttctacaatgaacatgtagtatatttgggattaaggacaaaatataaaatactgaagttaaaaagtaaatcctatggagaaaacagggttgtgaaagaacttaagaaatgattgggttttttttttttagactgaggcaaactgttgagccctcttgtgggctcagctagagacatcattcctatactcttcaagaatctaccacctgatcggctgtggctgccacaagccacaggagaaacggccataattcatgggcagctgaaataattcctctaagctctgggaggaaagtgttcccagatgcaggaaggagaacaacaatgtatattaagctgttgccagctaatgttggtcataaaaatccctagcacttgggtaaggcctttcatcttccaaatctttcctccaagccttagaacacttatctctgagttctccatttgaataactggaggcccatttttccccttccagagccacaaagggtccactttccaaaaccacataaagagaaaacaacgtcaatgtggcaacttctcccaaagaggagcagaattctgctcttggttaacaagcacacaaagaacatctcccacaaacccttccaacgcttcacctctgagccacacaggccgcgtgctatcagttcattccacagaatgtctcgtttgaagagctaaaattttccaaacgtgaactcattctacccactggtagaatgctttactccttggaggtgaagtcatttgacatgatttattcattaagacaaaggtgaggtaactaaaaccaaaatccatccaattagctatttatccaacctctaactctcagaggagaaattcttttttccttggtgtcaacctctccctctacctcctgccctccctcaccttcttcctttgtgtgttttgctctcttttcttttctggtttctttctgttcagcaaaataggggagatgacagcagaggcatacaggagccccagaggaaaggagacccaatgagcaggtgggaaagaaacagcctcctattctaagaagcggctgtattcaagtgatgcaaaaagaggttcaagagcactgtctgtctccctaggtgaaaaagagtcaacacctagaaaatggaatccaactcgagtttcctaacaaaggctctgtaccctacatccaaattcttggcagggcccccaaattacaacccccacgtgaaactgagaagggggctaaaccttggagatacaaggcacgtgacattgataaggaggtgaatttatggcccagcaacagtcaaaagcctccagtcacagctgctgacaagaccgaagagacctcagaaggcaaacttcaagaaacaaccagaatgggtcgttttctgaactctgggcaaaggggcaaagggaaaccacactgtctcaggaggacgaagaacccagggaagccatcagggagaaaaataaagtggccttcatggaggaaacacaagttaaggttaaggtcattctacgtctcaacactgcggacatggaaacaccacccagctctgtcccttcctgaactggatttagaatttgaaatctaccatccaccaaggcttgttctgcatgtcccagacacagactagaagcaaacaaggactagtgcaaacagaaagatctttccaagttcatcgtaaggtgggtttgtccccagtggaatagtggcctcaggagatcataaacacactggtagggtgggcttccagcactggggaggaatcgcacagggcctgaggccccaaagcttccttccaccactgtgaatttatagttccatgcgcttctgcacttgttaaatcaggtcgctatttgttgtctactaatctacaaacctgaagcccccagccagcagaggccactctcgatcccaccccccagccccagttcactcccaaagatgaagacagagaggactgtccagtctctaaaagggaagaaggagcaagaacaagacatggaaccagaaaataaaataaatactcatcttatactcccaacttgaaatgcacatacaggcagcccaacagcctgtagataatttggtttacaatgatatgcaaagatgcagacccatcgtggctgaatagtttcgtacagttagaagtgaccctggaaagaatattactgacagtcttgccttaaaaactcttttgcaaaagacatcatggtcccagacttcagcagttaacagatggaaattaacttcacttcaagtcaaaaacctaaaatctcgccgggcgcggtggctcatgcctgtaatcccagcactttgggaggccaaggcgggtggatcatttgaggtcaggagttcaagaccagcctgactgacatggtgaaatcccgtctccattaaaaatacaaaaattagccaggcatggggcatgagaacctggaatgccaggtactcaggaggcactagaaccctggagggagaggttacagtgagccgagatcatgccactgcactccagcctgccagcctgggcaacacagcaagacggtatctcaaaaaaaaaaaaaaatctaaaatcctatttttcctttttaaaaaaacaccccttccccaagtaaaagtcaactctgataatggggagatctacataatgtttaccttaattacttcttccccaaattgaagtattcctccctattgtgctagaaaccaaaattaaacagcaccaactttccacagaaaccctcaggaatgacagccactaaggaaaaaaggatgtaaaagaaaggatggagcaagaggaggagggggagaaggctggaattcaggctttcctgtgaattcgctttgaaatgcctagaggccactggatctgagtccccaagaaaatctggtagagaggccagtgaaccagcataaagaatagaaaataaaggagatgtgttaaataattttgattttggccacgtgaagaagtattagtcatacaggtaacaagatcttacagggagatgattccaaggctcggcttgacaacgttaagtgtatatccattctgggcctggagtgccaattacatttccaaattggcaattagacacaatgtcccaagacaatcaccaaataatgccaaaaacaaagcaagttccatcttaaagcagccattcttttgaaactgcccttccctcccgtgcctgactcatccacctcacaaacaactgcccattatgaactaaatccttgttagctactgatcaagagaaaccaggtggcatgaataattaaaatccacgaatgattcaagcaccatgttgtcaacaaaccaagcccatctctttcaccaggagtttctccatagcatctaacaaattacccaaaaaagcaggaaaatatatttgccacccccaaccaatgcattctcgttcagcccccagctaactactggaaagagccttccaacatctacgtgtgtttacatttgcatgactcagttcctgccctcaaggagtttgcaggcaattcagagatcagatgttcatattccatgagaagataactgttttttcctctgctcagcctgtcaagtactaataaaagccctaacaagcagggagtcagaactgggtcttaattatttttcccccagcacctagcttggtttctggcacatcgtatacacttaatatgcaacaaaagcaaaaacaacaacaataattataaccagaagacttctttgagggcctactgtgtgcaggccgccacgatgctaggtccttcttcattctgcctgctgcagacactcatggtgctcccctctgatgatgaaacaacataaaaagcacatctcatggaaaaagtccctgacagtgtgagctgtgaaaaaccctggtatggtgagaaaaggagctactttcactttcatcttctggaattcttaagaagtgcattggagggccacacagcacggtgccacgcgtgtcccccagtcactccacgggcagctcttcagccaattctttgaggttgaaccctccatttgggaaggcccacccaggcccctacagaaaatcaggctggcagtcttaatgcccactgacttcaaacactccagagggagtggtccccagccagcctggggcatcaccgcagtgcagccctggtgacaccaccagcctttaattttgcaaggaggtagtttggctgggttgccctcctggacttcgggaagtcacaccctttgcagaatgaccaactggcacgaggaagagcccacacattggtgggtaacacacagaccacaccctgtaaacactgctctggccaccacaacccaaccctaaatccacaacgctgatgggttccttaggagcaggcacctggaccatcagttttcgcaaataagagcccagcccgaaccacagctaccctggtctgaaaggagttttctccacccaacgatctggcagagcaaaccttctgcttctcatcccttcccccttcaagagctgggaatttccacatttaaaaataagcctgtcttcagggatggactgcacggaggctgagggatggaccagatccttgatactcaaagtgtggtctgcacagcatcagtatagcctgtgtctcgccagaccagcataatctcaggtcccacactggatcttctgaatcacagcctgcattttaacagctctcggtgattcctgagcatattaaagtttgactaagccaggcacagtggctcacaccactgtgggagcactttgggagaccaagatgggaagatcacttgaacccaggagttcaagacaagcctgggcaacatagggagaccccatctctgtaaaaaatttaaaacctagccaggtgtggtggcacacacccataagtcttggctacttggggagctgaggcaagaggatcacttgagcctgggaggttgaagctgcagtgagcagtgatcatgccactgtactccagcctgggcaacagagtgagaccctgtcccaaaaaaaaaaaaaaaaaaaaaaagtttgagaagcccaggcctagagacactctccagtccttggagataaagatgtgatattcccactgaacattccccaggttttctgtccaaagtgctaggacacccttgcctccgagggtccctgggtttccttttctaggtgcctaatgcgtggggttccacccacccaagaagcagttctaaaagagacatccttggtctgctccctgactgtgcacagaaaggcatggccctgtctgatccccagggatgtctccaagggacccagtgttccccacacggcccagggcctggcatcacagcacaaacagccctttcactggaaccacaaaggcgaccttccaggggatctgcagcttggcaaggtggtattggctgctgtgattcacagattagcatggtcactgccagtgtgagccgggacgcccactttgggaaggaggtcctggcattgcaatcgaatgccaatgtaactgtttctgcaccaggcctctcatgccctgatgagagagagagaaagagagagacagccccaaagcaagcacttactcctggctatcagccaccaatgaatgtccccatccagggaacaaaatagctgtgaggcaaagagaaggtccatttggacttaccattggaatgctttatcccccaggccaaacagcagggggcaggcagctcttcttttcctcctgttgtatgtttggtcaagtttcctgggcacctagaagcagggctagcccaaggctcccaaagggaggccataggttctcagtgtcctcctaggaaatgctataaaatggggttggtgaaaaaaaccaccccatgaggctgtgctctatcacagacctcaatttgcaggtgaggaaactgaggcacaaaggcatgacgtctttgcccaggatcacaggctgaaccttgggcactgcacagcacccctgacactgaagcaagactgctcacaggtagcacatttgagggcattttaaccactttctctaccagcaggatgccgccaagcctgtgatgtggccctccaaaggggaagctcagccacgccatgcctgctgattttttttcacaaggtaatttaaaaggcaggtgtgccacagaacacacttggggaaacctggcctagggggtgtcttggaaaagctggtctgggtagacagtgagtgtcctggccaagagaccgtgacatcacttgggagacaggtctatgagttctggacttgggataacagggatggaatttgtccctcctcaagggtacaatgctggacaaccatacctgcccaccaaatgccacagtgtttcccttctgccagcccagcagctcctggtcccccatactgtcgatgttcgtccactgataccccaccatcaaaactgtaaccatcctgccaggaccccatccgtgaagcctacctctgctgccctgccctaactttccagccttgcaacagccaagagccataagcccatgtctcagtctgactctaaatggttttttgatctatgacagtatacttcaggatctaaagcctccttttggctcaaaaactttatttgttatagtctgcgcccttcaggggctataagttcaatgaatcaaagggaaaataaactcagcacttcatgaagctatgatagttaccacttacaagaggcctgctaagtgtctggcatttgcagggtgctatgtgcccattattcctgctccctataagaaccctacaaagtaagcatcagtatgctcttggtataggtgatgtaaccaaagctcaacatggttggcagtcaaagatgccctgctaataaatgtgagatccatgatttgaacttgggtttgcctgattgcagagtcttgtactaaagtgtgcatttccataaagagggccaggggctggacgccgtgcctcacgcctgtaatcccagcactttgggaggccaaggtgggcgaatcacaaggtcaggagatcaagacaatcctggccaatgtggtgaaaccccgtctctacttaaaatacaaaaattagccaggtgtggcagcgtgcgcctgtagtcccagctacttgggaggctgaggcaggagaattgcttgaacccaggaggcgcaggctgcagtgagccaagatcgtgccgctgcactccagcctgggtgacagagcgagactccatctcaaaaaaaaaaattaataaaaggagagagagagagagcaaggaatgaggagcacgagctctctggacaagggcaggtcagctggagctcccccgtgactaggacccaagaactcctccaaggccaccccaagtgatctgctcaaaaaggagtatctcaaggtcatctggtgcagccaatccccaggacaggatgagatgaggcacaagggccaatctggaatcaagagctccacggcactgaagctccagccctgattgactgcgtcaggccagaccctgggtaattaccaagctgtaatgggatctgatatttatattagtcacgagcctgacagagaaaacgtgttgttttctcaggcacagccatggagacaacatctcgataattcattacacgcagaccatccttgatcaagcccaagcttctacaaggccaacagctcaaactgagaatggaaataactctatgcccagccacactcaggcccctcaacaaaccacagctccaacaggaagttggcctcagtttccccagttatttaaagagaagtagaccacatgctggaagacgagcagaagatggaaataaagatatgtaactgtcccaaggctgaattcctaaaggaattgctagggaactgcaaaacacattctgagctagaaactttaaccctcattcctcaactcctccctctctcctatatcgaatcacagagcaggaagggacattagaactcacagaattcaatccccacattttatacacaaggaaagatagacaccagagaggttaaataacttcttcaaagtcatggctttattcaggctaccagagcagctccctattcaatatagtctatgacaggattgaacttcacaacgtcacacccaagtgaatagagagctctgatgaaatcccacaaggaaaaaaacaataatgtgaaaaagtacagcaaagaacacagtactggaatgactgtgaccaagttcccaacaggaggaaattgtaatgttttcttcttcactttctgaaaaagtccacatgccactcttttcaaaagactaaagtcattcactgtttgagattcagaggccaaaggtactaatgaagagatgtcccacgatgcatgtccacagtcttgggttcctttgatcaaaaaggtttggtgcgatcccagagaccaaacgctcatgaaattggagctccttgctgaattttatctcccacagaatttcagacctgctttcctctggactccagctcttgatcaaaccatcttggggctgaaggagggtgagggtgaacccatctgagggctggtagaattttctggaaaggcagcctatgttttcttgggaaatctagcacaaaaattattattctaagcttaagccaaatacatgcctgtgtatcgagtcttgacaaaactaccaaatacttggaaagaaaaaagaaaaaaagacaaacacacacacacacacacacacacacacacacacaattgcaataaaaatacagacctcaagcatagaaagaaaagcttttaaaaggcctaacttaccgttactgcatataatgagctggctacctatggcttaagtgagcaaatctaggggcaggtatcaagagattctaggtgtgctttaaaatggacttacggtatcaaaaggaacctgcactcattctatactggcctcacatcttccaaacaaaccaccatcacctctcatccctggcagatttcttacagcaactcacttccagttatgtccactcagcaggtcttggggctacaaaacatagccaaatatttacgaattgttttttctaatcgttgccaaaaacctattttcttgagtaaactgacagaagttatgcttgctcatcatttaggagatcctttgtgtgtgcgatgggattagcatttcattacagacactgcaattgcatttatgtaccccctaacataaaaagactttggaagctgtgtttaggaccccaggttcacaaaaacaccacaacttattttcaatcatggaaaaagttttcattatgataaaaattgccccctgcctgaaagaaagcaagctgttaaaaagttcacccagatcactctatctagggaacatttcagaggcacacaactatgagctatctttcccctaaagacagtcgctgaatctcagtaaaccggggaacaaaattcccgagactgttgggggaggtggaggagaaggatggagagagggaatgtgggaatttgaaggctccaggaataagctgttctcagcaggaaggctagtcagggatctggtgtatagggctttgcttaacctgagggcttctctggaaggtgggaggtttgcctccttaacaaataagaagaaacctctacggctgagaaggtaattccaaagaaaactctccgaccagcacctgcaggcctccggagaagccagagaatgacgaagagaatgatggttttcatatttctccctttgttccaatacaccagtattttccaaaacacaaatgtgctgccacaaaacacagctgagctccagcacccaacaggatgtataattaatgatcaggagagacaggctccttcccccctggtgttttcatagccagccttcacccatagccccaggcttccctacttctctcagccgccaaggaggctgctacaagttgctgtgccctgtagaagtttgaggggtcctcggtttaactttactagaaaagatgtgaacatgtggaggctgcaatgtgtatctaccctgcactattcccctggatttcccttccctccaaaacggttcgcgcgtgaagtcccctaggatgggaattactcagaaagaaggcagctggctcactctcttttttccagttctttcttttttattctgcagttttctatcagtgtcgggtcccccactccagccagtggctgtggggaagggaagacatctctagggacacgactacagaccaggcagtgagcctagcaaccatacatcgaaggtgtcgccagcctcagtgccggtgggcgtctgcaccaggaatagctaaagccgacgacatctagccacctcgagcgccagggaagacgctccgcgtaaaaccgcggcctcaggcggactcccgctccagctccgcgctgctggtggcatttccggggacccaaagtgggtggcctgggggcaaaggaacagaggccgaagaacttggggtatgttccactagagcacctaagggacggagtgggaggttacatcagatatgcgacctcgacacattccaaaagtggcagccccgtgggctacccccaatagtgggatggatctccccaacttctctcgcccctcgaagtccccctgttatctcgggccatgctcctcccccgggattcccttgtgcaaaattattctctcccttgcccaaaggatttttcccttctttctgaccccacgaactcatctccccaacaggttcctaaagtatgggcggatgtgctccctctcgcccaccgccaggagccgagccccggcaggtgagcggtgcaaaacacgcacccagctgcccccagcttcctccgtccccgctgagttggctgtccccaccccgcaccacggcacccgagcctgtgagtccccgaccccggccccagccgcagccgccaacaaccctacaataaacaagaggacaggattgagcgtccgcgtcccggagcgcactggctgggggcaactcctcacccccggcgcgccgcccgctgccccgatccgagagcaccgggagagccgagggaagggaaggcggcgaggggaaggcaggcggggatggagggaggcacggcgcggcgcggagcgaggaggtgggctgcaggggacgccgagaagcggtggggctggcgcagagggcgggcgcccggggcgcgcgttaccttcgtcttgcccccgcagtggcagcacacggtccacaggtacttgagcgtccgccagagcaagatgatgaagaggcccccgaagaaagtcaccatggaggaggccaggaaagcccaccacatgcgttggccccggctgtcgcacggcacctccatggtcaccgggatgatgagcgcatccatcttgggctcgtggaccgaggacgaggaggaagaggaggaggaagaagaagaagaggaagaggaggaggaggaggaggaggacgcgtctaggctgagatggttcgcgtggatattgctactcattctaagactgctgcctccgccgccgccgccgccgccgctgctgccgccgccgccgccgccaccatttgccatagctagcaacgggcagccggcgcaggggctcgggggagctcctcccgccgccagcgccaccccaaacacccatcaacagccatattgctgctactgctgccgccgccgccgccgccgcggagcgcgggaggggggcggggaggcgcctgggctcggggcgctgtgcgcgacctggcg

SEQ ID NO: 910 - DNA, 768220 bp, Homo sapiens; identical to SEQ ID NO: 909

SEQ ID NO: 911 - DNA, 752944 bp, Homo sapiens; identical to SEQ ID NO: 906

SEQ ID NO: 912 - DNA, 135801 bp, Homo sapiens
cttacagaaattgacctttatttgttgtactaaagcctgtttaacttttgatacaaagtaacattttagtacagaaaatcccagtctgtcagctcagtacctgtctgtgcacactgtaccatctcagtcccactctgcctgtaacttagaaaacagcccctacccccagagggtctgcgagttaataccttgagaatagtctacagtttttcatagtttgtctgagctagaaaacttgtacctgtaaaacaaaggacagcattgaggactgaaacttgtctcttttttgaacaactgtgcaagaaaatatatccctttttaaaaaacatcagttatggctaaactacaatctagtgtctagaattacaaagaataaaatgaaatcaaagatttctcgctagtaaaatgaaatgttaggaacagtattaaaatataggtcctaccccaacgacacttacacagagcccagtacagtacctattattaacaggacgcatagcttaaggaggaaccacatcaaatcttcagccagacatatctagcctcagaagtgcaaaaaaaaaaaaagcccccaaacgaagacacccacactgagtagggtgcatgccgtgagtgctgtaatcaagattaaaaagacctcagtttttctttttagactgttgatagtgacaataaccattatgcttcccctaaaagctctcaattcaatgtctgaaacatgaatgttttcatatcaaaaagaactgatgtacctgccaccctctaaaaagtttaagaattaccctgcaaacattgcactgatgaaggctgtcacgacttacagagcctaaggaggacccaatggcaggcatcagcacagctgaacaccacctggaccccactgcagccctgcccacgcagctctcacggagcagacacagtcctcaagtaataagcacagatggaggagaaacgagaggctgtggaaggcaggagagaaaggccgagagacgagtttgtaagaatgccaaagtcaccttccccattgtgggaggaaaatgccaaaggcactggttctgctgccacaggcagtctgagcacctggagttgtgacgtccttccaggagaggtgccaccaaggagcaggaggtttgtcaaagctctggtcccaccaacaagaacctcccaaagcaaagcagcccccattgaggttccaaggtcgttttgctgaagacgggaacgaaaccaacaccaaagcgacagggggttgacagaggggacaggggctgggcaccggcaacatggagccgttcaagtaaacataaaccaccaaatacttagaaaaggcttgtaaacgagtgatccgaaaggttctctttgcagcatctctgatcagctggctaaagaaaggtgggtgctgaacccgtctttagtgttatctgttttgtgttaaagcacacgtgtgacacgggcagagtgtgtgggcctgggcctggatcgcacgcagccgtggccctctgtctacaaaggaggtgcttctgggtcctggttccggatccttcccccgcatgttcatagacggacagacttctactttcagtcgctagaaaagagctgagtctggtgtcccctcaggcggccagctgcagtcatccacagcacagcattctcctagagcgggcaggctggaatccacaggactttattttgttcttgattgaccattgccaagatctgagtgcaaatgcttgacagggctcctccctggatgacccctgcaaaagagccccccagacacgtcattcagctcagagtaagaccccaggtttgaggcaaggcagtacagcttgcactctttctactgtgtggctgtctgctttgtgctccttggcactctgctccatccccacctgactctccttcaccagcaagaaactgggaaagaaaattgcccctcttgagttgatcactcatatgtaaactgcccaccccactgcagttaacaccctgggttgggtttgcaatggttgggggaatcccagggcatcagaaggaagtttggaggacatgtggcggtggtctaatcattagcaggattctgcaggaaacgacaagtttaaggagccagatagctcatggccaagaggagagtcacagaaagatgatggcgccaacttgggccagccctgtactataggagtttgacaaaggggtctatagacaccaggccaggggtactccagtgtgctccacataacagcacctggacacaaaccaagcccctactgcaacaaggcatgctcagaaattgacagtgagtgtctagaaactgctatggaaacaggacgtcgtaattttatgtctgttgaatctaacaagaaaaaaatagagcttaccttttgcaagacttagagttttaaattttcatctctctaggaattgtcagtgtatttggctaaataccagtctgtgaggaattggaaatgaaagttcacacacacacccacacacacacacacacagaggcatgcacacctgcacatacctacacacacatgggcaccaagcccaggtccctggactagatcataacactctccacaatgcagttagaatccctgtcccatcctctgtgactgcaaatgctaatgccctgcaaatgacagactttcccaaagaggctgaaggccagaaggtaaaatagaaccaaacttcactgagtttgtttcactttgaagaccagagatggtaaggggacagcattgtttttttttgttttgttttttgtttttttttttttggaggggggtttgccaaatcccgctgcaaaacgggactgccctggagggtgctagggacagatgggcccctagcctccgctgcccacactgctggcacactgggggctgctccagtccccgccctgcctggggacactgtggctgcactaaactgcacctgtgctatgagacagacccaccactgcacgtgtgaaaatgagcaggcaagccaggcaggacctgaggccaagatcggtgagcttaacattcaacctgtaagaatcctgacgttggccagggactgcaatctgaacacctgacttgtcaggaacgtgctcatgacagcacttgggagcatgtagaaagtgcgggcttctccacggctaagaaaacagccttaggaagcctctgcttccttccctgctgcctgctccccactccaggcccacgcacacctacctgtgaagtacctgctgtactcctgctcaagcttctgcgccgcctcaaactgctctttggaatgcctctgagtcaccttgtccctcaggtagatggggtctctctgctccctgtggggacagccagacaccaggctgagcactgagcctcctccaggccctctttccttcctctgtccaggctaacaggggccccatcaaggcaggggtaggctgtggagggaggccccatgtgctccccacataaagcacagcaacagcctgtaggctgtcgggggagctctgggcagatgggggaaggagggccccccagcacacacacttggaacagatgcaccagcagcccctagcgcaggtcccagaagctcagcagcacagaaaggcaaaatggagcagggccttggtgagcccttggcccaaccagcacaggagccgaagctcagcgaaggcaacggctcctgagtcatgagccagctcggggctgagtgggactgtgcccaggccactggctcccctgctcctaagcagcacgtagcgaggaaagggggctggggcaggagaggggagctgtgcagaccaagctggccatgcccaaaaaacagtggcagcacccaaatggcggaggggcgcgaggaaggggctgcgcttggctgacaccacctctgagtaggggacagggccgacagggaagggtcattttctacacgtactgcctatttcaagacccataggcccatctctcattcctcaaccccccaccccaacacaccctgctccctacttgggctcccagccccacctgtgacaaggccccagcggagcccagggggccagttacctacttgatgtgcttggcgctcttgtagtggatgaagatgacaatggggtagatgtgcatgtggtggagccgctcaatagcgtgcggagcaatgtccaggaggcagtgtcggttctggggtggggggtgcagagtgagccctggcgggcagtgaggggcagccagccccctgtcctgccaccagcaggacccacctcacctcacagggctctacccacaaacaaggcagtaaagccacacagtacaccgtggggaaaccatacccacgaaactcccaacaaaccccacttgctgtgaggaaggccaaggctgggagccagggcttagggggctaggggtgctggccagcccaactccaaacttcctttcccgcctttgcccagatacagggaccttctgaaagccctgccccaccctggcctctgaagccttatttttgccagactgagcgaatgaagagccagagtctggtgagcctttgtgtggctgagactgaaatatgtctgtcatgtctgtcgtcccaggcatccaggtggagtgcaggcccgtgcactcccgacccccagatgctccactggggcattcccccaagtagagtttgcccactttcagcagtgagaagccaacaccttcatctaacagagaagggaagcaaagcccagcgagcgagctgagcagcctggagaaatggagcccaaggagcggctgtgtccttggactccgagtgtttgccccaccagcactccccacagacgtccccgccctcgtgctgcctaggatgttcgaaggcaccgagagtcatagcccttttaggggcagggaccctgagggaaggcacgttcctgtccccagaaggtgcatgtgaaattgttcggcacatgcatttggggaccccgttccggaatgccctgcgagaggcctttccgcagagctcaatactctcatcagagatgagaccccccgcacctgccagagaggaagatggggcggcacatacacaggggaactcctccatccccaccaagggatgtgcttgcagaaacacacagcagccatgagggcaagcccaggcacaggtgaactcagactaacacaacacggtgggctcactgaaggtctgagccgctggggcagaggatcacggaccaggggcctagacctgtgcacaggaggtctaatactggatgcctaatcctcagactgaagccctgggtaccttttctgtgatctcctttattgacgccacagtggtcacatcgaaatggccgcttctccgcttatagtcgacaaacaggcaatctttgacaccccgctcaatggcctgctgggaggccttcatcacctctgcaatgcacagacacaggaatcagggagccccaggccctgctgagccccagcagagggagcaggggaagaacactgctcagcagctgtcagtaacccagtcctgccatgcatgaatctgacccatgtcagcaggcttctggaacactgtgaaatctgccccccggtactgccacccactgtgcacagctgggcaggcaggtggacagggacatagagacaaagagcccagtaggcacagagggtgccccgtgccccttaccaaggggacatctgcagaacttgccaggagcctcattcaccagcatctccttcaccacgtccagcaaaggccccagaatcaggacaggcctcagagcggtgcagtccaccttctggacccgctgataggccaggctcaccgaatctgagggagagagagcagcagcgtcacggacccagcttggagtggaggacctgagtggggctggggaaccccgctccctgacctcgcccactctggtttgcctgggactcccccagcttcagcactgaaaatctcgtgtcccaggcacaaccgggcatcgtcacccctggagtccagcatgagcaccccccatgccctctgtgaacaccagaggcagctggtctcaaccactcatcccagagcttccttctgctctgatttttcctcgtgggtcgacgcctgcttcccctgccccatctccattctcctctgctctctggcaaggcagcctctggggtttggcaggtaaagctcccactccccaggaaggtgtggtcagtgtaacccagacctgcccagtgacaggtgaggcctccccaatctgcacggctagaacaggtgagtgctgtgagccagctctggccatgcagttgaggataacccttaagaaatggcagaggcacaagatggaagggacctgggtcctggatgatcctcagaacgcaatgcctctcccacatcaaccacagctcagacttgtacatgacagagaaataaactgcccattatgcttaagccactgttatttggtttcagttaaagcagtcaaaccaatatcctagttgatacatgcagtaaacctccccttgcaccaaatgaataaagtccttgcagggagacacagtctaaaacccagcaagatcttcctggcgtctccctggtataagtcactgtgctggaatctcagaaacataataaagaatagaacacagagttcctgccattaaaaagcacacactttaactagagtcacaacagagcaacacatgaacagcaagagagcacgcaagagctgcctggcaattccaggagcggcgggcttcagtagacactgtggctggatgacagggtgaaaagaccacttgggcaggcccaggagggaagtgggatgagagtctccagaaagagcagggcaagaggatgagtatggagatgatggggagggcagagcacaagatgactgcaggcttgggaggaagggtccatgagaggcttggcctggagggatctgtacgcatatgcagaacaaggagtgactgcagagcaggcacagggaccaggaggcagaaggctcaggagaacacaagcacagtgccagctgcagcagcaggctccatgaagagcaacctgtgggcaaactcagggagtaagtaaagtctctcctctcctcttgccctgtccctgtgtgtgtgttttttagaagtgatcactgctgggcatggtggctcacgtctgtaatcccagcactttgggaggctgaggcaggtggatcgcttgaggtcaagagtttgagaccagcctggccaataaggcaagaccccttctctactaaaaatacaaaaattagccgggtgtgctggcgcacacctgtaatcccagctactcaggaagctgaagcacaacaatcacttgaacccaggaggcggaggttgcagtgagccgagactgcaccactgtactccagcctgggcaacagagcaagactagatctcaataaaaataaataaaataataaaactgatcattatccacatacatccacacagtcttttacacagcacttcctaacctggtgaccagcagctctgttgtttaaaactggaggagggtttggtggtcacattcaccaccttggaaccccatgtggtcccgagtgaaggctctgaggaggagtcacggggcaaagaacttcctccgagaggagtttacataaacaaatcctctctgtaacaaatctgaacctcacggataaggccagcactcctctctgataccccttccccaacctcagtccccactgggctccttgaaggtaaccactattatgagctggaagtgtatcctagttcttcttataaactgatttttatatgctaaagaaaacctagaatatatattgtttaagtgtgtctgtggatactttataactcgctccttgtccggggctgtgtttctgggaggcatccctggtgattcgtcgtgggccgctctgctccttttgggcatcccattaacacttattctggatcgacttatccacttccctgctgatggacactacgtcaccattccctccatttactagtataagaatcatattctcaaattatggcacagttgctatagggtggaattcaatatagtgcttaaaagaatggtttggaagaatattactgagatgggaagatgctaacaatatgatagtggaaatacctggatgaaaacagtgtaatgcagtgtaatcccagctttgttgtattaagtaaaaaactggtaagaaatacattaaaatgttaatggttaaaaaaaaccatattctcccttaatgattactaacattccacactatggggtaccaatttaggagattctttttcctccctgacaatcttctttgtcagatgtcctcacaattacagaattgtaagactagacagcatcttatgagtcactgactccaactggagaagaaaaacagcctatccaaggtcacagctaatcagggcagagcaaaggcatggtcctgggggttccaaccttagaccatacggcaatggctttctttaaaaggtgctgtggactgaactatgtcccctcgacatttatatgttgaagccctaagccccagtgtgactacctttggagacggagtcttcaggaggtaagttaaatgaggtcagaagagcaaggccctaatctgatagaactgcggctttttaagaggaagagacaccagagatctctctgtctccaacatgtgaggacacagcaaggaggcagctgcgtacaaggcaggatgacagccctcaccagaaccaaccacactggcacccagatctcggatttccaacctcaagaactgtgagaaaatgaattcttgttatttaagtcacctagtctgtggtattggttttttggtttgtttttgtttttgagatatgctcttgctttgttgccaggctgaagtggagtggcacaatcatagctcatcgcagcactgtactcctgggcttaggtgatcctccagcctcagcctcctgagtagccgggactacaggcacacgccaccacacttgattagttttttaaagtttttgtagagatgggagtcttgccatgttgcccaggctggtctcaaactcctggcctcaagcgatcctcttgcctcagcttcccaaagtgctgggattacaggtgtgagctaccgtgcctggcctgtggtatttggttacagcagccctagcagactaacataagaggaaaaccagtcctccatatattcctgagacactcccgcacaagcccctaaaagagcaagcataaagacatgcagtgtcctctgggtggtggagagttgagtccacttagaccattgcaggtgggtgcacaatcagcagggtggggggtaccagggatgctatgcagcagttggaagcaataaactaaagcaggaattcaaaacccactgtgcattagaattagctggggtaacttttaaactactacacagggattaccactcccaggtataatggaacagcttgcagcatcccttggagaacacctagaaaatctgggtaaaaaatgagaaatatctttttgaaggcatcgtagagtggcagagacaagacagaatttgagatgccaagatcctggagagaaggaaactggagtattagaagctgacattctgcaggcctttcccccttcagagcaactggagacttctaaagtgagagtgaggggcagagaacccaggcagagggccgccgctgaggggctgagaacccaggcacggggccgccgctgaggggctgagaacccaggcacggggccgccgctgaggggctgagaacccaggcacggggccgccgctgagggctgagaacccacgaaaagtttctgaaaatctccaaagcaggtgagatcaaaacggagttcagggctgccaggacctggtgggtcattattccagaggaagggaagggcaaagaactaagtctggtatcacaggttttcccttaaagccatttgccaaattcttaagctgtgaaaagcaagaagctaagcatctaagacagtcactaagacactgagcagtgttccatggcctcccagtgctgaagagtgagaaactggaagtcaaggctccctagggaagagcggccctagggaacaccccaggctgggaccactggtgggccaccccctagggtcaggtgaaccaccagctgcacaaaagctgcaacccagcctgaggtcagctgagtctgtggctggatcaaagtgatctgcgagcagcggctatctccagagcagagggcagaccctctctggaagctggcaacatcactcggagccctgaaaatcccctaaacataacttctgacatctcaataaacaataactaggcatatcatggggcaggaccaagaaaaacaaagaccacagaaagagactcagggatgaccacacatgacagttaccaaacgcagtctttacaaacatatgattcaagtatttaagaggacagatgacaagagggaaagtctcagcagagaattaaagcctggtaaaaaagaaccaagtggaaactctagagtgataaataaaatacaacttctgaaagtaagaacataatggatgcaacagaagagtggaataatgaacaggaaaaaagagtagaaaacaaccaggctggctgaatcatggagagaaagaaagaagtggaaaatgcaggagaaaaagagcccagaagacaggagacagacagggtattgtcgaagaacaaaaaccccgaggagaggcaaggtcagcacagaagcaatatgaaagaaactgcggccaggaatctccaaaaccgaccacaccaccaaactacagatgtaaaaagtgctaagcaccttctgagcaggataaacacaaagaaaaccacacgggggaagcacggtgtggtaagaaattaagaagtttctttctgagaaaggaaggcagagaaaaccctacccactcatggtggtggacgggtggtggcactgccttcagcactgagcctggaaagatgacttctcaccagcaatgagtgtggcaggctgacaagtgtcccccaaagactgactcatgtcctaagccccagatcccatgagcattacaccttatgcaacaaaagaagcgatgattcagttaaaggccttgggaggaagggcttttcctggagtatctgggtgggtcctaaataaaaccccacgggtcctctgagaggcagagggagttgagagagagacccacgtggaggacgaggtgacgtgaagatggagcagatgagatttgaagatgacagtgatgtggccacagcaaaggcttggcagcagccaccagaagctgggaggggcaaggaacaggctctctcctcaagcccggagggagcgaaggttggccaacaatttgactgacccagtggtcctgagtgtggacttctggcctccagaactgtgggaggataaacctgtgtgtttgaagccacacagtctgtggtaattgggtacagcggccacaggaaactactacacaaagagagccagggaccaggaatgatatctttaaagcacccaagtaaaacatccaccaatctaaaattctatatccagtgagaatctccaaaaacgatattaaaatggacattttcagacacaaacactgacaggatgtgtcaccaaaaaacctgcactacaagaaaaacatttctgcaagttgttcagcagaaagaaaacaaaatcagaagcacaaaactgcaggaaggaataaagagcaatggaaatgtaaaaggcaaaaaccgatgaataattgatgtgcaaatggacagactgagtcagagttaaagtatctgtagaattaaaatgagaaaagtatggccggggacagtgccttgcgcctgtaatcccgggtgcagtgccttgcactttgtgaggctaagacaggcggctcacttgaggtcaggagtttcaagaccagcctggccaacatggtgaaaccccgtctttactaaaaatacaaaaattagccagatgtggtgacaggcacctgtaatcccagctactcggcaggctgaggcaggaaaatcgcttgaacctgggaggcagaggttgcagcgagccgagatcgtaccattgcactccggcctgggcgacagagcgagattctgcctcaaaaaataaaataataaaaaaataaaatgcgaatagtatcaaagttagaaaagagataaatggagttagtggtttgatgtcttagaattatcagggaagtggccaaagcaatgatttctcttagcagtaagtcaaaggtgcacactgtgaggtctattttaacccccaaaagaataaaatagaaacaactaaacactagtggatgtgagaggataacagtagatgatataggggcagaataaaacaaaacacatgattcatttttaaaaagcaagaaagaagggacaaacataaacgaggtagaatgaatagaaaacaaacagtaagatgggaaatgtctactttatgtaatgaggtaaatactcttgatgaaacaatcaagactgccacaggggtgttcagattgtggaaattcctcacactgctcacttttctgtaaatgaatgtgtgcattgctgtatgtatgttacacttggataaaatttttaaaaagacagattgccacagtggatttaaaaagtcccacatgctgcttataagggatatttaaatataaagtgacagaaaagtttgaagtaaaagaaaaagataaactgtgccaaagataaccaaaagaaaactggtaatgtcaataaaaatatcacgtaaaatagactttcagaaagaaacattcctggagatcaagaagggcattttataacgataaaaaggttaatttaccaggaaggtgtaacaatgcaaaaggtgtatgtatctaacgacaacttcaagatatatattgaaaaacacctgaagagctaaaaggaagaatagacaaagggctattttttaaagacactagcaccaccggacaaatgccaaacataatggagatggcacctacggagaaaggagcagagggcacaagagtggaggccaaagagagtgaaggaaaaaaaacaaaaagcaaaataagagagaaaccttgccttgagtaacaggttggcatttttttttttttttttttttgagacaggttctcactctgttgcctgggctagagtgcagtggcgtgatcacagttcactgcagctcttgacctcccaggctgaagctatcttcctgcctcagcctcttcggtagctggaactacaggcatgagccaccacaccaggctaatttttgtattttttagtagagatggggtttcaccatgttggccaggctggtcttgaactccctgcctcaagtgatccacccacctcggcttcccaaagtgctgggattacaggcatgcgccaccatgcctggcctaaactttttctataaggggcaagatagtaaatattttaggctttgaaggcaaaacggcaaaattaagcaattgttatcagcaaagggctaatagacttttttacatcttacattttaagaagtgtaaaaacccatgctcagctcacagaccatttaaaaataggcagtagtccagactcggtccatggccaatagtttgccaacccttgtcccagctgatagtgacagtgggccatgaactacagtgtgatccactgaactccctaggcctaaggtcttcattgtaaaaagcgaagagagggagggaggcagccagctgccctacactctgctgctcactgccacccccacacctgattgccagggagggcacattctaggacagtagacagtagacacacaccagggccctgggagccacgttcctaagggcctcttgctttaaaggacaaatgcatcctttccacaagggctgtctaccaggggatgtctgacatctcctatcactcaactccagccctggactagcatcttgctccataaggattatacaagacttgttcatgaacacaggactgaggccagaaatgccgaagttctgcagaaaccgacagctcttggtcactaccaagcagcctgtaagaacctaaaaacaaatggcaagcaaggcactcagcagagattgcttcttgcctacccaatagctatccctccattcttcctcagtaactgaacctcttactgaggccagcaatgcacccagctaaaacatgccttttctttttaattattttttgagacaggatcttgctctgtcacccaggctggagtacggtggcgtgatcttggctcactgcacctccgcctcctgggttcaagggattctcctgcctcagcctcccaagtagctgggattacaggtgcatgccaccacacctggctaatttttgtatttttaatagagacagggtttcaccatgttggccaggctggtcttgaactcctgacctcaggtgatccacccacctcagcctcccaaagtgctgggattaaacgtgtgagccactgtgcctggccaaaacatgcctttttgacctctcttgcacatgcaagtggacaatgagatgcaagttgaagtcacaggttagggcttccagatagctgctgaaagaggcacgctcagctgaggcacacttctgccttaccactccttccttcctcctgctgcctgaaacagggacatgatggctgcagctgcattgacaggcggtgactgggaggatggaagccacaccccatagatgtggctctgaagatggcagcaccccccgaccaagccgaacacacaccttcagacttgcgcacaaaagcaaagtaagactctcttttgtttaagtccctgttgtggagctcctggatccacagcaagccccatctggagagcccactggaaaatgagctcagccacttgccttcaaagagtggaatggagtcactggaaaaggcatccaaggcgagcaggtctttcccgtccttggacccgctgcgtttgtgcttgtgtttcctccgaaaaaaggaccggcgtgcagccgctgacagcgtctttgtggcgctattgtcatctttgacttcagacatgctgagcctcctggagaattcttggtccatcctgtggcacaggggacaatgctgggcagggccatcgagaccctgctgccctgcccttcctgcccttcctggtgagaaaagcaaaggtgggccagacactgggctccccccacactccttggcaggtctcaaggctacatctcctcccacgcccctgggaaccctcggtacatgctgcgggggtgacacaaacaccagcaccagggcaagctctcagagcaggcgattttttctactacagcatattcagctcggtgtcaaaaggaactgctaggacagccttcaattggtgacatgacgagttacgcttcctgccatagaagggaaatgatgcagggatgcaggctgcctcgaaaacatgctcagtgacaggagccagatgaaaggccacactatgcaatcccaaccacacagaagtccagacagggagacccatgggtatcaaaagtaaagtagtggctgcctagggctgagggctgggtgggaggacagtgggataaggggctgacagctaatgggtctggggtttgtttgaggtgatggaaatgctctaaaattaactgtagtggcggctgcacacacctatcaatatgttgaaaaccactgaatggtacactttgagggagcggcaaggcacgagtatctccataaatccatttttctaaaacacgttatgccttctgacccatcactgtgctctatacagcactgactcacactaggagcagctttttagaccagcacttttggcaaaatgtagagagcagaagctaagataagaagcagaatccctcctccagcagccctggccccagccccctcccatgggacagctccatggctggtggccctcggcgacccctgccccaccccaccccaggcccggagaacacttacacatatttgctgggaatctgcccgcgctggatcttctgggcattctcgtccagctgccaagccatccaggacccgaacgtgccctggggtaaggtgtcatccacgtagaggatgtcgtccttcttaaagctcaactcttgctccacatctgccagccggtcgtacagggccctggaccacagcacagaaggaacacgatcaggcggctctggccaccaaggacgaaccaggtgccttctgtggccaggcccctaaggctgccattctgctttgggctgtctccaaacttgatcaggaatcgccgagggtggtgattctcaaagtggggagccctgtgttttacataaaggggcaaagactgcctttgctcccctaacactgagggcgcatccccatcaaagaactcaccaagatctgaggccataacttccctttccaggtggcctttcccagttgcctccctcctcgaagcccaggcccggcccctggttcctacagactggaatctctctaggatggaaatatgtcatcttctaccctagagacagggagttgtaccgcatcagtgttctcatgctttctgtgatcttggatcttaggaaatgtgaagaaagctctgagctcctcctagaaagcctgctgccatccctaaatgcccacagcatttcatacagtagtaagggcactgaagatgcctggaagtccacacacactgcagagggatctgcaaacctggcttgggggacaccagaaaaagaggagcacagcacacaggaaaacggggcttgactgcctccaaattctctaggtcttaagccctaaagagggggcccagctggttctttaagccctaaagggttgttctaagtcacaatcatctcaacataaataagcgtgcagattgagtgtcaaggaatgatgatcatggccccagccttggggggcaagaaacagagagccattcaccaggaaaagagtctccagtgaaagcctctcctctggttccaaatctcccaccgattccccagccactggtacctgatgtagaagctgtcaccaggcaggcccttggccttcgtgaactcctcagggcggtactgcaccttcaggcggacgccatccctgggcttcagcatctccacatagacttcctccactgtcttgttccgcacgtccaggctgccatactgccagggatgggggtggatgcatcagaaggcagaagccagggggcagcttgggcacccgagaggggccagtgctgaccatacggcagaaattcaacatccctccttaactgagactctggctacctcccctctgcaggaaggactgagtcttcatggtctccccagtctccaggtcctgtgcatgctccctggacaccaggtcctctgccaagtggctgccctgcccttgacagcttatccaggaaaaaccctgttctggtgactggcaagtctgggcttttcagaatagggaccttcctcttgctgatgttgcctgtgcttttatttatttattttctgaaacagggtctccctctgtcacacagactgagtgcagtggtgcaatcacagctcacagtagcctatacctcttaggctcaagtgatcctcccacctcagcctccagaatagctgggacaacaggcacactccaccacacctggctaatttttttgttttgttttctgtaaagacagggtctcactatgttgcccaggccggtcttgaactcttgggctcaactaattctcccaccttggcctcctaaaattcacaggtgtgagccaccaaacccagcccaacttgtgcctttatattctcacaaaccatctcccccatgaggcaggagaccacagagaaagaccatcctctctcatcagaacagagtcctgcagctacatcacctgagggcgagcaccccctgatgcccagggcctgagccaaggctctgccctcaggttccctcaatggcctgcctggcttcacagggacctcctcagaagggcttggcaggattctgggtttacagggattaaaaatcaaccctggccaggcacagtggctcacgcctgtaatccctgtactttgggaggccgaggcgggtggatcacctgaggtcaggagtttgagaccagcctggccaacatgatgaaaccccgtctctacaaaaaatacaaaaataaattagctgggcgtgttggcgcatgcctgtaatctcagctactcaggaggctgaggcaggagaatcgcttgaacctgggaggcggaggttgtggtgagttgagattgcaccactgcactccagcctgggcaacaagggcaaaactctgtctcaaaaaaaaaaaaaaatcaatcctgaggctggacacggtagctcatgcctataatcacagcagtttggaaggccgaggcgggcagatcacttgaggtcaggagtttgagaccagcctgggcaacatggtgaaactggtctctactgaaaatataaaaattagccgggtatcgtggcacatgcctgtagtcccagctactcggaaggctgaggcaggagaatcgcttgaacctgggaagtgaaggttgcagtgagctgagattgtgccagtgcactccagcctgggcgacagagcaagactctgcctcaacaacaacaacaaaagtcagccctgactggctcaccagatgagaggctgtactcctccgtctttggtgccacctgagatggcagcaagcccactgtgcaggtagatggaggcctggcctgctcagcagctcagaactcacctccaggatgaggtcccctggcacgaggccgtcaggacccttggcaggactgtcatcctccacctcggccacaaacaccccatgcaggttcccaccacacaagtgcaccccaagctccagctgggactttttgatgaagacaacgcgtggctccagggtcttcttgttggcatctcccgcaatcctttcaggaaaaaaacaaagttcctcaactgtgcacaaagaggaggcacaaaaagacaaagcagtggccaatgccctaaccgctttctgcctgcttcttggggtctcagaaccacagggagctgagaggtggcctctagttctactggctcggcgttcgggacaggatgctaaggtgcactggagatgaaggcaagaccccaggtccaaagccagttagcgggggcagtcaaaaccgtaaatcagtgcccctgctcccaggcccggctatcaatctcatgccttaaagatcaggatggcctccctcccatgtggatcacactcattttcctaacttagtacttcctaaggaaaggtaaagttggcctcactgtccagagcacagcaatgtattcagcaaatgtctacgaagaagcttctatagaccagcaactgctaacttgtgaagaggggccccttgccatcaaggcacttacaatcaaggaagggaagctgaaagtaagctgctgaacacatggagggagtgagatgggacagcgatggaaacagatacagggggcttcaggggagatgccagcccgggaggaaaaccttgcagcaggtaagttccaatgtgacagactctggtatagagaatgcagagctggcctcattctgtgagatgctgcccagggcttggtgaaggcctctcagtgctggagacacagctcctccaggacggcagagtgatcatgtcacaccatggcctggatggccctccctgcagccccaggccaggctggacgctgtgcagctcccatggagctccttcctcctcctgaactctgctgctccctcggcctggacttctctttatgcccactcttggctcttgcctgtcctgaacattttaatccagctgccacctcccctgccacactccagtgatcttcctgcctgctctgcggcggccggcagtgccctcccagcaccctgactctgctgcacgtgcccggcactggtctgccacctcattgggggaagcactgctgtgggtggccagagcccagggcctggccgggtgatgactgtgggaatgtgtccaaagacagactcagaaagcgagtgaacaagaaaaggagaagagaaagagaagatgcaggggaaaaaacaagtcaatagaaaacaggagaaaaagagaaaggaaaagagagagtagggaaggaaaaaaggaatgccgtgctcccggcccaactcctgaagacctggtgtgcggcctgcagcacatgaggccagctgcccagtgcccacgccacttggagaatgtgctcagccccacccagccgaagcggacacagggaaggctcacagcaacgtctgctgacctggagctgctctgcttggctgggggggtgctaggcccctcgtcctgctccatcagtgggtcgatgacagatggatgctccggggtggtggtgccactgccctggagagtggagtgggtaccggcagggtccaggtgtgagctggaggcggaggacaggagggataaggagcagtacgaagccacccagagccacccccactcctgtggcaactagatctgagctataaatggggaccaggtcacatagccctgcaccctgtgccctgagcagagcagacacattagaagcctggacccatgacatccacctgtcctctcccctccacctgtcctcagctcaggggccctctccaaaggcatctgacctcaggaagctgtgagcatcctgtctcttttcctctgcctgtgcatcccatctctcctgctgagcttgtggcgcagcactgcagggcatgcctccccttcttttctgcccttcaacccacagctcaggggcagatacagacaggtgtacagcatctgctcctggacagggagccaaacactttgagtgagaatccacccccggggccacaactcctggctaccatgggcccctgctggtcagggggaccacagccatctgtttccacaccccatttcaggaggagacagcctctctatatatgccccttttccaaaatccagggctggtcaactctctctttagcagcagtaggatccccagaacttacggctggcaccctgggtctccctaaaatgagcagagtgctgctgcacccacctctccacccccagcccagacggccctgggaggcccgcactcacctggaccgggagtggctgctgagctggtgcacgtgggggttgtactgggccaggatggtgatggtatcacactgctgcccgatgatgagccgcgcctgctgctccgtggcgctccgcaggtttatgccgttgaactggggaaacaccaggatgggctcagtgggggggtcggggctgtggacagggaggaggccctggggacttgggagcactgctgttccctaggaggaggagagggggaagaagtgcaggtttccatgggcgccatgcaggagggcagctccctctcacctccagtaactgatccccatactcgaggccagcctggtgagcgatgctccccacggtcaccttggagacgtagatgccgcccttctctccactcacgatggagatgcccagcggctctgagcccttctgcaccttcacgtggcgtggctcctccacataaggcctaaggaaaagtcaaaagtttcggggactcagggtcaaacaaaagggttggggagagcctgagctctctgatcaggcatatgatctgacagtgcagaaagggccccgagcctggatgctcccattgtgacacagctacatggggacatggtgggcccacccctgtgtgacaaacgatcacattcccacagcctcacgcaacacgagcacagcacacgcagacacgcaaccacccaggccaaagacacagagaacggtccgtgtgaactataaacactgatacatgtggattttcattacaggagaggagctgccccacaatatgcaattacaaactctggggggtcttgagatgccctccgaggaaaagagatggctcctgggatgacattccatcctaagggggcaacagaaaataatccagttttatgtttactggctacacagagtgatgcaaactggtcacggaaattaagctgctgcagacccaagcctttgtaaagggagaaggctgggagcaaggctgcagccatgcacttgctgccctggggctgtacagtgcacccaagggcgccggggcaggggctcggcagggagcctctgggcaggccaactgcatggtggaagacctgggcctggtggccacgggcagcctcagaagagatctgtggtggcagagacatctggaaggtgacaaaggttagaaagaagataagggacgctcagaggagaaagacaatcagagacacctggaacataacagaaaagacagtcaagtgatgcggagcctcccgttgggacttcacgccactcagggcttcattcctccaaggtatggacacctgagattttcctcgcaggataaaaccatatagccaaaggctgagggggccagtccaggtcccctctacagcacatggtcaggatagattctagcggggaggcacctaaaccaccccaccccggccacctggaggcagagcagcttcccacttggcagtctcagcctgtggccctatgccccagccctcttgggaaggggaaattaaaattcttcttgagttgtccctgctctctcccaccctccaaagtgttcccacttcccaaacttgcccactctggaaatcctcccttgaccctccagctcagacagatccaccccagactacacccacggtcccttccaattcaacacggattacagccccgtgctgttgagagctgcagagccctcagcacacagccacccctacatcaccctcctgccccagccttagatgatgaaacagaggcccagagcagaaagaggtccacctccgtacaacacgtgtatcacaataaaggagcaagcaactaagtcacagcaatagccacccaatagaacaatgatctgaaccaggttcccaggttccagtgacatgcaaagacgtaagggacacaccacggggtggggaggcccgatcggcatcatttcacttatatttatctgcatctgcaaacaaaagtatgtgtggatttatgcacaaggaggcttcttatgtaggacattaccaagtgttaacaatggtgtctccagttgaggggatctgagctaatcttttttttctttctttttttttggaggcagattcttgctctgtcacccagggtggagtgcagtggcatgatctcagcttgctgcaattccacctcctgggttccaatgattctcctgcctcagcctctcaagtagctgggattacaggtgtacaccatcacgcccagctaatttttgtatttttagtagagacagggtttcaccatgttggccaggctggtctcgaacccctgacctcaggtgatatgcccgtctcagccacccaaagtgctgggattacaggcataggctaccgcgcccagccagagataatctttactttatagtcttctgaatgatttgaattgtttgtaatatgcatagaagttttctctaaacaacagctgcttctcaaaagaggtttataaagtatacttaaactattaaaaatagctaaaaacataatattaagggagatttgattatgtacataaataataaagcatgtttatatatatatatatatatatatatatatatatatatatatatatccaaagggtaatggcaattgaatctcttgttgaagaaataatctgtgacttttttcttctttctacttttctgttttttattttttgagacagagtctcgctctgtcacccaggctggagtgcagtggcgcaatctcagctcactgcaacctccgcctcccgggttcaagcaattctcctgcctcagcctcctgagtagcagggactacaggtgcctgccaccgtgcctggctaatttttgtatttttagtagagacggggtttcaccatgttggccaggttggtcttgaactcctgacctccagtgatccacctgcctcggcctccttacaggtgtgaaccacagcactcggccttctttctacttttctatgtctctgattttccataacaagtataaaatactgtacttcagaatctgggaaacggggccatttttaaaaagaaagctgttgctcagtcaggtcacacatgtcaaatttcatctccaatcggatcctaaccaccgtgagggcaggagtcactcacatttttctccctcctggagcaggtcctggctctccgtgccctgtggggagctaagggaatgcttggcagtgggtggcaaggccttttccacaactgaagaacccacttcacttggggaaggtcccgtcctctctgtggccagggccggggctgagtaaaacaggccagcatgctcctgcgcgtgccacatggtaagagctccgtcagcatttcttccgagttacacccgattcccctactggggccaggcctctgtgttttgctgtccttccgttacccctcaggttctctggttggttgccttttaagttcagattttcaagtcaaatataagattttctctggctgggcacggtggctcacgtctgtaatcccaacactgtgggaggccgaggcgggtggatcacctgaggtcaggagttcaagataagcttgaccaacatggtgaaaccctatctctactaaaaatacaaaaattagccaggcgtggtggtgggcgcctgtaatctcagctactcaggaggctgaggcacaagaatcgccttgaacttgggaggcagagattgcagtgagccaagattgcaccactgtactccagcctgggcgaaaagagcaaaactctgtctcaaaaaaaaatatgttttcttaacatagggcccacccctgctgaggctcacagctacagaggcctcagctttctggactcaaatgaaagagagtatctgtgtttcttttggtgattaaataaaagtaagtttatcagagctctttaagatctacaatctagacagaagctgttaaatataaacacaatctagtaagttccatctaggggaacaacagagagggatgtgtgtgcacagtgcgcgggggtgacggattccatggaggaggtgcctctggacagacagcaagcctacagtcaacctgaaacctaagatggacctacattctaaaatgaaccagtaccagtaaaaagctaggctgcacatttatgctttcttcctgtgtatattttatttcacaacagaaagcttcgaatgagagggaaaaagcaaagggtaagaatgagtcccggtgccagccactaaccacgtggccacaggtctgtcactccaacgtctggatccagtttcctcaactgtgaaacagggataacaataataacgacactggcagggtccctgtaaggatctcgtgacttagccacacgtaaagtgcttgaacaagggcccaggaaggtgtaaatggtgccatgatggcacgatcaccgtcaggtcatttccagcatcatctactgtgagccctcttggctccctgccttgccatccacacacgccccacctccctgcatccagtgccccatggcacttactggtgacaccagcaaatgctgggacactcaagctactcctgctgcttctactaagccccttccctgcagagcccaggcccgctgccgggatgcacactgtccactggtttacccactccaccgatgaccggccatgctcacctgtcctttctccgctccccgagggacgcggggttgacagcgattctgggcaatgtggaggctgaggtctgggactggctacaagaggacagggtgtcgatgttcaggggtgactgtggaggagtgctgcattcagaatgtgacactgaacctgcagagaggagcgggtaatgccggtgtgaactcccatctcacttccccaacagccaagaccaagaggcaggtgcgatccagacacacagctctatccccactgcatcgcatagtctggagctcagatgctaggctctgcattgccccctaccccccacaccaccaggcctactgctgggctcagtgaatttttactgactgactgagatgactatgaagttctcagctaagcccagagactccaccatgaggagtcagaccgcaggaaaagcaggagagatgggaatgtcgagaagtccttacctctctcggagcccacgacactccgcggatatcttggtgttgatgggattttaatgcgttccgccttgaactgcaagttactcgaagaacctattgttccataagggaacaaaacttcaggcctcatggttaaacaccaccctgtccttcctctccaccaggctaccagtcaggataataaatgcaaagctgggccctgctgtttattcccaagggagccttgatatggaacagtcaagaaaagcagacgtttaacatttatctcaatgaactgtgcaggcccagactgctccagaacaggagcgcacaagtctcacttccagccacggaacagcagcctaagagacacggcagctgctccatcttttctccccagcgccagagttccccaagatctccatgggctacctttgtccgactctcctctggggttcactttccatacaaaaatgtatgaagagccatacaaaacagtccagaatgaggccaacaacctcagggacacagagcaaggctcctagctgaggggtcacctgaatgaccataaggcccccacagaaagcggaaggcgaaagcaatggctctgacagcagcatgggcatggctggcccatgaaggaagcagcccttcccagtagagaaatgagctcagtcccaggaggtgacaggagctcgtgtggggagcccacccgcagatctggacattaggatgcaggcagagatgaaaagcttggcaccctctgcagcacaaagtccaagtggtgcagttacccaggcgggcgctggagggcagtgagttggacccatgggtggctctcatctcggagtagtcgctgcaggtcctgtggctcaggtccaggctcaggcgtccctggtgctggacactgcgtaaaaacaagaggtgaggagttcgggaggagaaccaggaacagatgtggccactggggagaaacacacagaccaggcaagggttcccaagcgggcagaagggaggcccaggagccactgattatcagccgaggatagcaggctgccctcagccactcccggaggtggcatccactaagagccttcaggaagtagaaagggccacacacatggggcggtcagtatcatacccactccagccatagggtcaggattaggctcactaggaagaagtgataaaaaacagaggttttgcaacctgggtgggcctggggagggggaacctgtcctcccaggaagtgggtaaggagagacaaggcacagaggactttggggaggggacctatgtgcctcactcgggacagcgtgcctaagaaaatgaagggcagagcagggatcgcccacatcaggctgccctgagaccaggcctcaacagcatctttttccagctatgtaatgaggtgacatctcttccctgcttaaactctacagtggtctccactgtccttagaataaaatccaaactcttcatcaccgctgcaggtcccacagggtttgtgccctgtgacctcaaacctcttcttgactcgctgcccctttgacaagctcccacgactgtgcctgggtgccctggccttggcaccgatggcccttctccctggaggctccagcccaggtcttgtgcagctggcctctttcatccttctggtcacagcagcatcccctctgccacagggcccttcctgaccacccactctaacttgccaccctcttccaagttacagcccagcctgtcaccctgtttgactgccttcatagcctcttggcaccatctgatatcacttcgttcattttttttttttgtctgcctcccacatttgaaaaaccacacgacatgagctagaagctaatttgtttagttcagcaatgtatcctcttataattaggatagaccaaggcatgtagtaggtgctcaaaaaatatctgtcaaatgaatgaataagagtggcttggagccagcccaccctcttatgaagtaccagtttcctcatcttcaagacagaaacagtaataggacttagcccatgaggttgctgttgattcggtgaaatgatattcataaaggtctgagcacagtggctgggacataagcactcaaacatcagctgctatcactatcgtgtccttccagtaccttttgaaaccttgtgctgatgaattcagaaagcagccctaaggctccctttccctgtgctgctctagccagtcccctcccaggcaggcaaggaagcttctccaccaatgagcctctttatgcactcatggttccatgtccaggcaggcttgggcagctggagtacagagaagcgtagggtgccttcacatacctgggatgcaaaccctgggggccagcatctcgggccgcaggtggagagctgcaggggccgaccctgtgactgcgcacagtgtagatggggttccgcaggatggagctcacagtggtgctgggggtcaaactccggggaacagtgcctagaaatgggcttggtgagaaaagacgccccaaaggacccagccagcccaggacttacacaagcctttcccctgtatcccaggacgcagccgcagtcttttgggaaaaggacttgggagatgagttttaaccaccaattcacaatgtggctgtggctcctggcctgtctccatttgtaaaaaggggggaagtctctttcatgcttcctatttcccaggttgctatggggagaaagcatgttgacaagctaagacatgtcatggctataagacaaaccatcccagacaggacagcatttcccagttctctggacctcagggctgaaaacacatggcagctctctgaaatgctgcctcccctctccctggagactaggcatcccgagtttacaccgaccctcagccccagcccctggctggctgactcacccacagacggcctgctagggtatagcggggggttgctgtgccggctggaatgcccaggcgagtaaggtgcccactcctggagctccggggagagttctccactggccgggacacacttctgttcctgcagatgcaagggcaagagtgtctgctagaaagagtggagtgtggccaggcgcagtggctcacacctataatcccagcactctgggaggccgaggcgggcagatcacctaaggtcaggagttcaagaccaccctggccaacatggcgaaatcccgtctctaccaaaaatacaaaaattagctgggcatggtagtgggtgcctgtaatcccagctacttgggaggctgaggcaggagaatcgcttgaactcgggaggcagaagttgcagtgagccaagactgcaccactgtactccagcctgggtgacagagtgagactccatcttaggggaaaaaaaaaaaaaaaaccaaacagtggaacgcttgagcagctctgcaagccagtttctgccccccaggaaccagctcctcccactggggcacaggaagggacatgaatgggaacgctgcccattcatgttgccttacacatcttcaaggaagcagctttacttcagaagaaaaccacagagaatgaatctttcacagagatcacgtaaaaggtgagaatgcacaagtgcatcaggcacgtacaactctgcccgatgtggagggctgtgcgaagctctttgtccccagtgagcagtgtggactggtgcctgagatgctttccacagtccccagcaatctcacccttctggaaactatgacagcacacgcaatcaggccgtcccgctgcccactcagcctcacacgtgccacctcatctccctagcccttcaaggcaagtctatgccctaggttttattgtgtaagttcaaaagcttcttattaaaaaagcaaaccaaatgctatgcccaataaagtgttcccctcttgtgtcacactcccactaccatgcacttccacgccacttacctacctcctagctgggccacttcccacttgagtccaacagcaaaggcaaaggcaccaggctaaacaggggcctgggacactggtgcagggccacttagcagccctccttcggccaactgcccctctctaggcctcccctccccacaccctggggctcagctatacctccaggaactgagcaggaatcactactggagcaagcttcggccgaaaactgggagcagattttggccggcgacgcttctgccccagctcatccaccttctgggaggtgaggtcctcatcacaggatttcttggccggcaggtgggaggagtccccatctccttcagggtagtagctggaagcaatgcggaccctggccttgcgagggggtgatgcgtgcatgggctccccggggtccacgtcagggggcagggcgctcgggggactagtggatggggagctgcccaccagagtggcttctgactcggagctagtctccagcctgtgctggaacttaatggagtcgctccttctgggaggttttgggggtgtcagaggccccgccctcttggagggctggggagagtgagcaggcccaggacctggaagcaggtagtctattttggggggtgtctgggggcgtttgaaagtgttagggtcaaagatggactttctttgctttggctttttataaacagagagcttctcaggcactgccgtggagctgagcatggccttgggccaggtcccgccgctgttggagccttcagagtctgccttgtccagggaggcctccccaaccccacaggggcccacctcggtctcaaagggcagcagtggccgccggccacgcacgtccaccagcccaaagccacggtccccagaggcatctgagcggaaggagctcaggctacgctcagaggcactgggacaggcctgggggcagacctgcaagggtcccccagggaatggcttatgcagaaaggagctgctgcctcctggggggcctggctccttcctgtcttccagcctgtccgtgtagaagatgtctgtctgcgtggagttattgtgctgtatcaagttccgtttgttatgagcctggacctccgggccatgggctcgaaaactcagcatcttatcagagtctttgatattttcaaaaatgttctggccactccacgaggagctctgagggaatacctaggcagggattgcagaggagtgagagagagagtgagatggcaggacttggagctgccactgaaaaccatccccagaggtaaagcaatggtcaggaatgggccacctgccccttaaaaaagagacagatagacagagatgcacacacacatgaacacatatgcttctccctaatggataagttttctcatggctctggtcactctgaactcaaagaagagtcaaagttttcttaactttgaacactttctgaaattatctgggccgggcacagtggctcatgcctgtaatcccagcgctttggtaggctgaggcaggcgggtcacgaggtcaggagttcgagaccagcctgaccgatatggtgaaaccccatctatacaaaaattacaaaaataagccaggcacggtggcatgcacctgtagtcccagctacttgggaggctgaggcaggagaatcgcttgaacccggaggtggaggttgcagtgaactaagatcacgccactgcactccagtctgggcgacacaatgagactctgtctcaaaaagaaggaaattacctgcataatgtcttgaatattttttttaaatattaaacataaaagtaaaaattcattgttaaaaatatatctcttgtggtacacccagacaacggaatataaattagcactaaaaagaactgaaacaacgtgcaggaaccttaagtgtatattagcaaatgaagaagccattctatacactctgtgattccaactctatggcattctggaaaacacaaaagcatggaggcagtaaaaggatcagttgttgccaggggcttgcataaatatggggagcatagggaatttttagagcagtgaaactactctgtatgatattacaatggtagtacatgtcatcacctgcatcaaaactcacagaaaatacaccaagactgaaccttaatgtaaactatgcattatagttaatactaatgcatccacattggctcactaattataacgcatgtactaactacactaacgcaaaatgccaaaattggggaaacttggggacaggagtggggatggtggtgatggggtggttgagagagtgctaagaattctgtatcagcccaacttttctgtaaacataaaactgcttccaaaaaagtcaaataatttgaaaatagttaatttagaaaacatctcttaatagaaagttagaaaaaataggcccagccatttcattaagagatgttttctaaattcggcctattttttctaacttcctattattaaacttttcaaatatgtagaaaagtataataaatgtccataaatgtaccatctagattcaaaaatatttcactaaattgtctttttgtctataatgatactacagaacactggaaagcaagttacaaatatcatgacatgtcacttcccttcctttttttttttttttttgagacagaggttcgctcttattgcccaggctggagtgcaaaggcgtgatctcagctcactgcaacctccgcctcctgggttcaagcgattctcctgcctcagtctcctgagtagctgggattacaggaatgcaccatcacatccggctatttttgtatttttagtagagacggggtttctccatgttggtcaaggctggtctcgaactcccgacctcaggtgatccacccgcctcccaaagtgctgggattacaggcatgagccattgcacccagcttcttcctttcatttttgagatagggtctcactttgtcacccaggctggagtgcagtggcacaatcacaactcactgccacctcgacctcccaggctttttgtattttctgtagaggcaaggtctcgctgtgttgctgggctcaagtgattcgactgccttggcctcccaaagtgttggggttacaggcatgagcaaccatgcccggccatgacacatcacttctaacaactttagcttgtacctcccccaaataaagccattctcctgtataacaaccccaatgccatcatcatacctaggaaaactggcaacaattccctaagatcatctaattatcgggtccagattcaaatgtacccaactgtgcccaacatggccttgactgctgttttttgatttcagaccagcgtccagtcagggttcctgccccctctgcactcagtaaatgcccaccctgttctcaaggatcctgtgaccccaaggagtagcatggctatgtggagccggggctctgcccatactcctgaccgtgagagcagagccaggtccagcccttaccttcaggagggacagggtcagggagtcctggcagctgcgcagcagagattcacattcattcagagacttgttgtccagtgcaatgccattgatctagagcaggacagagagcatgtcaggccacaggcagagcggcctcaggcctaccagtcaggatctctgcctacctaacctcctgtgctagacagtcaccaaatgcaaggtgccaaagtcaggagttggcaaaggatagaggtctttctggtgaggcccaaggagtccaactaaggggattctgaggtagaggaacacataagccttcacagcaggctaggggaggagcatgtccttctgggatcagaacaccgaggacccggagggaacatcttggcactgctgtgcccggccatgtggcgtgggaccttggctcagaacttcccagctccttgcctccacagaggaaatggaagataaatacatgcatgtggctcgggagagcgggggactaaaaacaagaccatggataggaaaggccttgtagagaaagtaccacgcgaagtggggccctgtgagtgttcacaaagaacctctcaaccctgctcccggaatctctgctcacagctatgtgcagaccttcttaagaagtatatgtgcaaccggtgaatgaccaaactgtgatacacccacattgcagaacactgctcagcaacgataagtaacaagcagccagcacacgcagcctcttgggtggatcttgcaggcatggtgcggaatcaaaacagcccagctccaaaggtcacatactatatgattccatgtctgtaacattctcaaaaggacaacatcacagagatggagaaaaaatcagctgccagggggcagggatgggagggagcagggggtgttactacaaatgggcagtgggagggagacctcagtgctgatagaacagctacgtatcttcattacggtggtggttacacagaacaacatgtgtttaaccacacacaaccacacacacacacacacacacacacacacacacacacacacagtaccaatgtcaatatgctagctttgatattatactcatgcaaggtgcaaccatgaggggaagcagggagaagagtacataggacccccctgtactatctctgcagcttcctatgaatctataatcatttcaaagtcaagttttcttttttttttttgagatggagtctcgctctgtccctcaggctgaagtgcagaggcatgatctcggctcgctgcaacctccgcctcccaggttcaagcaattctcctatctcagtctcccgagtagctgggattacagatgtatgcctccatgcccggctaatatttttgtattttagtagagatggggtttcattgtgttgcccaggctggtctcgaacccctgaactaaggcaatccacccgcctcggcctcccaaagtgctaggattacaggcgtgagccaccatgcccggccagtcaagttttctttttaaaatatctgcagagtgattatctggaagtagtaaattaatttgtggttttttccttataacatatccacatttaaaaaattttcatagtggccatatagcttttacactctggctccccaaaaaatctgaaaaacattggcaaagatgtgaggcaatgagttcccccacacactgcagggaggactgcaaaagccatgacctttttggagcaaagggggaagatctcgctggatgttaaacattcatgtcctctgacccagcaaaccccacccccaggaatgtaccccagggcacactcctgggtccctatgaagtagcatgtcagtggccatgcagcacgacacagatgtaagtaagggcagagatgcccagactatccctcgggagggactggtcaacaacttaggctgctgccactaaggaatgacacgcagttatatgccttggggcagatctaaagacgtgaatgtgggctgggcatggtggctcacacctgtaatcctagcacttcgggaggctgagggcagatcgtttgaggtcaggagttcaagaccagcctgggcaacatggtgaaacccccatctctactaaaaatacaaaaaaactagcagggcgtgatggcacatgtctgtaatcccagctgctcaggtggctgaggcaggagaatcacttagacctgggaggcagaggctgcagtgagccaagatcacgccactgcactccagcctgggcaacagagtgaggctatctcaaacaaaaataaaaacaaaaagacatgctgctaaaatctggctgggcgtggtggctcacatctgtaatcccagcactttgagaggccaaggcaggtggatcacctgacgtcaggagctcgagaccaggctggccaaaatggcgaaaccccgtctctactaaaagtacaaaaattagctgggtgtggtggcgcatgcctgtaatctcagctacttgggaggctgaagcaggatagttacttgaacctgggaggcggaggctacagtgagcccagatcacaccattgtactccagcctgggcaacagagtgatactccatcttaaaaaataataataaaaacaaaaacaaaaagcaagatgagcaactgagtatattataatcccatccaggttacctcaaccccccaaaaatgtgtgagatgtacatgttttgaaagtgtctgggacataatataataaattgttaacagtgattgccatcggggtgggaagcagtacacaagaggtctagccagaggaagatttgttgtcacgatttgccttttgtactactggaattttgtatgtatgccatgaaaaagtgtatggcattttcagtttttgttttttatttattagagacaggagtcttgctctgtcacccaggctagagtgcagtggcgcgatctcggctcactgcaacctctgcctcccaggttcaagtgattctcctgcctcagcctcccgagtagctgggattacaggcacccaccaccaagcccggctaatttttgtatttttagtaaagacagggtttcaccacgttccccaggctggtctcgaactccctacctcaggtgatccacccacctcggcctcccaaagtgccatgattacgggcgtgagccaccgtgccccgctggcattttcaattttaaaaggtcagaagtattaaatttgcatgtcctatgactcagcaatctcacggcatttgtagcttagtctcagagataccattacatgtctccagaggctctgtgcacacaggtaaagttcaatgcaggactgtttgcaattgcagaccctgaaaacaacttctatgtccatcaataggtggataatttaaactacatataatcaaacaacagaataccataaggtgggtaacattagccaggctacacttggaaagatatccaaggtaggatgcgaattgcagatcccattactgtacataaataagcaaaacaacaccaagaaatctatctaggtatatatagatttgtaggggcacatatggtttgggctgagtgcttatcttctaaatgggggcagggacaatctctaggagcaggattaaagggggaagaaagggactgccacttttcactttacatatttttatattgcttggctgttttacaacaaacaggacttactttggtaacaaaaaaatttaaaaataagtattacatttagttaaaaaaaaaggggtggcatttaaaagtcacaacacaatgatgtcaatttttttaattgtccttgataaacattcatgagaatgttaaatgtagagaactacatttaaaatgttaataaagctgggtgctgtggatcatgcctgtaatcccagaactttgggaagccaaggcgggcagatcacctgaggtcaggagttcaagaccagcctggccaacatggtgaaaccccatctctactaaaagtacaaaaattagccaggcatggtggtgcacaccctgtaatcccaactactcaggaggctgaggcagcagaatcacttgaacacgaaagtcagaggttgcagtgagccgggattgcgccactgcgttctaacctgggtgacagagcaagactccatatcaaaaaaaaaaaaaaaaaaaaaaaagttaatagaggttatctacaggtggtaccaaagcaagtggttcttatttcccgcttaggcctttggaggttgcagtgagctgggattgcgtcactgcactccagcctgagggacagagagagatagagaaaggttatctacaggtggtagcaatgcaattgattcttatttccctcccagaccttttatttcctaattttctacagtaaatagaaacataccatcaagaaacctatttttaaatgttcacatagtacaatgcccacaacaaggaaaatataaaaactttgctcattacttcttgctcaaacctcccaaatgtaatctgcctatgcacggcagatgaccctggctccagccttgagacttaccgcaacgatcctgtctcccacagcaagggacccttctttagcggcagggcttccaggcagcacagcggcagcatacactccattctccagactgatgccactgtctgcaagccacaggaggtcactgggtagcccctggcctcgctgcccagccctgggtcaccctacctcatctttgttaccatcttcttacaaaagaggatgtcagcaggctgcgccctgtctacgcctgcaccctgccccagtcccaccaatcgggggctcagttacatctaccctggtgaatcaaacactcagaaagcaagactcagggcccagaccacctcttgccagaaaagcacatgggctacatttaaatggcattggcccctcatccctgtgaatgaggtgctctaaggggcacccccggcccctgtccacaaaaaagggccccagccacctgaggcactctgccatgttcacaggcccgctacctttctgtccactgaggttgatgtgcagcggcgtgaccaccttcccacccagggacttcctccgccgcacgaccatgttgatggccccctccccattgaggagcgccttgatggcctgcttcttgtccttgttgatgaggtccacatcgttgattctcagcagccagtcattgaccctgagaaagggcacagccagttcagcacccacacaggctgtgggaccagcggctaccgcccacaactctcactcagggggctgactgccaaggagtgggtgcctcacatacacgctcagaaaatctcctcttgcaggagtgcacagtggtgaaatttgcaaatgctgaggttagacagcctgggttcaaatcctggccctaccacttactagttgtatgacctagcccctccaggcctcagcgtcttcatatgtaaaatgggggcaataatcacgcctaccttgtaggattgtaaagattaatcaattaatttctataaagtgcttaaaccagtactcagcaaatagcactgtaatagtgttagctattttatcatcatgactatttccctgaatgagcatgccatgtacatcctgggctctcacgcataccccttgagcactttcccacccaaaggagcaaaagacagtacctggtaactaaagaataatcagattcagaggcaactgagaagcactgtttctttcggagcattattagctgctgagactgcaggccttggacagactgtgtgtgagtctaaggctgggaaacgttcacctaagtgctacctggctctcttcgggtcctctgcactgggaagaagggccccaccttgcctccagagcctgggcctcaactcttaccttaagcggccatcagcaatgcttcctttgtccactttagtgacaaatatgccacagtcccccgggaaacaaggctcattcacaccttctgccatatcaaaccccagtgccttcaagtcaatatcctcctgcaaaaacagcagcaacagcaacgcatttcacaaagcagtgacagagacatttggctcttaagccccgaagctgcccactccaatgtgggggactgtcccttcacctcatctgataagacactccatccccaggatggaaacctatgagtatctgcaacctgccccttctggccactgcagacagacatccctgtcagcgtcctccgaggaccctgcccttccccagctgcaacccagcctggacagctgctgggaaaggatgcctcacactcctgggaggaaaaggagaacctccaaacttggagtggtgaaactgggagatactgcaagcgggtcaccgtctcctccttcatccatcagagaaggagagaagaaccatcagaggcagcttaccgtctccctctcgaactctacaacttccgtttcccactccatggaatccgtgtcaatggccgagtcgtgggagctgtgggccatcagctgtcggaaccgggcctccttttccaactgggattccatctgttccctgtgaacagagagagccacggtgacagccccttgggaggtgaaacatcccaccgcgtaacggctctgaacctcacgaggcaggccatttgaaacagctaaaatgggttcctttcccccttgtttcccaataactcagagtcaggtcaaggctgctgggatatctgtgagttttcacagtggttttttaaaaaagacaaattctccccaaatttatctagaggtttaacacaattaaaatcaaaatgccagctgggcacagtggttcatgcctgtaatcccagcactttgggaggccgagacaggcagatcaccagaagtcaggagtttgagaccagcctgaccgacatggtgaaacctcgtctctactaaaaatacaaaaattagccgggcgtggtggcatgtgcctgtaacctcggctactcaggaggcaggagaattacttgaatcagggaggcagaggttgcagggagtggaggtcacaccgctgcactccagcctggcgacagagtgaaactccatctcaaaaaaaaaataaaatttaatttaaaaaataaaatcaaaatgccaacaagatttttgtagatatagacggctattctaaaatgtatacaaaaaggcatcagaatcactaaaactattttgaaaatgactaaagtgggaggaaactctctacccaatttaagacttagtatacagctacagcaatcaagactgtgtgctgctgtcagggagacagacacacaggtctgtagaacagaataaggaacctaggaatgccccaagtcaccaaaggtgcataagttaacagaggaaggacagcctccaactaatgatgctggagcgactgcacatccatggccaaagaaatgtatctcaacctaaaccacttaacctcggataaaagttaacgccaactatatcacaaattgaaatgcaaactgacagaagcagcaacagaaataccacttaaatagttatattaggatgaagatgtagttcttaacatttcctttaatgccattgttacaattttaaaaaatgttcactgatggccggatgcggaggctcacgcctgtaatcccagcacttcaggaggcagaggtaagtggatcacttgaggtcaggggttcaagaccagcctggccaacatggtaaaaccccgtctctaccaaaaatacaaaaattagccaggtgtggtaacatgcacctgtaatcccagctactcaggaggctgaggtacaagaatcacctgaacccaggaagcagaggttgcagtaagcaaagactataccactgcactctagcctgggcatctcaaaaaaaaaaatttgatagatttgacttcatcaaaattataaatattagctcagagaaagacctagtaatgaagatgtgaaagagagactcagaagcctcgttatatcctcaggtgacttgcctgtgacacccttcctgaaatctgggcccaggctgccttgccagctcatgaacactgcccactgggctcctgacctacttgtgtttcctgctccagcagacaggccccagggccgcacctttgcctaggctgtgctctcaccagccagctctagaatgccactcagcctccagggcagagctccaatgccttccaacactgccccagcccctccccaggccagtgcagctgagctcagcattcattgctcactatacctgtctcatctggcattaccagggagtgcctgaggcttcccaggcagcaacacagaccccctcaccagcatcctgccagttagagaacttagcagacaggaggcacaaatgcaaacatgctgaatgaacacacaagctgaatgcacaagcttcaggcaactctggcccaaacaagaggcaaaatgtcccatgttcacggccagagattctaggctttcccttcgaagagaaccccttgattccatcacattgctagacccaagatggttcctgtgaagagtcttgccttgcctcttaacccctataatattcctgagagcacccaagctccagagagtctgggtttttatagaataaatggagctctttgtctcattaggaattttactgaatgggaaagaagagaagctgtcactcccttctgacgggcagcacttgagtgtgcaaggcttgcacacttgcactcacacacgagcttctcactgccccctcaccacactaacagctagggaaatgtcgcacaatggatggagagccactgctttcctactagatttgggttttagaccacggcctattgggctctgccaatttctatgcttaaaccctgatctttgtatttcaatgcactactaaaggccactgagtgtttaaatgacaccctgggaggctgctgtaatcgaggggaggatgtctgacaccccaaatggtcttccaaatggacgtccaaataacacaagcagaacagactgctggatgggggttgcaattgcctttaaaactctaatcacaatctgtcgtcatcttactcatttacgtacttgtctcttagatggacctgaccttggtctgtgtctcttcctgcgcactgtgagcccatgaggaaagggacttggtatgcttgtcagtgccatttctccagtgcctctaatggaggctggcccatacagagcaggtacttaaaaaatctctgcgagtgagtgagtgagtgagtgagtgagtgagtaggggaatgaatgaatggataacacatgcatgcctgccccagatggactgcttgggaacagggtcctcccttcctagtgccttggcacatggtgcctgccctgtgtctaagaatttttggcctaagaatttctaattaaccctacatggagatgacattcgaacccattctacacactgacagagtaaggcagagtgaagtgaagggacaaacagccagctcgacgcagaaggatgaggccctggccaatgcactcagcattgccttgcccagaagggagaggggccccaggctcccagatgcatgcccactccagcgggtgcccacccgagcctacttgagctccttcagctcgcggctgacatcattcttctgcttgcgggtgtcatccaggctgcgcagggcctcagccagctcgctcaccgcacggtcccgctcccgcctcaggttgtcacacagtgtcctggtggaaggagcagaggacaaggtcatctcaagaggcatggggaagggggttcctggtctgcagcggatggtctggccacctcactccaaatacctgccggcacctatcccatccccagatgcacaggaacacttgggaatctaggggtaagaccacctaggccagccccagtgcatgacagagggaatgtggaggacctgggcagggaagagacacccccacagtcacccggcaacaagtgtcaggttcccaatgccctgtttcaccctcaatgtgcctggggttaaggaccaccctctgcacacactcactgttctaatgccaacttggggagccagggggtggctctcctctgcatgaagcaccccccacctgcctggcaggcctgtgctccagcactaccacatgtctcatatctacccacaggcagagctttctagagctgtccctgtaccctgcaactaggaagggagccccttcggataccagccagtcctcatgcatctctgtctctattagctctgtgcaggtgcaaagtacaagcttggcaagactctatgaaagaggaccccaaggaggtggaaacagattacctggctgtggaggggcctgggctctgtgccacctccagaaatggacatacccagaggactggttcctacctctccacagcctcgaatctcccccagcctcagtcagagcctggctgaggactgccccctggagacacccgtggaaggggtctgagcagaagcagacaggaagcagcccctgggcctccctccccttgcactgggcacctaactgtgctctccattagcagggcctcaccacctagccatcctcatctcctgaccagcccctagagacattggtctctcccctgacaaaccacaagaaatcttttggacacctcccaaatagcaagacattatctctccccaccccaaacatcaccaccaccatagcctctcctggttcctccccagccaaggatcaagcccacactgcttggcttccctttcaaggcctctacacctgcccctgggaatctcgccagcctgccctccccacgacttgcccacgtccctgccctgagcacactccacaggtgccctccatctgcaatgcccttcccccttttccacctggaaaaaccccactcatgcttccagttctagtgcgaatgccacactctctggggagacctccccacaccccagggagccctgcatgccccccacagccctagagctcagttacacatcttcctccctcactgccgtgcctgaccaagcctctcccaaggtctccttgctccagagatctaagaccctggcacacagtaggcgcccggtgaatactgctgaaaggacacacttcggatgtgctcttctcatcagaaaccctcaaataaaagaggtcggcctcgtgccccttcacagcggtctcacgtggacatagtacacacttgggacacctagggctgagtgagatgggagggagaaacaatggaaaattctaaaactaagaggcaaggctagggcatcaactaggggtgagaaaggaggagcccaggtccctcccactttacctggacatacagtaaatgattccgaccctcccaacagaccctagcaggtcccctcatcctggggagacgcaagcccacgccagcttgaggtcaccccataccggatgctgtcacgctctgctacaatcttgtctcgctcctggaaggcccagtcccgccggcacttggccacatccgcctcctggagggcttccttcagctcctggcacagagccttgcactgctttcgaaggatttcaacctccttgttggctctcccagcatccattgtcaccgtgtctttgatctggtgggagcaaggggcaggaagagggagaggttgctgagcctcatggaccaggagcgcctcccaccagtgcgggggccaaggctgaggctctagggagctggatggagggaaacacggagcccatcgcagcacaccccatacccccagtgactgcaccccacagccacggtcctattaaccagcaccccctagcccccgccatgtctgtgatcctataatctggcatactgagttatttttaaagacaaaaatacaccagtattcctgctggtgaagtgctgtgtatctcagttcatttaaaaagctgaaatccaaagcatttgcatcttgacacatccctagagagttatatgctccactaaaatttcaagtcaaactcttagtagcactcatatgaaaaccccctccacacctctataatccttagacaacacagggaaatgacggatgacaaagcaagtgtttactgcaagaataactcctcctcccgcttgaggctttccaaacatgcaaaagagaagcacgacagcagaggcgctgatgacactggtgtccccgccccgagactctccacccccaagtgctaggacacaggaagacacacacgcacaggaagaaagcttccgttccctctaaagatcattctccagacagcaggagacagcagcctctacaaaaatgtgttcagaaagatctcagacgtagaaaacaagagaagagaatgaagttgacaagaaaacacctggagtcagttgataattcccctcatctctgaaaacagaggcagaggagctgaaaaataatttgcacaaaaaggaccatcaaaactcgagggtgacagtgcagtggcaggctttcctcagacctcacggtttctgggggtcattcaaatcatttcagttttgatttttttttcagctttacatggtatgctgtgtttgtttagtttgctattttcaaaaaaaaaaatccttcttaaattttcattttaaaaagaattatttgggggcagggtacagtggctcacacctgtaatcccagcactttgggaggccaaggcaggcagatcacatgagatcaggagtttgagaccagcctgaccaacatggtaaaaccccatctctactaaaactacaaaaattagccagacatggtggcatgtgcctgtggtcccagctacatgggagactgaggcaggagaattgcttgaacttgggagactgaggtctcagtgagcccagatggcgccactgcactccagcctggacaacagagggagactcggtctcaaaaaaaaaaaaaaaaaaaaaaaaaaagtgtattaatttagtcaagaatttatgataaacaatactttgaaaaatttacattatatttgctgttttacaatatatttatggatagttttagagctgacacgttaccacgtggattccctgaaaggtttctccatggtgctctagatgagcatctaggagggaggccccaggtgcagacaggacgacaggcagcgcaggaggtgggcagctcccccagcccacagctcccttcctttccctgggccccacaccattgctggtatccaaaatgaattcatccccaaaatactgcttccttataaggaatacaagaagtactatacttagttttagtgagaggggagagggaaatgaggtaccttaaacaaatggtaaaatttggaagcccagaggacccaagtgacggactgactgattctgattacactggtgaggaaccgcaggatctagaagtgactcgccagggctcccccatcctgcagagctgatcagtactggctcctctaccccaggctgcctcggcatcagatgtcagtctgagtctgctctaaaagcgccacctgcagtctctttcttcctgtgctgggtgaacaaaggcgtgggaagagatgggctagtcttcacaagacacttgccagacccaggcatgaggccagtgagaaaggcctatgggctgcaacccagccccagagggccagagcccactcgagagtcccaggggaggatggggcccgagtgtggagtggtgcccctgagcagatggctctcgggtgagggcacctccctctgcttcctgggaagcttctcttgctacaacagccctctgcctctaagttctggaaaggccactgctgccttgccttgtcccctggcactgtccagtctatccaccacagctgagctcagctcctcaagcaggacctgtagctgcatgtgtaactgcattcagggcagcagacggcaggagcatggggggctgcccttctacagacggaactcggtgagcagggcccgtctaggaaagtgcgttggaacctgggagatttctgcaacagacagcagtggcctacagcttccagtggtgccgacctcaactccccaggcagttcctccctcctcctgggagcaatgagacttccccggacaaggtcagctactggcctgaggcaggagggcggccttaggggagctcccgaggatatctctcccctgggagctgggaagaagaaggcgagggaggcaagggcacagccaacctggcaaagatcctgacaggcccccggcctccccatgctacctctttgctccctctttgcctcagcccactcagaacacagaagggagagagggcatagagaaggaaaggggaaaatggagcaagacgtgcagatagaagacagaagcgtgcaagcacgatgccagaaactgaagcccagccctcgggctgagcaagatgaagatggctctgcggtgagggagctagacctgccagaaggccccccacagctgacccctgacaggcagcagccagtggggtggcggggccaatccccagggtgcctcactgcccacccctcctggtctgctcttgccggtggagagtgctctcttatccatgaagccagaccaacttgagaaggagctgaggatttcagctctcagagctgatggggcagccgcgggggctctctcctgcctgctgactcggaacagggcctggaaaagatccctgcctcagctgacaggtgcacttgatgcccagtcaacaccccctgtggaggatggaggcgggctccaggctgaatggctcgcctgagtgctgggaatgcggtggttgccgcaaggacgtcaggcctggaggtctcattgctggacgccagcaccacagggaactcaggtgttctttgtgcatctctgtgctttctatatttctacaaacagtcttcacgattaacttcaaagatctcaaaacttggccaggcgcagtggttcaggcctgtaatcctagcactttgggaggccaaggtgggtggatcacctgaggtcaggaattcgagactagcctggccaacagagcgaaaccccgtctctactaaaaatacaaaaattagctgggcgtactggcaagtgtctataatcccagctactcaggaggctgaggcaagaggatcgctggaacccggcaggtggaggttgtagtgagccgagatcgtgccacttcactccagcctgggcaaaagagggaaaccacatctcaaaaaaagaaagaaagaaaaaagaaaatctcaaaactccatccacacgggctcgctgttattccccaggcgtgtgtctgacattctgtgacatttcagagcagttactgactcggtcattttccaagtttccttcttcatcattttgttttccttatttgatattgacattttccccaaaaaattatgtgctcagataccaggatgtgaacatgagttcacggtttttctaggatgattaccaaattctaatgcattatctttacttattaaaaatttattctaataagcttttcaaaaatttcattgcagtaaatatttctcttcacactggcttttgcctcaagggtctggagaagtcttggtggttccttgtatgaaattcccattacttggctggcccatttttacccacagaaacagtttaatgaggttcaccctaatcctaacagaggagtaagattcagacgggcataataatgaatgcccatctcaactcactgttgctttgtgcaggcacaatgatgtattttctatattgaatcatttgttcatcatgaccaccattccattgtgcaaatgaagaaactaaggctggctgggtgcaggggctcacgcctgtaatcctagcactttgggaggctgaggcaggaggatcgcttgagcccaggagtttaagaccagcctgggcaacatagtgagaccgcatcactacaaaaaaattaagaattagctgggtgagctggtgctcgcctatagtcccagctacttggggggtctgaggtgggagcatcacttgagcccaagaggtcgagattacagtgagctatgattgtgccactgcactccagcctggggaacagagaggctgtctcaataaaaaaataaaaaataaattaaaaatagaaactgaggcccagaggccaggcacagtggctcaccaggcggtgaattatacttgtaatcccagtactttgggaggccgaggcggaaggatcgcttgagtccaggagttcgagaccagcctggccaacatggcaaagccacgtctctagtaaaaatacaaaaaattagccgggcgtggtggcacatgcctgtaatcccagctacttgggaggctgaggcacgagaattgcttgaacccaggaggtagaggttgcagtgagccgagattgcgccactgcacttcaggctgggcaacacgagactcagtctcataaaaaaaaagaaagaaagaaacggaggcctagagaggttcgagaccacatgactgaggagggccatctcccagcaaggggcctgtgtctcatgcattccccacatcccctaccactgcccaggcctgacgaggagttgctgtcggttgaaagacatgctggtcaccccctgggcatcacctgcctcacacttggtacagcaggacctggtagtaatgatccaatgcataccagccctgccaatctgcctgacctttaaacgccttgctttttgcttctcataaaccacctttgaaagctgcattctaactgacctgcacagaaaggcagaatagagggatgtgaatatctgagaactattctgataggaaaaaaatctgctgtgatcaagtctagaagctctaatcagagccacacacaacacagactgaagggaatctccatgggcccatccaagcccccgcagggctcagctagacctagggcaaggagctccgcgatgaggagaggttgacaggtaggaaggagacagaaaatccacattggccacccaggagttgagctaggtggcccaatctagtgctaccaaacatcccagccccccaaccctggaggtgtggcccccagagagcaaggctttaggagaagaatgttgggctcagcctactagcacatcttcccagcaggagcctgaaatactttttcaagagcagactcgtgagatgcacactgctggtgaaaaagggcccctgagggtgctcttccagacacaagaggcctaacgtatctatggctttgggaacttggccttggtatcttgcttcataataagcaagtccttgagatatcactgacttcagcatgggactgatctgcaattacgtagcaatgggtttgggtgtgagtgttggtgtgtaagctccgggcagccatgactgtgtctgggtctccctcccgccttgtcccctgtaatccagactagagctgggcattaagcatgagctcaggcagtgtctgataacccagcttgcacttaggcctccagtgagaagccatttactccaactcaggaggcttctaatccggacaccacgcactctgcagcccctcttcccgggatgctgtaggagaggctgaaagccagccaccggcccacccacctacctgccgcagcgcctccatctcctcattggccgccttcttctcagatgtgctgctcttgagcttggactcggccagctccacttcggtctgcagcttgtccagctcagagatgacctggtcacgctcactcatgatgagcttgtactcgctgtacacagcgtcccgctcctccctgtatttctccgactcctttgctgtcttcacctgcgtggttctcagctcggtcagctctgactgcagcagctccatctcccactgcaggtccttgttctgcgccgtggccttgttcagctcatggtggatcgcctcaaacctggcaagagaggtggcgagatgtgggaagggcgggggccctgcccggtcagtggccggctgcgctgctgcctcccgccagctctactgtgctggacagtcaagcgtgaagtttcaagtgaagtcactctctccacccccaggagagaaaagtcatggagtaccagtgcccccggacctggaatttttctcagccctttacaaatgccaggagttgaactgaggacttcatgccctccactccactagaaacaacagcatatttctcccacagtcaagccacattaattttttaaaataataaaaacaaaacaatgccaggataacagcataaagaggccttaacgatcatttagtcaaaccgcctcatttcacagatacgaacagtacagccctgtgacaaggtcatcaagttcgctcgaagagcacagctctgtccttccaggccgggggacatcttccacacaggcagcctgcaaatcagagcccatggctccagaccagcaattctcagtgtgctccatagacaccggttctgcatggagctccattacccccaaaaaagtatattatctgatgacttatgtttgggaaactctgcatcttggccccctcttggagagtctgtctactgcacaacaccacgctgaaggctctgagaagtcctgcagcagagacatctgtctgggttcaacctggcaatgctcaaacctatttatccccaaagagcacttttcatgtgaaactgctacatgccccagagaactggtgattcacaggcacatcctctacaaaacactgtttgagggcatatatcacatctctaaagatgacagaagacacatgccccagataattaactttcctatttgctaggtgggtgactgccacagaggggagaggcacatgacagtgaccaaagaaacaggatgctcagaacacaccagtatttattaagtattgtgcagagcagttaacacagcagacccgagatttctacacgctcagaaaggcccgcttgcaaggctaaccactgaatggtgtccgtgaacccgaaggtaaacagggatgttcagatgggaagagggagccacgattcccaagacacattcagtgtcaaaaaaaaatgtttcctggtcagaagcattttttgattgaaaaagcacaataactcatgctgttctcatcccctggtggtggctgggaaccttataggacccatttgcccccggcccccgatggccctagccctacctcctcagggagagggcgcactggtgctgcagctggatggccgtgtccctctgctgggtcagcatctctgtctgcttcagcaaccgctggttctcctcccccagctgctccaggcggctcaggtctgcattgtggatggcgactttctcactgtacctcttccgaagggcgtcatagtccttcttgaccacctccaacttgtccatggccgtgtcatacagtttgttgagaatctcggatgacccgttgtgcttcaacacctggagaccagacagtttcacttaccaagggtctgtgggaggtggcggaggagacctcccactctcacttttgtctatctgagggtgagactgatgacaaggcggttggggggagggggttaccctaaagcttttgagagtcttgaggtccaattctccaggccctgcagtcacactgggctgattcatttagattcactcagtcacaactatttactaagtattgtgcagaacagttaacacagctgacctgagacttctatatccttagaaaggcctgcttgcaaggttgaccctaccgaatggcgtctaggaacccgaacagtaaacagttctctaggctgatgtaaaacttttcttctggtgatataagcagctctggtactgagcctgtacaaataaagtggcttatgctgaacacctgctttctactgggagtccagaatctgggtacatggcaggcagaagttcctacatgaccagcccccaataagacacttgagcactgagtctctaatgggcctccgtggaggccagcacttcttgtgtgttgttgtgattccatgctggaggaattaagtgcctccggtgaaactccaccaggagaggattcttggaaactcaggcccagtttcccctggactttgcctcacgcgcctttccccctttgccgactttgctctgtgtacttttgttgtaataaatgtcagccattgagtataattacatactgaatcttttgagtcctcccagaaagtgacatagcccagaatcaggttatgtaaatcggacctaaagactctcaaaagccctagggtgaccctccatggtgtagggtccccccgcatcccatgcaagtacctaatatgtctagcactggtctaggggctggtgatgccagacaggacagaaagacgctgtgccctgtgggccttttatcctaatttggagggtgtggacacacagataggccaaataaagtaacttcagagcaaggtaagaactatcaagaaaataaaaaataaaacagaataatgggctggagagagccatctgagcagcagagtggaggtctgtgagggaggctaaggctgaagaggcttcttgaagaaggcgacttcagaggcaaatgaagaagagcagcgagagcacactgggcagagaggggggcagggtcaaaggcccagaggcagggcctgcaggcgtgttctagagacagagaggggcaaggcggagtagcaagagcccaatgcacagggggaggtgggttcaaaggggacctggagaagtgggtgtgggcatgggggtggccatggccgcaggcctcacagtgaagactgtctcctgagtgagacaggaagctgtggagggttttaagctagacagcattctactctaaatgacaggcactaaagttcatttggggtgctgttatagagaaaaaaacaaaccaagaagatgagttaagaggttgccaggggggctgctggctttggctaagcacctcatgggatctgagccctggggtgagtcactccacctctctgggtttcagcttccggattcctcaaatgcccaggctagaccaggaaagcttgtctggcccttccagctccaacagccgaggaatcacctggctcattcagtggcagcctggtttatcaagcgtttgcagcctagagaaccagaagctgggacgatggaacactccctttggaattagggtcagctctcaataaacacgaaaaacacaaaaagcaaaagagggcttaatttaaaagtcagaatcatagcaacaagaaagtaaggtcttcctctaagacctaagcattagattctaggactgtagactcttaaagaggaagtcaaggaagagggagaaatggagggaaggagggaagaagggaaggaaggaaggaaggggaggagaaagagaaagagagagaaagaaagggaaaggagggagggagagagggagggaggattggttcatttcaggctcattctttttcctttatttatttttaaagcagaacattttctttcaagggaaatcttactagtacaccaaaaatacagaacttattttaaaaagcagtacacaggtatctcaggcagtcaaaatcttcactgttttgtaaaatggcatcactgttgcaaaacaggaatgcacactgagaaacagaacctcactgacagtgcccactctacatctaaaatctttctttaaaaaaaaaaaaaaaaaaaaaaagccctggccaggcacagtggcacatgcctgtaatcccagcactttgggaagccgaggtaggcggatcacctgaggtcaggagtttgagaccagcctgaccaacatggtgaaaccttgtctctactaaacatacaaaaattagctgggcgtggtggcgggcacctgtaatcccagctactcgggaggctgaggcaggagaattgcttgaacccaggatgcggaggtggcagtgagccgagatcacgccatggcactccagcctgggtgacaagcgcgagacttcgtctcaaaaaaaagacgaagaatgggctcaccatgactatactgggtcagtgaaggacagtcctgacatctggtcaaccaacgccttctacccacatctggaaaggtccagcatctaaactggattgccctgattggtgagcaatacctcaaaaatgccaattaaaaattacttcaggccgggcgcagtggctcacgcctgtaatcccagcactttgggaggccgaggtgagcagatcacaagattggaagttccagaccagcctggctaacatggtgaaaccctgtctctactaaaaatacaaaaattagccgggtgtggtggcaggcacctggaatccctgctactccggaggctgaggcaggagaattacttgaacccaggaggcgtaggttgcagtgagccaagactgtgccactgcaccccagccttggcgacagagaaatattctgtctcaaaaaaaaaaattacctcaaatgttttactgtctaaacatcccctaagccaagtgagaaccccattggctccaaatgagtctgctttgctggggaacaaaggaggctgtcattgcctgagttccccacaaggtggcagccgcggggagacgagccaacgctctcctgcagcggcttcccgccttcccagctcagaaacaaactcattccaaaggcagccttgaaatgacacaaagcccggttctgggtggtagcccgcagagcccacctccacaagtgctcggcagaatcaggagtctataccatggtttggcctctttgcagtcccctgaatggctaaccttgaggggcctggatccgggcctgtgtgacaatccagggatgattcagggccgtgtgaatcaggctgccagcaagggccgtgagagtgggccacgaattcccagtgcgacagggtgggtcacagacctcgaggtcctttcagctgctccccccagccttcataacatggtaggatcctcgggtcagaagaccgagagagagagatcaggccccgtactgcttgcttccaccacgatgacggccaccctcggcctgctccacaagtgaaagctccttgggatagggtcgtgctcaccgggagctactccgcctccctgcaactcctaacctctggttctcactctagccttggagtcaaacagaataacctgttcccacagggcagcatccagatactcaaagaggctcgcaggccccaaacacttctcaccctttctctacaaacaggactcagtgccaggcctgtactatgtaaccaacagcctctgaacaaagctggggaaccaggtcatggttaactccggagaatccaaaaaactaaatctattggtctagaatttttccctctcgccatcagaggattatgttcttggtaggtatttccacatgcacatgcacacacgagtgcgcacacacacacacacacctaactacagtcaaatgtttagcttcccagcaaaagctaatgaagagagaatatttaaatttggcccagaattctaaaattaaagtgatcacagttcactgcaacctcaacctcccaggctcaagtgatcctcctgcctccgcctcccaagtagctgggaccacagacacgccccaccacacctggctgattttttattttttgtagagatgggggtctcactatgttgcccaggctggtcttgaactcctagactcaagtgatacacccactttggcttcccaaagtgctaagattacaggcgtgagccctgagcctggcctgagagtcaacttttccactcaggcaggcagcagtctttagagatgatgtccctccagcctgagcacgggacagttggcctgtgagttcaaggggcttaggagaaatgggtggaagttgcacaggggaggcacaaagacagccacagtctaagctgttccctgcagggaggccaggaagagaccaaccctcctacctgtaccctacattggtcagaacactcctctgtgggcttctctgtaagggatgcccttcagcaaccaggaaacccctctcctctcttccttcctccaggcccatcaaagggcattcattcaggatacctgggacaagaaaatcaactttcatgaattacaagagaaagtatattttaaagacaggggaaagggcaaggaggaggagagagaagactctcggggcctgagaggtttcccaaatagattagcaggacctaggagaacatgtgcactgccctggtcccaggaattctacctgtaaggctcaaacttcaaaacatgtgtgcaaaagaacacaaagacatgtgtgtccactgaaacatggtttgtaacatgggaagatgttgaccaccaagacgctccacacagaattcgattaacacctgacagacaacaaaacaagcaaggacctttttgtatgtgcaaattcacagaaaatgtaaggaaacccatgatatattgtaggatttttttttaaagcaggtttcagggaataaaaattaaactatatgggtattaaatgtgacattaaaaaaaaaatctacaaggatacacatccatcccaatggtttacacagaggatggtcatttccacaaagctaggctggatctgagtaggtgggtggctgcccacattggttgaagattttttttctattttaactaaagaatacacactattttagtaaagaaaaaagatgcaaaaacaccctctacttagattccccaaccaagccttgtcagggtcttctgggcattcttgacacagcctagaagaatccaagaaggtgcactcggactgcccaaacccagagatggggatgccaggcagaggccctccccagcaaaacacacatatggacaaaacacctgtgtgctgctctcaaccatggcgccccctcccctagggctgcctcatttcctctgagataaatcatgcagagggccgggaagccccacaaatccctcaagcaaacactcaagtcaaacagcaccatttaccctgcaagggcctcttcaagtttacaaggcgtgggaggaacccggcaacaaaactgcccttgtccagagaggttgacctttgcccttgggcccagcggggagcaagcctgtggccatccccttatccccgcttcctctgctgctggcctactgccacctgagcatcccacagccaggcatccactccacgcctgatgaaggcaagggggcccaggatgccaggacgcggggctggtcgcccagcagctctgagatgctcccagccctgctccctgtggcagccaggcctcttctcctggtggggtctggaggtggtgtttgctgagaggcactggtccagctgaactgacctgggggaccccaatgaccaggatgcatccccacccccgcccctgctgccaaggaccacaacggtaggaaaaggagagcagggaatgggctgcaaggtgggggaagaagaccctcccctgtgaggcagacaggaaagggagagggggacaggggtgggagggagacctcagtctgaatgtctgtaaagctgagcaggtgctcaagaaagtcagagaacgggagacaaggaaactttacgcttcttgagggcagagtgctccttctaaaaaaataatattttcaattaaacaatttcttgtagagatagtctatgttgcccaggctgatcttggactcctggaatcaagggatcctcctgctccttccaaagtgctgggattacaggtgtgagccactgtacccagactggatttctctatttatgacaaggtgaaattctgagtctttttttttcctctctgagttataatttacataccacacaaagtatgcaattcagtgtttaatatattcacaaggttatgaatccacaaagttgtgcagccactaccactatctaattccagaacatttttatcaccccaaaaagaaaccaatacccatcagcagtcacttcccaaaccccaagcccaagacagccacaaatctgctttgtgtctacatagatttccctgttgtggacatttcatgtacctggaatcatagtttgtggtctttttgctggtttctttcattggctgtcatgtttttgaagttcatccacactatagcatggatcagtactgcattccttgttatgctgaataatattccattgtatggatagatcacattttatttatccattcatcggtcagtagacctttgggttgttaccggttttgggctgctatgaatattcacacctcaagtttctgtgtggacgtatattttcagttctcctggacacctaggagtgtcgctgggaggtcacctgttagctctgtttagttttttgaggaatcactaggctgcctttcacagtggctgtatcatttattcccaccaacaacatatgcaggtcccaatttctacacatcctggatgaggcagatttaaacccagacttgacaggattagaataatatcattaacgaccacaacactgactgagcgcctcatacacacgggcacgcggcgccagtgccttctacgcagtgtcttcatgacagccatacagaccaattctcctacactgagatgtgccaacctcgtgctttctagcaaggctgtggggcttcccttggaccgaggtggagccacatacacctctgaaatgatgattctctcaaggaagtatagaatccaaactaaaccccaaggcaaaaggttacctgagccaagcgtagaccaagaagaacaaactgccggcaggcaaaacagcaagaaaacaaagcacacagcagggtgtaggtaaaggccgggagaggccgcctgccctcaggtgggggaagttaccacgcaccccagggcagagaaggggctcaaacccttagagggccatcccctcgggcagcttcctgggagctttgttttgacacagcaccgccatccttacctgcttcacacgcaagattcctccacaggatttcttttgaggttaaaaatatttttgcctctttagaaactgaaaacctacagtctttaaatctgtttgctccaggaagctccactgacatgcacaaggaagggtccctgcagggggaatgggttgtgggcagtactgaccagagctagcacggcactttctactctctcatttcatccttagagaaatgctccaagagcaccacccccacctcctgaatctataaagggtgggaagcatgttgtcacagcttctctgtgccatgcagcaggtgcgagaagggacagtcttcctgctgccggctttccattaccaaggctcagtcaagacctatgggctaaataccaacttttgccccagccactgggcctgacctcacacgaccaattcccctaatcagagggcacataaaaaatacttctaatagctccaagtatatccatcttagggtctcttgctgagcctgccctggttactccacataaaacctcaatcaatatcggagaaaggaaaataaacagcaactttttcaacagaagcaagtttttcaatggaatacagtttcattggaatatggaatactccttttatctaaacaattaaaccttaaagccattaggcaaagcagagcaagacaaggacctacactagggcaggtcgccccagaggggatatcacagctggcatggaaagaggagtgggtcctggcatggcatgaggagaccaggcctgacagagagaaggcatggggtggaagagcccacaaagggtcaggaggagatgggaacaggatgggggactgcagagggcatgggaggcagctacacatgggggattgaccaagtaaacaaattaagaataacaggaattggctgggtgtgatgactcacacctgtaatcccagcactttgggaggccaaggtgggtggatcatgaggtcaggagatcgagaccatcctggacaacatggtgaaaccctctctctactaaaaatacaaaaatcagccgggtatggtggcatgtgcctgtagtcccagctactaaggaggctgaggcaggagaatcacttgaacccaggacgcagaggttgcagtgagccaaaatcacactactgcactccagcctgggcgacagagcgaactctgtctcaaaaaaaataaataaataaaataacaggaatcacatttgtcactgtttgtttgtttgtttgtttgaggcagaatcttgctctgtcacccaggctggagtgcagtggcgcaatcttggctcaccgcatgctctgcctgccgggttcacgccattctcctgcctcagcctcccaagtagctgggactacaggtgcccaccaccacgcccggctaattttttgtatttttagtagagatggggtttcgccatgttaggatggtctcgatctcctgacctcgtgatctgcctgcctcggcctcccaaagtgctgggattacaggcgtgagccaccgcacccagccttgtcactgatgtttttaaaggaagttacaaaaataaaagaggtggaaaccaaaatgaacctgtggtcttggattagaattgaaaatgtcaatgcgaactcatggctttcaatctacctgtctgatatagaaatacagatatacatatgtgtatgtatgtatgtatatgtgcctgtgtgtatgtgtacacttagctactccctacttctttccactaagagggccgggaaacagtgccaacccaagctacaagcacatccagcaattggttggctgtgttttttttatcagagacagcgtctcactccttcgcccaagctggggtgcagtggcatgatcatagctcactataacctcagattcctgggctccaatgatcctcctgcctcaacctcctgagtagctaggactacaggtgtgccaccatgtccagctaattttttttttttttttgtagagatgggatcttgccatgttgcccaggctcatctcaagcaatctctcaccttggtcttccaaagcgctgggatcacagatgtgagccaacgtgcccggcccagcatttacttctcaatactattctccattaaaaggaatgaggactacttgggagaaatggccagtctccaggggctgggcctacctgctgctgctgggcacggaggtcaccgatctccttctggtcctcctcgtggagccgcttcatgtcctcccatgactgctgcagcaggtttcgctcccgcagcagctgcccattctcccgcctcagcatgtccacgtcatccttcagccgagtctggtcactcaggagccggctgtggagtgtgctgaaacacccggtacatgctcagtgagccccagccagcccctcacaccccgccccaccccagggcatcaccagcctcaggtcccaacacttcccgtagatacagcggacaggagccaatggcaggtaggtctgtagcactcagaggcaagccaaaacctgctaacagcccaattccagaaacatccaaatcaccacttacaaacctgacaccaaaaagggcacatgtatctccagggaagggagacaggcccctctggtacagacctagtgcctccaaatactggggcctggacagatatcagcaggtgggcaggcaaagaccctcagagggatgctgggagaccaaagggaaacaccccttgggcctaccctacaggaagaagctgcagtagggcccctggacagagacccagaggcctgcctgagccctgctgcatgttctgaatcactttcatgcctgccaggtctctgaagctggcaataagatgtgaaggattaatagccttgttttacacttaggaaaactgaggcccaaaggcacaaatccacctgctgtaggcagactgcttgctcttgcacagggacaggactagaaccagaacccctggctactaagtccagagaaaagaagggcaaaggcagctgtctgtgggtgttggaggccctggccaagcaggcctcactcactggtagaagtcagtctccttggccacctcctcacacctcttcaaggcgttggtgtgctggttctgcaggctctgcaggtccgacatggctcgcacgcactggatcttcagcctctcatagtcaggattcagcctgtggtagggcctggcccagagagcgaatggccccatgaacacaggccccaggattcacacggatagaggaaccaggtcctggattaggccagcccagtggttccccagtactggtcttctatgcaccacacacacctgggtgtttgttaaactcagatatcctggcctcactcagacccacagaatcagaatccctaggatggagggagccgtggttgcctgagctccctgcatgggcctggagagctaagaaggtgccaacttgttctgcaggagcttccaggagtctgtacaacaggtctgagtccaccagaaacctgtgatgaaatgtctcttctctgtaggctcggcgtgacagctcgtgcctgtaatcccagcactttgggaggctgaggcaggtggatcacttgaagccaggggtttgagaccagcctgagcaacatggtgaaaccccgcctccacaaaaaaaaatacaaaaattagcctggtgtggtggcatgtgcctgtagtcccagctactcaggaggctaacgtgggaggatcacttgagcccaggaggtcgaggatgcagtgagccgagatcacaccactgcactccagcctgggcaacagagaggatcctgtctcaaaaataattactaaataaataaataaataaataaaagtaaaatattaaagaaaagaaatttctcctctctttagaacaatgactctcaatcttgggtacacattaaaataccaatgcccaggtcaattacattagcatatctgaggataaaacccaaacgtgaggattttttaaaaactccccagggtattccaatgtgcaaccaaggttaagaacactggccatgagcagtgatctcagagtggggttcccagacctgcagcacagtatcacctgggaacttgtcacaaatagacattctcaggcctagccccagccccagccctcctgagtcaggtgttctgaagggagggaaagagaggcaatgatctgtgcattaacaagctctgtggatgattctggtgcatgctcaagtttgaggaccctttttctagagcagaggtcagcaaactttttttgcaaaaggccacacagtaaatactttaggctttgcacactacatagtttctgttgcaaccactcgactccacctttgtagcaggaaagcagtcatagacactttgtaaccaatgagcatggctgtgttccaataaaacttcatttataaaacaggcagtgggcccgtgggccatagtgtgccaactctcatgtgctagcacatccacgtcttcactcatcctgccttcgggccaactgactgaggggcatatcctcatgaatacaagctcagggatcaggctctgcagctctggcataatcccagaggcacaaagtgcagaggcatagacccttactcctgaaggaaagaggtgaaactgaagtgtttacaccaagcccccctcccctccagacctctaccagcatgggagctaaaggataaaccactctctggccctcctccttcccagaaagtcctcttagatcatgcaggtagataaagactctctctgccccaccctatgggccacccttccctggtatctacctctaaatcacaacaaaagcagcaaacattttcttcaaagcaacaaagacaccaggtacaatgtgctctgtttaaaacacatcatgtggggccagacactgtggctcacgcctgtaattccagcactctgggaggccaaggcaggaggatcactggagcctagaagcccaagaccagcctgggcaaaaaagaaagaccctgctgctacaaaaaaattaaaaaaaaaaaattagttgggcatggtggcacacacctatagtcccagctacttggaaggctgaggtgggaggttcacttgagccggggaggtcaaaactgcattgaaccatgattgtgccactgcattctagcccaggcaacagagcaagaccccgtctcaaaaaacaaataaaacacatgtgtgacagggaacaattaatatgtttaccaaccacataaagcttcactcaacttaggcaggtctaggagacagtggtagggacacacacacacacacacacacacacgagctgactttgcacacaagcacaccactatcaggggccttgccacatgtgggatggggacctgccccacaagaagcctgtgggtcctgcccctgggaagcatttctggacatgaggtgggggaaaggggacactcaggcagcgcagcctggacccccaggagccaggggtgtttgggggtgacagcaccagcatcggggtagtaatcccaaccatggggcctgggcaggggagacggcgcaattactacctcttgtcaaaggccgtgccatgcgtagcaaaggccaggcgcttgcggagctcgtttctctcccgggtcatcagccgcagctgaatggagaggttctccaccttctcattcacttgctggtcagtgaggaggggtggtggggacggcgccttcccggtagtgcctgtggaaggggaataataaagtgaacttgtgttcatctggcattcacgaggcgcccggtgctgtcctgagctgttggcttgtgttagctattcgtgacccaacaagtgggtcctcttagcattcccctttcacagatgagaacactgagccacagacggtagcaggtagaactgaaagtgagtgcagggcatctggctccagcatccaagcactcaacaacccccagtaaccaccccagcaaggaccctgaagacgcgcactctctccccaacctggctttcacacctccaggatgcgactgttttggccgtgatccttgcatcctcccctggtttggaaatatcagctgttacccaccactaagcctggcacatggagcaggacagaccaacctgtgccctgaggagagtggaaggcatggctcgaggagaaaggcacacctgaaatccaatgacgctactaaggaccagggcagctggggcccaagggccgtgtccccgccctcctcgaccagggctggacagtgcacggctccctttttgcaagccgtccacccgcctgaaagacctgcccaaccagcccaggcgtgcaggctaagaggagggctgctggctcccagctgaggtcagtgtgacgcaattcaagttggtcctgatgcctccaggctacttaaccctcaccagccctcatcaaccaccctaggactgagtgtcctacagggagccccacaccttatgctcctagcaggcaacagccaccgctgccaccaccacctctgataagatccaaatccatctctaggaagaaagcacctcatcccaggagaagagactaatccatggtgcttttatattgaaccctgtcaatatgtctacctgatatctcaatcaacccttagagacccttgttggggtcagaggagctcacagcaaccatccaatttgtggatgggatctggcaggctgactcgtgtcaggggacacagtgtctgttccgcactggacccacaacgcacaaagggcataggacatgataggtcttctgattctctgtgctgtcctgaccacccctgtcccactgatccttgttggtcaaatgttcatgcaaaccaagagtcccccaacccaagacaaaagcagtggcttggggccttccagaagggccagggaggatagggagctcagggccaggcatgacaagccagaccacagtgggaggaggatcctcaactcccagtgctgtgcttttcagtcttttcaggttgtggaaccccaaccacttgactccagcaccccctgaaatgcacgacagtcatgtgccacataacaacgtttcagtcaatgatggtggaccacatgtaggatgtggtcccataagattataatagagttagaaacaaaagaaatatgtattaaaaaaaaaagattaaatcacatctctacaaaaaatacaaaaattagccaagagtggtggctcatgcctgtaatccaagcactctgggaggccaaggcagacggatcccttgagctcaggagtttgagaccagcctgggcaacatggcgaaaccccgtctctagcaaaaaataccaaaaaattagctgggtgtggtggcacgtgcctagagtcacagctacttgggaggctgaggtgggaggatcgcctgagcccaggacgtcaaggctgcagtgagccgagatcacaccactgtattccagcctgggtgacaaagcaagaacttctctctaaaaaaaataaattaaaagattaccatggagatgaaaaattcctgtcacctaatgacgtcttgttgatcctgaccctctgtagccctaggctaatatatgaatatatttgtgtcttagtttttaacaaaaaaagtacaaaaaaattaaacatttttaaaatagaaaaagcctatagaataaggatataaagaaagaaaatattcagctgtacaatgtgtttgtgtgtattctttttgtgtgtgtgtgtttttttgagacagggtcttgttgtcacccaggctggagtacagtggcgcagtctcagctcactataacctctgcctcctgggctcaagcgatcctctcacctcggcctcctaagtagctgggactacaggcatgtgccaccacacccagctaatttttttgtattttttgttagagacggggtatcgctatgttgcccaggctggtctcaaacttctgagctcaagggatctgcctgccttggcctcccaaagtggtcggattacaggcgtgagccaccacacccggcccaatgtgtttgtgttttaagctaagtgttattacaaaacagtcaaaaagttaaaaaaatataaagtttataaagtaaaaaagttacagtaagcaacagtttactattgaagaaggaaaaatattttctgtaagtcgaatatagcctaagtgtacagtgtttacaaagcctacagcggtgtacagtcatgttttaggccctcacattctctctccactcactcactgacttacccagagtaacttcaggtcctgcaagctccattcatgtaagtgccctgtacaggtggaccattttttatcttttattctgtactgttgctgcagcttttcttttctatgtatagacacacaaatacttaccattgtgttacaactggctaccgtagccagtacagtaccatgctgtacaggtttgcagctcaggagcaacaggccatatcgtgtagcctaggtatggggtagataccatctaagtttgtgtaagcacactcatgtttacacaacaactaaattaccaaatgacaacgcatttctcagaatgtgtccctgtcattaagcaacacagactgtgtttaaaagccaccagcatcatgacagccaggatttctctgctccaggccgcacctttggggtcaaaatattctttggcggtgaggccaggggtcagcatttcctctccccaaaggggtctcctctgcagcttcgaagtcttcccacacctttccaccaaaagaccctgagcttcactgctgcccccagcagttttgtgggtcaggtgggtgatggtgctgagtcatctgactgaccataacctacctgactctccaacaagtggagcttcctttgaacgtgcctgctactcaacctctaaccaagcccagggggaggttatgttccaggcattgatttcaccttcacaacaacctcacaagtgtgtactgataacatcgtccccatttcacaggtgataaactgaggcccagcaaggttaggtaattgactcaagtgcccaggcagtctggattctaaacacatgcacttcaccctcatgcctcggtgcctcccaaataacaaccaccagtagcacacaatgcaagcctggcaggttttgggtttttttggttggttttgtttttttgagacagagtttcactcttgttgcccaggctggagtgcagtggcgcgatctcggctcaccgcaacctccacctcctgggttcaagcgattctcctgcctctgcctaccaagtagctgggattacaggcatgcgccaccatgcccggctaattttttgtatttagtagagatggagtttcaccatgttggccaggctggtctcaaactcctgacttcaggtgatccacccactcaccttggcctcccaaagtgctgggattacaggcgtgaggcactgcacccggccatgcctggcagtttttgaaatgcttttcatacattatcccatttcgatcctcataaggtaaatatcactgttatcctcattttgcacatcaggaaacacaatcttaccaaggttaaatagtgtgtccaggtcacagagctatggaatatggaatatggacctctaaatgatcctagaacccaaggtattaacctcaaaacttgcacatttttggatcttaggacctctgtacttatctggcactccaaagagctcttgttcacagatgttatgtctaataaaatttacaagattagaaattaaaaccaagaagaatttttaaatatttacttattttttaaaaaatcaaaactccattatatattgacataagattttttatgagacattaaccaccctttccattacaaaacaaagcaatgcggcaggaacagcatcattgctttgcattttgttacacaggctgtttaacatccagcttcacagagacagctggagtctcatctctgtaatgtcacacacccaggatggaatctttagaaaactagactctacacccatgtgaggatggaagcagaaaagaccagtgacatcctagtatcattatgaaaacagtctcacctcacgagccctctgaaaggacctcagggacatcaggccacactttcagaatggctattctatgctatagtcaagttcaagaaatagcagagaaacatcaaatgtccagtttcacaacagaaaagcaccaccaggcccagtaacctgcctttggggagacaagaaattttgaattttcatccccattgtataaacgaggcaacataaagatgcagccctggctttcaaagaagctggagagaggagaggaggcggcaggacagaaggaggggctcagagccatcccaacacaccccatctctgtctccagacgtctcagtctacagccatgaggacctgggcgtggctggccacacagataaagtagcaacgacatgtgccaagcactgcccaagcactgggttctgtgctaaagacactctaccttcaactcattaatctccacagctccctactggggttgtgctaggattgctccttgagaaacacgtcagaaagactacatggctaggaaaatgggattcccatgcacactcagctctgacgccaaagccaacacctcaaccactccacaacaatgcctcctaatagggaaggattctcgttccacttctcttggcccaaaggcttgagcatacaggacacatacagaaagtaaggtcaaccagacccaagatccatcacacatcaggctctcagacccagcagaaagtgcagccgatgcctccggccttttgtaattgggggatggggagggccaaggagggccacaggggacctcatgaccaatctcaagatgtgctacgcccagaagttccaaaagaacagcaagggttgcagaaaatcctctcaatccccattcaactgaagtttttgtctttttacttgcatctagaggttgacagatattctgaaaatgatgcagtcctaccatccaaatggttgtcaggatccctcaaatggccaccaagaccaaattctacagcaaaggagctcactacttcccagcagagcccatcttatctctctccctaaaattatgccctctactgagttaatctgtccctggacattccctccactgacccttgatctaacccctaagggccacagggaacaactggatttcttgtatgcaatagacctgcaagcatttgaagacaaccatgaagttcctttaccaccatatgcccatcagaatggctaaaataaaaagcaatgccaccaaatgctggcaaggatacagctggattctcaaaactggaattctcaaacactgctgatgagaatacaaagtcatgcagccacttcagaaaacagtttgacagtttcttataaagctaaacatgcaattgccataccacccagcaatcccattcttaggtattttacccaggagaaatgagaatttatgttcaaacaaaaaccagcacacagctgtttagagcagctagggaatgaataaacaactgtgttatgtccttatgatggagtattactcagcaatgaaaagggatgaatgactaatacaactgcggacacacacagggtgtgggggaagctggaatgccctgcgttaatcaaaagaagcctgactctaaaagctacatactacacaaccattcatatgacattctgggaagggcaacactacagggacagaaaagagatgagtggctgccaaggactgaaggtggggaaagggcagattgcaaaagtgcagagggaatttttaagatacagagggcagtgttttgcatcttaaaagtagcaatggttgcatgactatttgtcaaaacttgaactgtatacttacaaaaaatacattttactgtatgtaaattatatctcaatgaacataaccttaacaaaaaaaaatttcttttttgagacagggtcttgctctgtcacccaggctagagtgcagtgacacaatcaaggctcactacaacctccacctcctgggctcaagcaatcctcccacctcagcctcccaagcagctgggactacaggggtgtgctaccatgcctggctaattattattatttttatttattgtagcgacagggccccactatgttgcccaggctagtctcaaactcctgggctcaagcaatccttctgccttggcctcccaaagtgctgggattataggtttgagcaaccacacctagcctatttttttaagaaaaccaaactgtgatgccctgaatgaagccatcatcctaagagtgatgttgacaggtaaagagatgaggaccaacctcctctgctgtcactgtggttatttacagtaaactttttaaaaacaggcaaaacagaaactaacataaagctgggttgtcaacaaaagcctccaaagtagctgccaacaaaagcttccaatgcagttctaaccttgtgcagttgttcttctggactcaaatgcaaagctgtcaactctcccgtgacctcaggctttccttacccaagtctggcaaccactggagaaggaggcagattgtccttttccttttggtgttcaggatcagatttcagaggtaagggatttggtttggactaaaatggcccaaaacaggaagacaccagatcaggagcaggctctggatggagacaaagagcagccagccctgcgctgctcttttcacccccattttgtaaaggaggcaacaggaagacacagccctgccttacgaggaagctggaagaggagagaaggaagcaggacagaaggaaggggctcagagccgtcccaacacaacccatctcagtctccagccatgaggaccttggggcggccagcctccctctgacctgggtgtaagaaggagggcagaagggagtgtccccatcacaggaatcctcagctccttcagttgccctggctgctatggtcaccaccaccgaggctcagcaaatgaactggcagctgggtggatttctcagccaccgccctttgtcctgggctccctcactgtcatgctcccactgaccctggaggcgcatccttggtcttacagctgggcaggtctcacctttgcttccaggccctgtatgcctgtgcttccaggagccagagagatgtccaggtaaacttcctggccacctccaggccctggctgcccgggagaggcaaagcagtggcagagcacagtcatcagagcaccacgtcatcctcacctacaactcaggacacccagagccacagtcatcagagcaccacgtcatcctcacctacaactcaggacacccagagccgtccaggaaagacccaggccctgcctggggtgaacgagtgcttcttaaagcacctaagcttcactagagaacctgctaggcaaaatttcaggtcccacccagacccactgaatcagaaaccctgggagtaagtccctgcagcactccgtgtggtaaaagccctccgggtgattccgatgcctgctagagtttgagaacctctgttccagaccaaagttgcatttgcatatttctcctttgttttactggctatccagcagccactgcctttaaagaaatcccccactgatgtccttgacaatgaaggcctaagggggacacccctcttagtcaatgagtacatgactccagttcagcgtttccccagcttggagtgaaaggaggttagattccaatgctggaagcccaggccccagatctccagccagatcaaagacttgctttcgaacccttgactcagggtctggttttcagaacccaaaccaccataagcagccatggccaactacttcccagctgcatctagtccagagcacttttcctggaaggcccagtccaagggccacttcctccaggaagctttctgtgattcccctcatcagaactaactgcttcttcccttgagttacttctttctttctgctctacacagaacagaatagccagtcgtgccagacagtgcctgtctccctggcagtgtgataacatttggggccgtgttcaccgtgatccctatgagtaccaaacacctgccccacaaggaggaggcattcccatctctgataaattggctttgcaaaggattacccctgacccaaaagtctgggccaggaatgaaggatcagaggtcacagggcgtcagtggcagcccccacttccctgatggctcaccccaccttcccctgtcaaccagaagaagcactttcaaggaatcttccctgggatatgagagaagccctccagcaatttctcctgccgataagcctggagacctctccatttaataagaaatcttctgctatttcaatcttcatggaatttaaggctggctttataagtgctgcccaagaatgtctcttctcctccttaaaacctccccagttttccaagatgagaaataaaaggctactgagaaattaggtcaggatgaatggggaggaaaaaagtactgattgcctgaaacgagtgtgcagtccccaggcagatccaccaggtagggtcgggggcaggtcacaacaacaggcgcaggaagcgggggagggcctcggggaagctgtgtgtgcttagctgatgaaaactgcccgaggaggccttggcacaaagacctgctgcctttaaggctgttggcaaaggtgtggcgagttgtgagtagggccaggctggagatccgagacccgacagaccgcctgagagaacgctgtctacacgccccaggcttcagcctccaatttcttctcatgctgaatacaacctgccattgttttcccagccgtttccatttagggagatgtaaatggaaaagtggaagtgatgtttttattataaggatcttgctcttgccttttctcaggttcctaagatcaccatgtgaccttaccagcggcccctcctgccagggcggtgtgtgcttgcaaagacttctgcctctcatcaggtgtggctgagccagcaggaactccctggcaggtgctagagtgctcccagccagggccagccccaccaggcactccaccccgagggactggtacaagcctggtacagacattctggttcccttctcagggatgaggttgggccagcccatctcaaactggagggctattaagctgtagaaaccctcagcgtttctgatgcagcaggggtgggaggaggctcaaacctgcatctctaataagtgccccagtggtccagcgaccaggctttgtgagccactggtttcggcacaaacaagcagccaactgtggtcaatgaaaggaggccatactgatggactctggaacaggttcctttgctcataagaaccccgccttcttcttctgccactcaccgcagatggctacagagcacttgaaatgtggtggatttgcctgagaaactagaaatttaaatttcattttaattcatttaaatttaagtagccacctgtgtttagtggcgcccatactggacactgcagacctggacactgtcaggtctggatgtgatggctggagctgctgctacagacaccccgccatgagactgtgtgaagacaccacacagaggagggcagagctgcatccccatgtactggctgacctcagcacagcctcatatgggagctcatacatttcctgattggttaaggtggtatgagtgggtgttccctgctgcctgcacccaaaggacaatggcaatctcaagcagaagagcaagagaagcaaaactcggttccctgtgaactcaagaggctttgcccagaagggatgcaaccagttatttcagcattaaatatccagacacagacagtacagacccatcctgctccaagaaacacatcagagcactgcactctgcctgcctgtgatgcccaggaagagcacagagatactgttgacggctccatcgcaaggactgagtcagcttcaggtgagtgcagaaccaactggtgggtcacggccatgacgcttcttccagaatatgctggggtccagctgcccaagaaatatcttcctactcaggctgggaattccaccatcagcagtaattgctatgggttaggcaaatacccctctctggaatccccttttagaatgcacatgtgcctaggaaaggtaacgatttaacccttgaaatgccgatgggaatgagtttactgattgctatctgttagacagatattggtgaagggtgaaaaactagacaggtcagaggagtatgctcagggcttacccagtccaccttaaaaagcctcaccttccccatctactgatcctgactgccccactccatgcacttcctgaagggtgagtcccacattccaaattccaacaatcccatcattccattgatatgtctccgggcaccaaaagcaggcagaacaaagtaataggataccgttgggagctttgaattgcagtcccagaagggcctgccctgagccctaaacaggatgagggttatgggaggaactgtgtttttatgggtggagttgtggccccccaaaagatgctaaagtcccaatccagtaaatgtgaatgtgaaccttatttggaaaggtcaaagcgttatctttccgaggcgcatttgcattctaaaaggggagtcccgagagggacactgctcagcccacagcagttattgctgatggtgaaatagtctttacagatgatcaatttaagatgaggtcttgctgccgtaaggcaggctcctaggccaatctgaccagtgtccttattaaaaggggaaatttggagacagacacacatggacggagaacatcatgtgaacacaaaggcagagatcagtgtgatgtcggcaaaccaaggagcaccaaggattaccagcaagccaccagaagcgaggagagaggcccgggacagatctctccctagcgccttcagcctgcgtggcctcactgacactttgatcttgggcttctgtcctccagaactgtgagacaatcaatttctgctgtgtaagccacctggtctgcggcactttgttatagcagccctagaaaactaagatggaactcgccggctggtcactgtcttccctcttatcacactaccttcccttactgcagctacttatttaactgtttcccaccaaaagaccctaacatccaggagtgtggggcccacatctgcctaattcgccactacggcccaagcccacctctggcacactggaggtgttcaagatgtgagctgacatatgaaagagctgtcctgactagttctagaatctcaggcatgtgactccccctcccagaatgtcaatttccccatctctctgcagagggaaaagaaaataattggagtagatgacctctgtgagtccttcgggctcaaaagatggccgggactcaccactgaaggtgtctgcatccatcatggtcagatcaggccatgagaaaccccactagaggtgctaaacagagggaatgggtcacagaggtgtgggaagcctgagaaaccactgcggccttcctgctggacttcagagaagggctggcctcattttatgggctttctgaaacccatattcagagaaacacacccaattcagcatggactggcaatgcctatccccaaggaaactccaaaaggggtgagtctcctgggcagtggtcactgagttactacaaggcctttggggttggggtggggatggtgggtcaacaggctcccctagaagccctgtgccctgacaaagtaaacaatggcaaaacatgtgcttcccagcactcacctccccacctccttctaacatcagaactgggtttctgatgatgggagaaaatgtaaatgaaatcaacggaaggatgatcctgtgagtaatctgacaagggagaaccagcttcctctcccatgaaccccagctgccttggctttcacccagacccctggcccacccggtgtcctccccagacagtggtactcacccacactgctgagggagctgctgctttctgagtctgagggcatggtggacaggacgctgtaggtagaacctggggaaagaggggagaccatgttactaaccccaaggggtcactcgtcttcaccccaagccagctgatcatcagtcaatgccaggccatgagagctacatgcaccaggcactagaaatccacatccacgggccaagcagaggaggcgcgctcagcagatctggacttcggtgtttctgccaggcctcccacctcactttatcggcccctcctgctctgggcaggcgggcagaggggaacttggagtcagtcagctggcttcttgttgggacatctggggaaaggcttagcaagggagtgacatgccccaggtaaacatggggtgtgggggtttcctccacatctctagcaatatgattctggcttccatgcagagggtaacagagcagaaattaaagaacaactgaactatctgttctttctctgactgttctgctctttaggttctaactgtattcaagctcagttcttaataatttacttagtatctgcccccttattaaaagttactcctaaaatgatgagcaattgtaccatcaccaaagccagagggtagcacttttttttgtccacacttaatgttaattcctggttgtggacacacaaccactgtggtttggtttgaattcaaatatcttcaaaaccagatgttaccctcccagcaccgggaagcccagtttctgaacctagctctatgtaggtgcccatagctgggtcgtgctgagcaagtagcttttgttttctggaactctgtttcctggtctgcaaaatgaaggagttcaaccagatggcttataaggtccctaccccatcccccatcccccatcccccatcccatttcagcaatttccatgattaatggaaacagaaggtacactttgctcatcaagactatggatgacataaaattaaaagggagggcaaactgactcagagactaaattgggagtggacaaagcataacacacagagatggcaggtcagataaaacaaggacaaatccagtgttttgttcttggagccaaaagaactatacaatgaagagcggtatgtaccaggccaagtgggtgagctggagatggaatttttgcaataagggctttgaacaagccttagggctctggcatcagaaagctgccaagaactaatgagatcctgggctccacaacaagaaatgtggaggaccacatttaaggagctcccagcagggcacggtggctcacacctataatcccagtgctttgggaggccaaggtgggcagattgcttcagctcaggagtttgagaccagcctgggcaacatagtgaaactccatctctataaaaaatacaaaaaattagctgggcgtggtggcacgcacctgtaatcccagctacctgggagtctgaggtgggaggatcacctaagcccagggaagtcaaggctgcagtgagccatgatcatgccactgcacttcagcctgggcaacaaagtgagatcctgtctcagaaaaaaaaaacaaaaaacactcttccactgcaattcttgactagccaccctacacgcatctttggacgggaaagaggagaaatgaagaaatgggggtaaatgggggagcggggcaggggagggagatgcactgtaggtgggaggcccctgggggacaggagagaccttgaggggaaagcagggagactttgctggggaggtgaggaccatgcaggagggcagagagatagactgcaggcaggcgagctagcaggcgtgtccatcagaaaaagagatgaagggggagagaaaaaagagaaagcaagcaaaaagcaactttggtaatggcaagcactaggacaggcgtgaccggcaatgaccagtagcctcattatcacattttcagagactctgaagaatctgaaggcgttgagcatgggctgaagagaatgactggggaatgggtaggtgtcttgtctctcaatacgactgtcagaagggattagatttgttcttgatggcctccagcagccaaaccaggagcagcgggtggatgctggagaaagctgcatctctaaacaggtctggatggccacggtcagcactgccaggtatgaaaagcctgagggtgagggggtgagacagtgagggaggcccagcactcagtggcatggatgtcatggggaagtctgtgcatctgaagggagatgaaaccagaaaacccagttcagccttaaaattctatgatcctgctaataatgaataacccatgctccacctcccatatctgaagtccaacccacactattagttttgctgtacattcaatatctctgcatttttgtctcaacaaaaacaataagcatcacacttttttttttttttttttttttttgagacagagtcttgcactgtcgcctgggctggagtgcaatggcgcgatctcggctcactgcaacctccacctcctgggttcaagcgattctcctgccccagcctcctgagtagctgggattacaggtgcccaccaccatgcctgcctaattttttctatttttagtagagacagggttttgctatgttggccaggctggtcttgaactcctgacctcgggatccaccaggcctcagcctcccaaagtgctaggattacaggcatgagccaccatgtctggcctgcatcacatgtttttttaacccatctctctttctatatcatacacattacatgttgcttcaatatctgtgaaataaagtcaaatgcaattcgggcaatccattgatatcttcaaagaacaagaacccaacacaatgcctattttctaaactcaactaccattttttaaatagtattttttctttatgggggcaaggaaggctagccactgacatgttggtggattgtttttggaagacgtctactcaggaaagcaggcacaaataaatttccccactctcacctccagaaatctctatgctcaacccatcccagcttacgacactggcagcctgcgctccagatgcctctgctggaacgctcccctctttcttactcttggcatcagcagtgccccttcttccagtaaactgcccctcctcttcaaatcgtctctctcctcccctgtggcaagtttccactgttaattaagcttggcagatgcccttccctctctccgcccacctacctccctggctgggggagtccacaggccaagcgacacgttctgttcctcttccctgtccctgcagtcctgactggcctctggggcctaaccagggcagcgtgacatctttgtgtgcatctctgggcatcactcccacccccaacccagggagctggcagggctcctaggagctggtggggggagtggttaaaattggacaggacccagtttttacaatgttcccagagccttggacgtcattaagggggaaaaaaggcccaaagacgacattgtctcggtcatgctttgtctctgcggttattgttgtcctaaaggcctgtgtggtcaggacagtcaggaaaaggcaaaagaagccactgtcccccaaagtcacacggtgtcctttcaaggccggttgcttccatggggcggaggggcaggtgtcggcgtcatctacctctggggtttcgccatcaaatttggagtcaaatttggtgctcctcatcttctgccatggcccaatccaggaggagacaatttccccaggttctcctgaaggcacctccacccaacctgccctgaaacctaggatgggctgctgtggaaggagaaacagtgtggagggacattctctacctcacagagtgcccagggctaagggggactgtaggatcagcctcctgatgtgtgtgtgtgtgtgtgcacacacacacacacacacacgagaggagggcaccaaccacaaacttgtgcaagctaccaagtaccatgcagaggtgctgatgagatccagagaaagttggatgatgtggaaacatttccagaaaaggggagcttgaggccaagtttagacgtggacatgtgggccagagcgtgatataaggagattctttactatcaaaggaactacctgggcaacgtaaactcttattcagcagatgagggtggggtttcagaatgcatttctcacaagcccccagggcacatgctctacacactggcccagagctggagtccacaggtgggatgcacatggaagctgcagccaaaaccctgggagaggtggaaggaagccactgggaggaagccagcctggtgaccctctgggactggcccacgggcactgtctgtgtcctttccaagagcccagcccctgataattctgtttaccccgtgactcagtgccactgggtcacgaagaccacttcaaaagaaattccaggaaaaaccacccgaacaataatggaatgccccagccctcccaggccccctcccatagaccatgaggcccaagagagatggaagcacgcccccaacacaccccttccattcacctggagcttgtaaaggccctggtgactcacgcttcctcttcgtgaagctcacagtggctgaaggaacttgttccagccttgaaccagcacacagagttctccctgtcctccagaagggcccaggcagaaaggcagagagctgacggctcacggtcacagggaggccagcaccccctacctcaatccccagggaaaggagagggagacaccaagctgctactctctggagctctggggtccctgaagacagagcaggaagtgctgcctgggccccaggaggacagtcactttcagggcacctgccacatcctgccgccctcctccagctcacactgaggaaccacagcctgacgaaccacagcagaatgaccgaaggtgcccaatcgctcccggactcacacgtgtcagccaggtttccaacacgtgccccccgcctagcatggcactgggccaggttcgggagaaagaatggcaagccaggggctcaagagcctggaggttactcatctgctgtgagtagccttcagaagaaggcccttctctctgagccaaacaataatgattgcagcacagctggggccaaactgcttggagttaactcccagcccagccccttatgagctgtgtgctgttaggtaagtcactctgcctctctgtgcttccacatacttatcagtaaaatgggatgatagaagtgcttatctcttagagctgtttgaggataaactgatttaatgcaggttgagtatccctaatccaaaaatctccaaaatctgaaactttttgagcaccaacatgacaccacagcagaaaattccacacctgacctcatgtgatgggccagtcaaaatgcaggcgcaggatacagtttattctgcttcctcaaaggaaaaacaaaattatcttcaggctatgtgtatataaggtgtatatgaaatgagaatacgtttcacatctagacttgggtcctatccccaagatatctcattatgtatatgcaaatattccagaatctagagaaatccaaaccccaaaaacacttctggttccaaggatttcagataagggatattctgcctgtttgtgaaaagtgactgaaacagtacctcgcatagccggtactctaagtgttagctggtgttattatggtcagtccagacctgcagagggcccttccaactctgctgttcaattcctcaattacctacatggaaagctgtactagagtgacaagtcacacaatctacaagcaaactgctgcactgtatatggcactctcaagaaaaataatagcagctaataggtactaagcactactaagtactgggactgtgctaagcactttgcatgtattgcctccattaatttccataacaacccaaaggttgtcattattagtcccatttcacagaggaagaaactaagagttagaaaaattaatttgctgaaggtcgtgctagggctactaagagcacaaacaggatacaaacccaggcagtctaccccagcgcctgtgctctcaaatcctacacacaatactgctgcccggctccacagggaagagcagtcagagaggacttcatggaggcaggggcctggagctggccctgaaaggtggtggccttggataagcacatgagaagcccgatcagcttgcaggagacaacaggcggaacccatttctctggaagggtaagaagtctcagagcagggctggcttgggccaaggccccccagcctctattccctgggaatgggctcacctcctccctgcccacctccccacaccgagacaacactcaataggcattctgagctgagccacttccacccaagtgggaagaaagagaaggagctgtggcttcatggcccccattccatacccatgcctgtgctgcctgcagaggggagtcgcagtgtgtgggcaagcctgcactcaagagccactcaattctgtgaactgcagagatgaggaaggaggtgaccgtgaaagttgcggagtgctatcacctttggcagagcccaccttctctgttttaaagacctcctgggatgctggggggacagagggctcatatcctactattaggctactaggaagcctgcttgcagaaccatgctcagttctcaggagggaagaaaggtggcagggaaaaaaaaaagaaaagaaaaaactacactcagggcagccccagcccctccctaggggctcggcctcctaccctttaaaagcacggcccaaggctacagacactgaaacccaaactgggaagcggacaaggcccagtatttcagggaggtataggttgaccatggccctggaatggagcaaccacagacactggcatgtcatcaaggaagtcctgctgatgcgccttatatgccacccgagggtgggaaaatcctactcttggtttgtaagttaagatttaatatttgttttcctcaactgagataatgctatagtattttccaccaagttttggaacaagcagcatcactgcgctaaaaaaaaaaaaaatcataatgatgtggattccccctatttctggtcgttataagaactgctcacctatctttaaaaggtaaaggtggccaggtgaggtggctcatgcctgtaatcccagcactttgggaggctgaagcaggaggatcacttaggtcaggagttcaagaccagcctgggcaatatagcaagaccccatctctctttttttttttttttttttgaaagagagtctcactctgttgcccaggctggagtgcagtggcacaatcttagctcactgtaacctccacctcccaggttcaagctattctcgagcctcagcctcctgagtagctgggactacaggcatgcaccaccatgcctggctattttgtattttttagtaaagacggggtttcaccacgttggccaggccggtctcgaactcctgacttcaggtgatccaccccaaaatgctggaattacaggcatgagccaccacacccagccaatcccatcttttttttctaagaggaaggaaggaaggaaggaaggaagggagggagggagggagggaaggaagggaaggaaggaaggaaaaaaaaaaagtaaaggggaaggggcattgcccagataattggagatttaacctcaggtatgcagtgagatctgtgtggggtggcaggaaggaagatgatggctgccgagctctctgtccattcttttttttttttttaaactttatattttaaaataaatagagacagggtctctctttgttgcccaggctggtctcaaacttctaggctcaagcaatctgctcgcctcagcctcccaaagtgctgggattacaggtgtgcgccaccacacctggcttttgtgtccattccttaacacattccctaaccccttcccactggacttttgaggccatttataaaataatgaactaaattgcctgaacctgagaaaactctcgtatcaattttgccatctgtgactcccctcccttccccacccaaaatgccccaaggcaaaaatatgtaaagagagggaaaacaaaacatgtgcaccccagaattaaatcattcagtaccatgcaagacccttcactcgctaactacaggactggttttggtctttttctttacttttttttttttcctcttttaagtggcaagtgacagggactaaaaaaaaataaaataaaactagcacataaaggaaagatggaagtttgttgaatttcgagggatgaaaagagtccacagttggatagcctgcttgtcttcatcagcgaagcaaaggctcctggaggctttgggatgagcacaaagcctgtgtctgatgaaagccaccctctttgttctgcctcccttcagagctgccgggctgcaggttggggatgggagcagggagggagggaaggcagtgggaggacctaagaccatcaaacctgacaccaggtgggaccacctctcggttcctgctttccatcaccaaaaccaagccctgctccctgctgtcacttctggccagactaagacagttctgcacctaaaaggcacaggaggaggcccaaagagggtctgattaaggaggaggatggggccatcgtgctatgccctggaaggtgggggtggaggggggacaacgaacatagccaagcctgacagcacccacaaggcgaggtgtgaaggagtggagcagcgcctctgccccgccaccctgacagcacatgtcacaccaaacccagacaggaaatctgagcagcaggggcacccaagaggcagccaagcctccattatgctccagccggacatcccccgggggccatgtctgccctagaataaacttctgataagccccagaagtcacaacaggcaggaagcagctctctgaaaggcaccgggcacccccggctccctcctgctctggcccggtgctcaatttccactagtcagtaaatggagaagaggctgcctccctcccacacaggatggagcgcataccttgcagagtacactgccctccaccctcccagggcaactgtagcaaggcaggctctgcgtcagaccggctggctcaggcctgccactcaccagctgtgtgacctcaaataagttgcttctactttctgtgcatttcctcatttataaaataggaagaatagtaggtgatgagaacagaatgagcaacgagagggaaagcccttagaacagagccaggcgcacagcaagcgatccacaaacaccagctctcgttactgttaccgtctcacaggctcctaaggaaggcagggcatggggtggcctctgcagtgtacacagacagcagatgctatggaagggacctggaggacagtcacgcagccttcccttgacttctggagtgttttgctggttagaagctctgcattgagtactctgtatacttcccatcaccatctccctcaggagctaatgcttccccctcaacccagccatgagtgtcgcctctcaatacctgaatacagctctatctatgcctgtggataaggaggcttcctctcccctcccaccattccacgtggccatggcaattccaagccatccccagcatcccttatgatttctggttctctggttcacaaagaaaaaaccagagcgctcacagtgtgcctggaatcataccaggcttgcacctccactcatccagtcctggctcccaccacctacatacagacatcagtcagtgccctgtaaaagatgctacgcattggtgggcatgtctgtccccggaaacacaaggcccactcattcgccaaacgctgggttaatgctgggtgaagtactgggatgcagcaggaagcaagatggacaaatccctgccctcatggagctcacatgaacagggtgacaggggcgggggagaaataaacaaacataaactgtattgggtagtaagtgctatgaagaaaaatgttgcagagttaaatggtaggtggtgggggtggagaggagatgtggctattgtacagcggtggcaggggtctctctgggcaggtcatctttccccagagacctagaggaagcgtggagtgccagaggagggaatagcaagtgcaaaggccctggggccaccccatgcggggagacctgtctgctgtgggtggagggacctggaggaggatgcagatgaggtcacaggggcaataggacagctccaggcagaaccttatgggccacacagaggatgcagggctttattcagagtgagacgggaaaactctggaaggttctgagtagaggaaagccatgatctgacttacatctacttaggctcattagatgatttgttgaatgttgtccacaagcagggaagcatagaaacaagtcagacagcaaactcgcaagtccaggggagcaatgctgggggtctggaccagagtgacaagaatggtgttggtgagaagtagctggatttgagggatattttggagcttttctttctttcctattccacatttggcttggagcagagctgaaaggatctgctcataggcccaatgtggaataggaaagaaagaaaagtcaaggatgactccagggttcttggcctggaaactggaaggatgatgttggtccttgctgaaagggggaagcctgcaggaaaaacagatgggggagggagttggggaatcatgagttcccgcggggcctggtcatgcgtgaggtgcctacagacacacaagggaggtgtcaggcaggcagatggatgtacaggcctcaagttcactgacaaggtcatggctagagatgtaatctgagaattgtcagcatatgcttagtatttaaagtgatgagccttgataaaatcacccaaggaaggagtacagacagcaagggcagtggagaggtccaaggaatgaacctgagcatgcaggggctaagggaagagaagagaaatcaaccaagaagacagaggagaagtgggtagtgagatgggagagtcgaccacacaagtaaagaaactgaacacagccgggtgcagtggctcacacctgtaatcctagcactttgggaggccaagacgggtggatcacctgaggtcagggtttcaggaccagcctggccaacacagtgaaaccccgcctctactaaaaatacaaaaattagccggccatggtggcgcatgcctgtaatcccagctactcaggaggctggggcaagagaattgcttgaacccaggaggcggaggttgcagtgagctgagattgcaccactgcactccaacctgggcaacagagtgagactccatctcaaaaaataaataaaaacaaacaaacaaacaaactgaacacaactgcatgtggtcaggtcttaagagaggtgctcagatatgcccatgttgcttaatggtgaaggtaagacagacacacaatcctcccgactcctgatcaagctgaatctgcactccacctaccccctgaacttccccagttatcaaggaggctgatggaaatgaggcagagcattagggagacccttcagtgtatactaggcatcctacatggcacagctcatgtttttgttgttacactctactcatatcaggtaacatttattgagtacttgttgcaagaaaggcactatttgtatggattatttcatttaattctcccaacaatcctacaaggtgggccactatcaactcaccttctagatgaagaaatgtaggctcagagaagccaagtaacttgcccaaggccacaaagctagtaagcagagggtcccaactcaagcaggactctcatccactaaccctagaccttttttttttttttttttttttttttttgagacaaagtctcactctgtcacccaggctggagtgcagtggtgtgatctcagctcactgcaaccttcatctcccgggtccaagtgattctcctgcctcagcctcctgagtagctggggttacaggcatgtgcctctgtgcctggctaatttttgtatttttagtggagatgggatttcaccatgttggccaggctagtcttgaactcctgaccagacctcctcctttctgacaagatcagaaaaagtgatactcactagttccttctcccactggatagaaaaagatgcaagcaggcatccctcgcccagtgtcaacactcagggaacaggagatacctagtaatcactactggcaggtcaggagctcttctccaagcaggcatgctatctcgtggccagcatgcagcactgtggccaaggccatctttccaacagaaggaaaaaagggaagcatgagaaagaagggttccagtcacctctgtcacagctcagctgccagccttgtcctctagtcctggcttcaacctctctggccttgtcactcctctggccgtggatttctctggtccccctcagaagagactagtactgtctctggaacaagctagataaatatctccatcctgggtctttagaaggcagcaagaaatggagtgggccaatggagtttcaggaagctgtttatgattctgatgcttagaccaaatgcaaaagaactgtaaaggtgtccctcccccactgtcccttcgtgccacaccatcccataatggcatgttccattaatctcagctcaaggtaagctgagtcatcagccagagaaaatgatggctctgggaactgcccaagtcacatggcatgagctgggcattaggcaaggacatggcatcccaggcttcacaggtcggggacattctgtccacaaaggccaaagagggcaactacaaaggaaaagtcttatctaagacatcagcaaacgggtgctgtttctgccccctctttcttcaatgtcatctacactgccctcctcatctacttcgtgggctgcattgagaatcactgaccaccaaggcaactcagcctgggtctgtagtagcagcaactagggctcctgaggtcatggagaaccccttgcccaccacaatattcctgctgagtttgaactcgtcaggacccctgccatagggcgggaggcacaaagtgaccccatactgtggaaagggcccaggatcaggagctggatggacatgggctccctctgctttggccacctcctaatcagtgaccaggagcaaatactttttctgagcctcggtgtcatttgcacactgaggctaaaagtctttatacagtcagtatttcacaggctgtcgtgcagagcaaatgaaatactggatgctgaaagtgcttcgtaactgctaataaatgatccatttttcacctcctcaggaggctcaggtctatctctgtccccgactccactgcaaatctttcccagtcttccttcatgcttctctctactttccactgtcagcctcttctcttccacaaactccttcttccttctactcttattcaaaacacaaacaacaaaaacaacaaacatgcatacaaaaggaaaaggaattaaaacgcaagaaggccaggtgcagtggctcacgcctgtaatcccagcactctgggaggctgaggcaggtggatcacttgaggccaggagttggagaccagcctggccaacatggtgaaacctcgtctctactaaaaaaatacaaaaaaaaaaaaagtcagcctggtgtggtggtgcacgtctgtaatgccagctactcgggagggtgaggcacgagaacctgggaaacagaggttgcagtgggccgagatcactccactgcactccagcctgggtgcactccagcgaaacaatgtctcaaagaaaaaaaaaaaaaacacccaagagcttcacctccatttctctccattagaggtgtccaaaatctctgggccctcagggtggaccacacctcacctagtttcacgcaattctacgctgactttcattactatgggtgaaagctccagcttctgggccttggagttcaagaatgcccagggtttttgaacacaggaataagcaagcaggtatgagcttcaggaacctgtctccagcaactgtgaactggaaggatggaagcagggagagcctggaagctgagagaacagttaggatgttcccacaagagctgcccttaactactggtcatggggtacgggtagggagagggcccaagaccacaggtagggaagaatggaggatggtgctgaggtttgtggttggggcatcccagaaggtgacacagttaacagaggcagaggattaaaggaggaggaatgagatcgttgaaatccatcaggtagaatgcactaaagaaaatccctgtgaagacagcctgctgacactcagaaactggaatgtggcaccacagagaaagtttcaggctaacacagtccactccagagtcacaccattgagcctgcaggatgtgagtgacaagcccagagtcactaattggtaatgtgaagcccctgggttagaaaaaaacataagactcaatttgaacaatgtcattgggaaagaaaaagaaaaaacagaggagagggctggatctatggaccccctaaacagtgactatgaagtaacattgttctttttttttttttttttttttttgagacggagtctccctctgttgcccaggctggagtgcagtggtgtgatctcagctcactgcaacctcccccttctgggttcaagcaattctcctgactcagcctcccaagtaactgggattacaggtacctgccaccagaagttggctaattttttgtatttttaggagagacagtgttttgccatgtaggccaggctggtctcaaactcctgacctcaggggattcacccacctcagcctcccaaagttctgggattacaggcgtgagccatcacgcctggcctgaagtaacattgttctaagtgtatataaagttcagaatctggggaaatacttcctgtgaagacaggaggaaaaaatgagtttctggaaaagacatagaaagatcacttggagcaggggtaggaggagcaagagaatgatgcatcctagaaggcaatggggtggagggagcctggaggggttggtctgccacaccaaatgctagggaggactcggaagcaaagaaacttctgatctggtcatttggaggtcaaagatgctatgcatggagtcaattaagcaggcaattgattggccctgtttctccatctgagaattgaagggcttggataagaccagaaaaggcacaaggtgcatcttgaaagagcagccatgcatcacaccgcctgcctgagtactgtgcctaaagccatacctcagctcactgggaaaggaccccacagtggatcagcaacgtctgccttgggcaagtcgggcaagagtatctcatccccggagcacattgtttctacagacctgtccacctccagagacatggttcatggtggtcggcacttagcaggcttcccgtaattaattactgattggaattaaactctgcaatctaatctgtgtctctgacatcctttaaatgactgtgactcaaggagcgctcagggaaaaataaaaggacaattatcttttttccatcgacttcttttgaggccccgagaaacagaaagtctgagagtttggctatcagaggcgctctgggcagccctgcccaaagcagatgatcctccaatccaagacgggccctcagatgttccaaacatgcttcctctccgataaagtaacaccgtccaggagggttcaccctcattttcacagtactcggtgtgcattttggaaatggcggacttcagaagtccattcctgaaactgctgggactctttccaatgttttacagaaaggacgctgcacacacttacctgcagacatccactgaggtatccaacgctcacctttgtcacacccagagcaggagtgagcttttaaatgagactttgggtactatacactcaggctgtcacctcctatccccccacaaataaagataaaacagcacaagcattcttcgccctaaaaccctatagcaagctttcatcatgacccattccacacctgtcatctcagtacattcaagtgctcacatgggccctcagctagagcatgagcccattcttagatgcctacgctcagaaaacaggcccatgctactctttgtttaaatgcagaaagaggagctccccctaaaacactccaagcaaaatctggacacacaatgccttcaaattgccccaagtcaaccacagaaaatggaagaggagatcacagaaggatttcaaatgcataaagggatgtagattatctttcacacgtgggcaatgctcagaaaagttgatcttgagtaacgagggaaaatatttcattcactatcttgtgcaaagagaaaaaaaccaaaatccacatccacgaccctggagtacagcaaatggaatcaaagtgtgccagcccccaaagattccagcctcctgcagctcctgaccctctggccatttgcagggagctctgcaggcagtctcatctcaatggactgggaccctccagcctgcaccactatggctgctctactctccctgccccctgagcaaggcaaatgcttagtgaaagtgtgaagagtaagagttgaatctgcattttctagtcagacttcagccctctcatagtttaaggggcatcccctctaccgtccagccctgacatcctacaggtgttcagagggggcgtgactgagccaggtcacacagcaagctggtgccagtgccaggagtgaaacaagcccacaactctgatgagcaggatgagaggaggaaggggatgaaggaagtgccctccagcgaaggcaagagtgcaggaatccctaggtagagaaaggtccccccagataagcacctggacaccctgtgcaggctgtgagagccaacagagaggggcagtcggtcaacagagcttctggccaatggctcccagcctggctgttcatcagaatcatccaagctgctctttaaaaatgctggaaaaaaataaaaataaaaaccaaaaatgtctcaggaccccttcctatccccaggaatcagcacctccagcattccaggcttttaagatgctgctcagagtctctggtgagtggctcagttggggaataccaccagggtctgcacacgcaccctgggcttcctgccctctgagcttcctgaacactgccactgaccctcagccagaaatgcttgcccccttagggtaccgttgtcactagagaaccgtgtgagagtagtaatgttgctttttttttttttggagacagagtctcgctctgtcacccaggctagatctcagctcactgcaacctccacctcccaggttcgcctcaacctcccgagtagctgggattacaggcacacaccaccaggcctggctaattttttgtatttttagtagagatggggtgtcactatgttggtcagtctggtcttgaactcctgacctcaagtgatctgcctgctttggcctcccaaagtgctgggattataggcgtgagccaacgcgccctgccagtaatgctgctcttatgggctgaagtgtattcccccaaaatccatatgttaaagccctaaccccttctgcagttcctcaaaatatgactgtattggaagataaggtctttaaagatgtaataaagttaatatgaggccatgagggtgggccctaatccaaaatgactggcatccttataacaagagatcaggacacagacatgcacagaaggagaactgcatgaagaactgcacggagaacatggccatctgcaagctaaggaaagaagcttcagaagaaacctgcccatctgacgccctgaccttggacttccagcctccagaactgtgagataatccatgtctgttgtttaagcttcctggtctgtgatactctgtatggcagccttagcaaactaatacagttgcaaccatttacccatgctctgtgcaggcccttccaatacagacatcacccacatacactatctcacttaaaacttcagcccccaggacaaacgtattgctgttagccccattttacagacaagaaccccaaggctctccaagatcaaggaactaacccaagatcattcagctagaaagtcaatgaccagatgcacccacctcccagccctttgcctgtaactgctcctgagctgcctgagtcctcagtcctctctgccatccgtcctgggcccactcagcagctgcagtcctaccccacctggatgaacactgtctgagcccactgtgccttctttcccagcctcaggcccccagcagacacttcaggggaacactgacttgctatcatctgtagtttttgaaactttttctttcttttattttttaaataagcactgttgctttggtagtcagaaaaaaaaattaatattaaagagaaaaaagctaacacggttaagagtttctattgaatctgtagcctgtgtggaaagaaagaagtgatcaaaaggaatatatttggaaaggctactaagaataaaaacaaacaaaaaaaatacaagctgcccttgccaatgtcccatcagctgagatgagataagagattcatggggcagaagtaaggctgctgaggccagagatcccagccaggccatctccagaaaatatctatttttaaagtcacgttccatttcatcacatttcagaaaaacaaagaagagaccttgagggacagacaaacaggctccagagccacacgcctttgtgtgtgctcacagcagcagcagccgtgcctacagccagccggcgattttcatctgaaaaactcagatctctcatggcagagagagttccacaccgagctgccatcatcatgcagcccaacaaagcagcaattttcatatttcctagggcctgctgggctcccaacttcttagtttaaatggaaactgtcagacaggattttgtgcaaacatgcgttttcctcgggggcaaacattctgagcctacaacttgttctttcattttgagagctttttgtccatggtgactacatcaaagatgagaggtgggcggggagggctgttggggagcaccagagaacagagcaaatgcaaagtgcagggagagcagaatgaattactaggaggcaaagtgcggcaggaacttatgtgcctggcctcctcctgggcagcagcctcagaggaaagaccttggctggctctgctccccacctctcctgcagcccctgcgtggacagcccagtctgtgtcagcacctcttccctcgggtgacctacaaggtcctggagaggaaaatggtagcaaagaatgtgcaaaaaaccatgatgacagaagacagcagaattcccatatgaataggattaggtaagaaggggttaaatgtgttaatattcatcaggcggagctttgcgacatagttttaggcaatggtactgactcttctggaatcattttaaagggccactcgctttttcattataagtccattcactggagcctcttaagatagtctcaaaagacagataggaatgcgcccaaatccacctgcgcaccaacaccgtgtgccaagcaaatggaatcctcgggaaaggacacccattaaggaccatcccaaaccccgttaatatgtacatgttcctctcaagctttatgcattaaaccaagtcaactaatattttccaagctcttttaagatgtgtggtcttttatatgtgggttgtgtgtgtgtttgaggggtagtgacgaagacacccccatcaagataactgaagaagaactgcccaaactgaaacattcaaatctccaaacgtctccattccccctaggtgtttgcatttcagtggataagatgaacacctggctgtgaagcccacaggtaacctcccaggcctcacaagcccacaggtaacctcccaggcctcacaagcccacaggtaacctcccaggcctcacaagcccacaggtaacctcccaggcctcacaagcccacaggtaacctcccaggcctcacaagcccacaggtaacctcccaggcttcacaagcccacaggtaacctcccaggcctcacaagcccacaggtaaactcccaggcctcacaagcccacaggtaacctcccaggcctctgccaagcagaaccaatgaagtctgttgacacaagtcactagggaaaaaaaaaaaaaaaagtctctgcaactctgtgctccccattatcagagaaaatgaggtctgttctgggcctcccagctctgagctggctgccctgggtgcagccttccccaaaaactctgggtatccagccctcacccgtgctgacagcgcactctgtccaccagctcatgacaaaggccacttgtttcccatgagtgtccagaacagtggctgaaccagtcaacccagtcggggactgtggtcctgctggatgggcggtgacaagagctcactgtgacctcagcagacaattagcaaggcggtgtcgagttactgagctccagcaggtcacctgctaggctgggagaatggacagaatgcaggttccagacccaagaaggggttaggcagggtcacaggctacttcatctgcctccgtatctttatgctaagcactgcaccctctgacattggagggcaagaaaagaaaaggtgttacaaggaggaggctagaacctatcccaggagtaatctgagaattgagccagtggttgacaaccatcctaggaagtatttggaaatgtgtggagacatggtacggtggacacaatgatagggaggggcactgtaggtgggagccagagatggtgagcatcccaaaagtgcagaagatcccaaagccaagagcatccactgagatatactgaagtcagttccatctaccccagctgctctgaccatacctgaaccactgtactcagcacaaagccacaacaaatgtggaaggcagggaagaaccaagagttgcaagaagaaaaaaaatacaacatgcccaaaaggtggtgatgaggaaaaggggaaacttagaggcagattggggccaaaaacctatagacaacagctagcaggatttaccaatgagaacggcaagcagcttctcaaagagggatgcccctgccaacacggatgctgagctgcagcaggatgtcttcagctggagggcgctcttgagcccatcagcagccaaggtctacctgtcctacctccaagcctcttgtgctcgtcacttcctctccactgccacgatgtggccacacctctcatagctcaactcatctcatccaccccacgattcaccttgggtctctagggtcccaggtttgccatttaccaccacgggcaaggtacataatacctctctgcacctctgattcctcctctataatggcacacagaggatgaggtcaataattacactttacggccgggcacggtggttcacgcctgtaatcccaacactttgggaggccgaggcatgcagatcacctgaggtcgggagttcaataccagcctgaccaacatggagaaaccccatctctactaaaaatacaaaattagctgggcatagtggcgcatgcctgtaaataattatgctttacacttggatgtctcaaggtagcgctggagtagttattctgagctactggaatatcagcgagtgccacctccagagggagcttcccagagcccagccctgtaccatctctgagcttccaggagtccccagctctccagccgcagaataaaacctgcctggaagctggcactggagggtctccatgggcccagcctaacctgtccacaccctcccagggctcccccttctaccacccacacttctggccagactatagtgccacttgcttatcacacccagcccattcccaggtgttcccattcagttttctgattccaccatcactactgcctctaccaacatcccaaccgacccttcaggcccagctcaaatgagacctctccgaggagtttcccagatccccctacccaggaatgacctgctcccctatctccctatgcatgcctccctatggttctagctgatgtctactaggcctggcttcacctatgaggctggggtcagggtggtttcatggatgtgtgaccttgtgcagtctcacaaggctcacaattggcttcgcactctgctgttgccatcgtgaaatcctcaatgatttatgtgccgcaaggagctcccaattttcattttgcactgggcctgcaaactgcaaactgcagatgtggtcctgctgaggacttctcaaggatgaggctttggtttatctctgcatctcacagactgcagcagtgactgggacacagtaaggacttaacaaaggagggaaggtggtgagtctccatgtctctttgttctgtgagcagctgtcacctcacacagctcattattcataggctggtgagctcacctctgtcccccaacagacacacacacacacacacacacacacacacacacacacacacgagaagaaagcaacaattcagctcagctcattcccaaaagccacattccctccaaccccgctacacatcactcccacaggacatcacaaaaaaaggtcgctggatcctactgaaaatgcagcccctcagcacttcatctcaaacactttctcccacagcaggtggctgagggctggtgtgctgaaaagctcacattctgcatgcgggaacactgactccggagccatccggctctgctgcttgctggctgtataactttgaatgagtcccctagcacaaggcccagaaagggggaaccctcagggatctggctgtccccagccctgcccctctctcagactcgaccctgcctctttctgcaggttggctcagagacacaggcccccagggatcacagcaccctgccctcatcatctgcatttatggtccccacaagtcccagactcgggaggacggacacacccacaggccaaacaaggcattaggaacatgggatggcacagcttcctgggatgccccagcttcccgggatgccccagctaatggaatcgcacccagtcctggctctgatcgcagtagcacatctgacacgtgccctcaatccctccctacctcgtgacccataagcagccttttggcacaggcacacagccattagtcaagcaacctgtgagaaaaacactgcctggccatgcaaaacaaatgtaggtggcccattagaaagtgaggacttgtttgtgaaaaggtacatgtatggaatgcaacagcctcctccctctgtatctgacttgggagcactttcatcataaaattttggttgacactagatgtgttcttacttgtaagacagcacagttatcaggaagagtcacagaatgtcaacaacagaagggaccccaaagataaagtagtccagtgccccatttgacagatggggaaactgaggcctctgtgttcccagggccccagcctgctccccttggacactgcacctgtgtactatattgccaatgactgtttacaagacacctcgcacaccagacagtgaattcctggagaccagggtggtaccttcatctctgctgccctagcttccctcacagggccaggcagccaggagacacccaataaaggattgctgaatttcaaaacaatacgtgtacatgataaatatatacagtatttgtccattttaaagggtaatcaagtttttaaaatgaaaataaaggattgctgaataaatgaacaaccagagaggcggccaccagccaaggacaaacaaagctgaatctggaacactggcttcctgctgtcctctcagactaaacgcagtaggtactgggtcactgggagaatggcaaggccagtatgctgtgtgtgcagggacagggcacccccaggttgggagccaagcctagtcccagccctgcctctggcattggcattggcgtgctagccatttgaccaccagagcagcccctctctgaagctcagtttcttccattcttgattgcaggacaaataaacgtcaccttacctacccaccagtgtctcagcaaggaaggagagagagaaggaaacgtcaccttacctacccaccagtgtctcagcaaggaaggagagagagaaggaggtgaaagtgcactgaagacctaatacacaatgtatacttaagcgggactgtcaggggacaaaggtattcactggggaccccctgcccccacccagtaatgctgccacattttccttatccaccagcccatttactcctccataaccctgttaggtaatgagaacagacatctcagccccactttactgaagagaaaacaaggtcgagagaggccatcgatagtgtctgtcctccagtggccctgccaggccaaggggttgggggcacggcaaagggctccaggagtccctgcccgccccagacagcagcacctgccaatcttgtgtatcaatgggcagcagtgctgggctgtgacttgccaagtccatagtcagtccctgaatgccatagggaagcatctgctctggacggtcccgtgcttgggggcagaatgacataagtccaaagtagttcaaacggaccagcaaaaagtaaccaaaacatagccaacggcctgtggactagaagtcagtgcagacaccattacctggttttctaattctccctggaggaaactggatcaatgggggatgggggaagggacagcagtttttgaccccctactccctgggcctgaacccttcccagagctgagtcctcttctccactccctactgtctccctacccggcgcgtggcccgcatggggccttcccacaggtggactgatttttctgtccctcagaaccagagccagtggacaaaacctccgttcccaaactccaagccaccaatggaaggcctcacataggaagctgtgggtggaagatggtgcgtttctactgcctggtggttttagatctctatcgcctactcagaatctgaaccctagcctgtgtgtgtgagaggctgcacgtgcacatacaaaaacagcaaggtatctacaaggggggtcaggattgcagaggggctacctgtgtgagctctggagcccaactgcctgcctgggaatcccagcttacccactgactagctgtgtgactcagggcaagttctttaaccactctgtgcctctgtctgcacctcactctccttgcccctaaaacaggggtaagcaaagtacccacctcccaggatttttgtgaggctaaaatgagataacacctagcacacttgccagacaagaaaagttctatttttccccagcacaatgttaatagggttgcctctgggattttgtgtgcttttctttttcttcttcattaattaaattttctacatgaatgtgcatgctttattgtcagcaaagaataaagctttttttttttttttttttttgatggggtaggaagaacagctcagaatcccaagtaaccctttcttttaaacacagaggatggaagcagccctctctctgctggtctattttaggatcttctggatgggcaaggagttctactgcccaaagcagcccaaccttttctgctccctgattcccagcgtaccccttccccacctctgcccatccagaaaaactcaaatctcacctcctccaagaagccctcgctgctagctcagcacctctcttcctcctggggaacaaggcctttcctcactctgccctcccctagctggcactatccactccagaggtcttgtaccggtctctgttccaggggcaaggggtttgccaagaccccagcacagcggtcttgaggggcagggccaccttccttcctatgtcctttcaaagcactcgctctgcttttcttcttggaacttcgatacaaccttatgagaggtggacatgggttcagggaagaaaagtgatgagcaggtcacactgctggacttaaccccagtctgaccaagtccatcagggctcactctgcagccccaggctgcttcccatgggaggctcacagcaggcactcagctgacagaccctcacccgcagggcagcactgccctggcccatcatacatctcttcctccaccctgtccccgccaatgccgtttcactactcacgccccttctccttcctccccaggatttcccttctcctctggctgtgctttggtctgcagtgaccctagctgatgttctgaaggtgttcagagctaaggaggccagtgaccccacatcaaaaggggaaaagagagaaaaagtttctgagctttgtaaaagatgctactggtttttctctgttttatgtcaaataacctgtaacactcctggcaatggtacatttgagccctgagtatagaaaagaatttggcaggacagtttaaaatgtccagacttgaaggtgtcagattttgtaagtgaagaaattcagaacacagaagcaaacctcaattcagggacactggagaagtccctcagctgttcagaccacagattctgtaaaaaaaggatagcagatgtccccagatctcccagtcccctcccaagtttcaagaattctaaggctatcctggggatatcagtagtcagcgtaggctgggcgcggtggctcacgcctgtaatcccaacactttgggaggccgaggcaggcggatcacttgaggtcaggagttcaagaccagcctggccaacatggtgaaaccccatctctacccagggctcaaatgtaccactgccaggagtgttacaggttatttgacataaaacagagaaaaaccagtagcatcttttacaaagctcagaaacttattctctcctttccccttttgatgtggggtcactggcctccttagctctgaacaccttcagaacaaaaattagccaggcgtggtgatgcacgcctgtaatcccagctactcaggaggctgaggcacaagaattgcttgaacccaagaggcaaagtttgcagtgagccaagatcccgccacagcactccaggagactgtgtctcaaaaaaaaaaaatagtagtgagtgtaaatgtctatatcataacaacgtgttctaacaaagatctgtcaaccatggataatccagattttatttggctagtataacgttagcataacaaccagttgcaacatgtttcttcagagcctagatttttaaaaaatctataaaaggcaggtatagggcaattagagagatttaagaagaactatagactagaggatataattgcatcagtgctgaggttcttgggtctaataatggtggtgtgtcatgtaggaatatgtactggtttgtgcatacttcaaggtttaggggtaaactgtcctgatgtccacaacttttttccaaatgaatcaggaaaacaagttttatatggatacatctgcagagtgagaaagtaaaaaagcaaatatggcccaggcgcagtagctcactcctgtaatcccagcactttgggaggccaagggggggtggatcactgaggtcaggagttcgagaccagcccagcaaatatggtgaaaccctgtttctactaaaaatacaaaaaaatttgccgggcatggtgacgagaggctgaggcaggagaatcgcttgaacccaggaggcagaggttgcagtgagctgagatcacaccattgcactccagcctgggccacaagagtgaaattccatctcaaaaaaaaaagcaaatatggcaagctgttaaccactggtgagtctcggtgacgactaaacaagtgtttatcgtactttcccttccattctttgatggatctgaacattttcaaaacaaaatgtcagagaaagaaagtatcattaaaatgtttaaaacagaaaattcgaagaaaaataatcccactgcccaaataattctataaaatatttgttgcttactgcaggaaaaaaaaataggcatcaaaaaattaaaaagccaggcatggtggctcacacctataatcccaacactttgggaggctgaggcgggcagatcacctgaggtcaggagttcaagaccagtctggccaacatggtgaaaccccatctctactaaaaatacaaaaattagctggatgtagtggtgcatgcctgtaaacccagctactcaggaggctgaggcgggagaatagcttgaacctgggaggcgaaggttgcagtgagtggagactgcgccactgcactccagcctgggcaacagagagagactccatctccaaaaataaataaataaataaataaataaataatttttgctatttaacaattgatttaaaaacaagtgagtaatgttgtgctactgctgccatgtttcatgtaccccaaaagggaaaatatcctaagagaatctttcctcttaataaactaatgtttaggcaaacagataaaaataacacttgaagaaaaaatctggttggctcatgcctgtaagcccagcactttgggagaccgaggtgggtcaataacctaagcccaggagttcaagaccagcctgggcaacatagtgagaccctatttctacaaagagagaaagagaaagagaaggagagggggaggggggaaagggagagaaggggaaagggggagataggaaagagacaaaagaaaagagaggaaaaagaaaaagatctatcatataatttcttagtggtagaattaaagaaaaaaaaaaggatgtggttcccaaaatgagggcctatacaaacacaggagacatgatgaagtttgaaaatattctatccaaatattctggtccccttgtctctgtgtcactggagagtggtagaatttccaggcaggttctatctcctttcccatagatagcatagcccctgaggctccccagagaccctccgaagtcctgtgattgcccattcaggagtgtgggaccaccaaacactactcaagaccagcatggcttcaaggaagctttggcctcagggtagctgctgctaccacaagcaccttcctcccaggagccagaacagccttctccatcagcgcaggtgaccaagtggcacatggctcacttggccaccacgcttaggccaaagcagccctgcatgtccccatcaacctggcctccccaaagacctggattctgtttccacatctccaccctctaccacacgtggactctgcagttccctgggacttcacttttcttggagaaggagagagaaaaagggaagcaaatcctgaattgctcgtaggatttaaaaacctctccacagaggggagctggggacaaggtaggggagacagtgctagcagcacaatctgaggacgggtcccctgccagccctccgggcacacagggagcaaaaggagaggcagaggcacatgggagcaggggctgggagatgctgcatggcgcaggctgtgggcttggctattaaagccagaaaaggcctgcctcctcctgccaatagagttatcttttaatccgaaccccaatgacaccacctggcaccagcgcaggagcagctcctgacggcacacgagtcacgcggctgggccccgcgtctatcccttcaggtcagggcttgccctgagtgctcctgaggaagtgggcccctgccccctccatggcctggctcctgacaggcctgtgcatgcctgagagggccaggcaggcggtaaggaagtagaggaagctccgtgctgtgcaaggtcaccaaatgctagatgcaaagacccagaaagggagggcactcacccaaagtcacccacgccgggacggggcagcaatcccaggattctcctcctacccagatgcggcaaagaggtttgcagcccaggacagctgttatcaactagccagtgctggaaaacagcaggtagcaccccagacctgccactctccacgtactcagacaactcatggcccaatctgaagatggctttcctctgaattctcccacatctgtgccctcctgcagggcttggtttctgaggtcccatccgccttgaagttggcaagggctagggtagcatgtaacctatctccctagtaaggatggcactgactctgctgtggcagcatccaggccaggcagccatccaggccctcccagactgggggagctcagcacctccagaggcagccacctcaccacagaccaacacaccctgctgcagcgttcttccttgtgggcaatggaaatctgccagcaggaactggtagcagaaaactccccaaagcctgctccaattctccaccccagtacaatgggcgtgccctcaggattccaacagccaagggcaaaatcccgactcactggcttgggactctgggcaagtgacttactctctctatgcctcagttccctcatctgtaaaatgaggagagtagtggccttcatcttagagttgctgggatgagatgatccttgcaacctcccggggcacacatgagtggtcaacaaatgctttctatggctacactacaatgcacagttccacaggctcaaggcccagctttctgcccctctcctcatactcattccactttctcatgaccagacttgtgctcagcaagtgtccactcctataggttcgctcaggggtagctggctcaccagggacacattttaaaccctggcctcttcctccaaaacttcagctcagagccttggcaagccatccctgccgcccactggagatggctgacgagaaaaccagaaagagaccatgaaagaggaaggctcttctcactcctcactcatccttatcttggaccagtatcctccacacaacaccaacacccaaacataacagcaaatggatataatcttatcaatttcatcctccacaaccttctacggctccctctggcctaaagtcaaaaagccttaccccagactttaaaaggaagagataaacacttagtgaacatttgactatgtgtcaagttctctgctctacagtgtatatatattatatcatttaataactccctctaaaattcgtcttattgcttgcatcttacaggtgaggaagctgaggctccaagacactaggcaacttacctaagcgtcacagctcagaaacagaagcagatttggaggccagatctgggaggccacaaggctgggtccttggcacagcctctacctcctctccaggtcatctcctgcaacccctccctgacccagccactgtccagtcaccacggtgcccatggtcacctggcacacctggctgtgtcctacattaatgcatatcctcacgcttctgcttctcctgcctggaacgcacctacctatcacctaatgaacttctactcagcccagaaagctctgctctcaagttatctccttcaggagacagaccttcaccccggggcccccttccataagagaaaaacgatcccctttggctgggcatggtggctcacgcctgtaatcctaacactttgggaggccaaggcgggtggatcacttgaggtcaggagtttgagaccagcctggccaacgtggtgaaaccccgtctctactaaaaatacaaaaataaagcctgggcacagtggctcacacctgtaatcccagcactttgggaggccgaggcaggcatatcacgaggtcaggagtttgagaccagcctgaccaacatggtaaaaccccatctctactaaaaatataaaaattagccagatgtgatgacatgagcctgtaatcccagctactcaggaggctgaggcaggaggattgcttgaacccgggaggcggaggttgcagtgagccaagatcgtgctactgtactccaccctgggtgacagagcgagactccgtctcaagtaaataaataaataaataagcaagcaagcaagccgggcatggtggtgcacgcctatagtcccagctacttgggaggctgaggcaggagaatggcttgaacccgggaggcagaggttgcagtgagccaagatcgcgccattgcactccagcctgggtgacagagtgaaactccatctcaaaaaaaaaaaaaaaaagaaaagagaagaaaaaagaaaaacaatccctttccttggatgtgtttcccaagcgcccacagcaaggcacaacttatcagtccccaagtcagctgtgctgccgtctgctccctaatgtggaccattcatcctgactactacagcacagtacgtttacttgaagaagtgaataaatgatgttccttctgacttacagaccaagaaacagggccgtcagagcagacttgacctttacagggacaactggtaaacagcccatctacagtagcatcctggaggttacacctggcaaagagttaccccttggctgggtgcacctgagcaaacccatctggactaacgccggtgtcaggaagtagcacatccacacagtgcagctatggccctctgaggaaagactgctgcatcgcatcagaaaggcagcatccgtgacttctgcggtccacgctgacgggtggggaggcaccttggggcctccttcccgcactgcagacaatggctgggaagcccacaccccagcctcctggcactctcacttctaggcacaggatgcagcaacccctggcaaaagcagctcctctttgctgacctggacataaggacgccaggacccacagtgggcctgagccaacagcacccggctccaacggtggagcagcccaaggtccccctggggaagggctggaaagacgagctctctgtcctgacccacttctccctgcacactcttcccagatctggcctggcccagccagaaagccaactatgagatccttctcatcttatgacattagtaagagaaatactcactcgtatgctggtattagcacattagactccccaaggccactcccactttacagaggaacaaagtgacacccagagccaagtccctaaactgagctcctctcactcgctgccaccgagctgcactcacaccacagctctcccttagagggaacagacaggtgtggtctctgtctcccttccaggacaggcttggacactgaggagatgccgtgcctatttcccaaacaccgagtaaaaggaacccctggggtccagcccacacccaggttctgattcacagacctagggtgaggccaaggggtttaatctttcagaagcttccccagtgactctgaaaaagccaatccaaagactgcacccggggaaccccaagcgtgaacccaggactgctgtttcagcccagcaatttgtatcaacagccgttcaaagtccacaccctttgacccaacagcaccacttctaggaattcatcctgagaaaataaagaagcatacaaagatctatagcatgaggtgatgcaccgcagcattgtaagtacagaaaaaatgggaaatctctacatctccaatcaagaagaactggtgacataaatctcaatcaggcaagactgtgctcccattaaaaacgagccattgagggccgggcgcggtggctcatacctgtaatcccagcactttgggaggccgaggtgggcggatcatgaggtcaggagatcgagaccatcctggctaacatggtgaaaccccatctctactaaaaatacaaaaaattagctaggcgtggtggcatgcgcttgtagtcccagctactcgggaggctgaggcaggagaatggcgtgaacccagcaggcggagcttgcagtgagccgagatcgtaccactgcactccagtctgggcgacagagcgagactccatctcaaaaaataaataaaaaaataaataaataaataaataaataaataaacgagccattgagcatccctcattctgggcgacagagcgagactccgtctcaaaaaataaataaataaataaacgagccattgagcatccctcattcaaaaatccaaaatgctccagaatcccaaactttcagagcatcaacatgagatagtaacacctttgcattctgatggttcaatgtacatacactttgtttcatacacacaattatttaaaatagtgtataaaatcaccattaagcagccgggcgcagcggctcacgcctgtaatcccagcactttgggaggccgaggcaggcggattgcttgaggtcaggagttcgaggccagcctggccaatatggagaacccccgtctctactaaaaatacaaaaattagccgggcgtggtggcacgtgcctgtagtcccagctactcgggaggctgaggcaggaggactgcttgaactcgggaggcagaggttgcagtgagctgagattgcaccactgcactccagcctgggtgatagagtgagactctgtctcaaaaaaaaaaataaaaaagaaaaataaaattaaaaatacaattagccgggcatggtggtgggcacctgtaatcccagctactggggaagctgaggcaggagaatcgcttgaacctgggaggcagaggttgcggtgagccgagatcgtgacactgcacttcagcctgggcaacagagtgagactctgttttgaaactccatctcaaaaaaaaaaaaaaaaaaaatcacttttaagctatatgtagaaggtatatatgaaacataaatgaatttcatgtttagacttcggtcccatccccaggatatctcattatgtatatgggaatattccaaaatccaaaaataatcaaaaatcggaaatacttctggtcctaagtattttggataagggatattctgcctgttacagcatcagacctaaaacttggagcccacttcaattagtgcaggaaggactgcagatggcatctacatacaccatgaaggtgatagaactccttccctgacatggctgaggttctacttgaatattcccagaaaacaagagctctcgcaattccttaacagtggtttctggcaattaaaaggctgctctaagtcaagtgtggtggtgtgcacctgtatctcagctactcaggaggctgcagtgggaggatcagtgggaggataacttgagtccaagagtttgaggctgtagtgcacaatgatcacgcctatgaatggccactgcacttcagcctgggcaacatggcaaaacccccatctcaacaaaaggaaaaagaacatgttgctcctctcattctgtcttgctgccaccatgttagaagtgccttttgccctccaccacgattatgagacctccccagccatgtggaactgttcataggcggaagggacttgccttgtctcagatgagactttggactgtggacttttggattaattctgaaatgagttaagactttgggggactgttgggagggcatgattggttttgaaatgtgaggacctgagatttggaggggccaggggtggaatgataatgatttggctgtgtccctattcaaatctcaactgaattatatgtcccagaattctcacgtgttgtgggagggacttacggggaggtaactgaatcataagggccggtctttcccatgctattcttgtgatagtaagtctcgggagatctgatgggtttatcaggggtttccgcctttgcttcttcctcattctttcttgctgccacattgtaagcagtgccttttgccctctgccatgattatgagacctcccagccatgtggaactgtaagtcaaattaaacatcctgttcttccaaataaaaaaaaaaacaaaaacatgttgctcctaatcctgagcagagttttactttcctgaaggtaaaatctcctggctccggccgggcgcggtggctcaggcctgtaatcccaacactttgagaggctgaggcgggtggattgcctgaggtcaggagtttgagaccagcctgaccaacatggtgaaaccccatctctactaaaaatacaaaaattagccgggtgtggtggcaggtgcctgtaatcccagctactcgggaggctgaggaaggagaatcacttgaacccgggaggcagaagttgcagtgagccgagatcgcgccactgcactctagcctgggcgacaagagcgagacttcatctcaaaaaaaaaaaaaaaactctcctggctccttgtcatttttaaaaatattttcatagagatgagttgtcactgtgttgcccgggctggtctcaaactcctgggctcaatcgatcctcccacctcggcctccaaaagtgctgggattacaggcatgagtcacctcatccagcccatcttcctgtcttatgtagtatcacaagctcaataaacacgtggaatggagtggttgttttcctagaccattcatactttttccactatggccaagatgagaatatgggtttttacaagcactgctgatgcatattcacaatgccatctttaaatcaagtgtttgcgcacctcttccttccacaatcacctagctaatcatccttgtccctacgttaaaaacacccttgtccctgctgtgtcaactatcacatgacctgaagttgtccctccccacctggtgaccttaacagctatgtaacagcatgggtaactctttaccaagaccatttctgggtgaacgacctgcctgaggttgccagctcagccaaggcacaaggtgccacagagttgagtgatggagcacagccaagaccctcccctcaaagacagcactaggatgggaaagagatgtatttatttcctcttctctctctcgtcttatttatttccttttattcccatttccctcccctcacccacagtcaaccattctcttgtgttaatctgttcatattcttgcaagatgggtattgttctatatcagcaatctacataatagcactgcaccatccatgctctatttcttatgttttcactgagcactgtgcatttaaatacatcatgctgcctgccacgtgtgcttctcaccagtcacttggaattgctgcaagggactacagactcatacccacccattatacccatttgctctgcaggaatggacatccagctctacctcaccaccacaaacaacactgcagtgaacaccctggaccttccccttaggacctgcatgagaacctggggaactgacacccatgggaggggcttctgggtcagggctttgctggtaccctgccagaggctccaggacagctgcaactgcaaaggcaagagttcctgcatccccacacccactgctgataggcagcatccagctttctagttcccaccagtctaagaggtgaaacaggatcgagctcaaggttgtgttccagtatggattcttaccaaacctgactgaaccgtacctgctaagggaatggcaggaaaagcacttgtaccgtaagcatcactggtgtgaaatggaaacaactgctcattgataagtctccactgtgaggcctcactttcttgaatcgtcagggacttctggaacacaaatgtcatgcactggcctacaaaatgccatcaatcccaccttctcccactggctgaggctcctcccaaggaggtcgactgttcaggatgggcagcaacagtgctgcgctccacttttttttttttttttttttttcctgagatggagtctcactctgttgcccaggctggagtgcagtggcacaatcttggctcactccaccatccacctccccagttcaagcgactctcctatctcagcctcccgagcagctggaagtacaggcacgtaccaccatgcccagctaatttttatatttttcagtagacatggggtttcactatgttggccaggttggccttgaactcccgacctcaggtgatccacctgactcaggctcccagagtgctgggattacaggtatgagccaccgcgcctggcccagagctccacttttttatttgcaatcacatcatccttctattgatgacttacctgcagctcacactacacaccactcaccacgtgatctgacaacactgaagcagtctatacctgttcaatgagtactagcaaggtcaagttgctctaaaggttgctaaacactcaatctctgtgcttgcttacttcatcacagaccaggaaccagaagattgcaaaccagcactggtctgtagaccacaccctgagttgggggtagagtagggagaaacaaaccaaccaacccgccctggatgtcatggctgggctcctgcccccctatgccacttaaacagccatggaactgggacaatcataagaatgaaaataactgggccggcgcggtgactcatgcctgttatctcagcactttgggaggccaaggcaggcagatcactttagcccagaagttcaagaccagcctgagcaacatggtgaaaccctgtctctataaaaaatacaaaaagtagccaggcacagtggcatgcacctatagttgcagctactcaggaggctaaggtaggataatcaattgagcctgtgaggtggaggtggccatgagctgagatcatgccactgcactccagcctgggcaacagagttataccctgtctcaaatacacacataaatatagcagcttacgcttacacagtacttaccatgtgccacacactgctgtcaacacttactaacttatttaaccctcacaatacaaggtcctgttattatccccattccacagatgaggaaaccaaggcacagagagagaaagcaatttggccatggtcacggtaagtggcagattcaggattcaaacccagtatcttggctcaggtacaggctcttaattactctcctaaactgactcctgagtaacccggccttccttacctgtttcctcacttgtaaggtcaggtaaggacccctaaaaggttgctggtgagatcaaatgagaaaataaatacaaaaataataaagtatcctatgcaacacaacacctaccacctacacagcatacaaccacccatgtgtggccatgaacctgcagcagccacctacctttcacacaagccacaagagggcgagggagtcacggatcccactgcagaggtgaggacatgaggcctggaaagcagaggtaccctcagccccctctctccttagccatgctcttctcctccccaaagagacagccacaacacaggaacatgtcccacactccccagaggacacaccaactctatttccaaacatccccactgtaactctcagagttgaaactggggagaacgctggctttccaatcctcctagcaactcacagacagccagtcagacacctcaggggatcctgggaaggccagccagtctacatcctcacctacccacctgcggccaccgggtcctccttcacacatcacagaccacccatcagcctcccacccaatgccaacccaacccattcccctctccagccccagcagcctcacaagagaaccagcccagagagaatgactggaaggacagcagaggctggttggcctggcctcatttttccagcacctgctgagcgaatgctccaatcagaagccctgaattaccagacaaacccgccagtcacagaatggattctctcccaagtcctgctctgtgctctcccctcgccaggtctacctccctccttccagccgcctgcctatgcccagctcaccatacaccctccttccttaggcactgaaacttcaagcagcctcacctgtctggcactatctgtactactagatacccacttgttcaagttttccaacaagacaataaactcctggggggtggggggagagaagccatcttctttgttgcccttctgagaatctgatggatttttagacacaaaaacacttgccatgtgctataaagcacaaaatggaaggtgagaaggaggaagtcagtataagctaggctgattattttctggtatttctaaaagctccacaatagagcaattaaaaaggaaaacctttgaaacacaacagcaggatatatatgttccagctaaaagaacgaatccaggttggaatattgttcatggtagatatctttccatctttgcatgctcagcacttagccgagcctggtaaagagtagtgaccaggtacttgctggagagatagacagataaactcttgtcagaatctgggctccaccctaaagcttgtgttatctcatgcaaggagaagacactgtgaccagctccactgagttctcatgagaagcctgaagatgagggaggttacagaaaaccaaatactgcatgttctcactcctaagtgagagttgaacaatgagaacacatggacacaaggaggggaacatcacacaccagggcctgtcaggggtgggggtctaggagagggatagcaacagaagaaatacctaatgtagatgacgggttgatgggtgcagcaaaccaccatggcacgtgtatacctatgtaacaagcctgcgtgttctgcacatgtaccccagaacttaaaggtattaaaaaaaaaatgagggtggctgaggacaaaagatcaagactacatgaaatttcacaacttcccacagaaacaaggacagctggtcaccgttttgttctctctccctgggctcacaaaatcgggggaaatgcaacaagatacagaaaggtggtttgccattttctagcaaaaatgagtggggggatacataggcgcatatatactcacacccacagcccctaaactctaaaccgccatgggtttagctccgtttttttcaggagaaggactcaaaaccagcacattttggttttgtttactttcctgctttttcttggatccagctcctactgagattggctatcagggtgggtcccaactcagtgtccacggggccttatcctcttatctttataaaaggcttttttccctgggacaagaggcccggtggcctcattttcctgcctgaactctgccctgtgactaagcaagaagaagccacggcagccagcacccagagtttctgctgtgtcacaaaaaggagtcatgggtctccctgccagcatcagacccattccccgactcagcactcaatttagatatcacgtcctacgtctacatccagaaagcccccagtgtgacagatgctcagaacacatctgctgaatgaatggacgaatgctgtgacgaagagaggtggagaggtaggcaaggctcagaccacagaaatggtcacagggtggcctgcagtaccgagtaaaggtagtcattatcaaaaaactgacaaggactccagggcttgcctagcctctcagcagctgatggccctgagcaggctaccaaactctactggccgagtgtgcccatctgtaaaagataaatatcaattgcagaggctgataaaagatttttttcattgatcaggaattaaaggctgtagctcaagtccagaaactgggatgctgtgtcacttgctcaccctcactgtaaaggctggtgcccacaaagccaggagaatgtcaggaaaaactagccacggatctgagacttcccacccagcctgctcctggtaaagaagtcttggaaggaaccccagcctgggaagagacctgtttctcatttgtaaaataaggagtttgggcaaagtggtttctaagatcccttccagccatggcattcaacaatcataggctccttaagaaatgtaggccgggcgtcgtggttcacatctgtaatcccagcactttggggggccaaggcaggtggatcacctgaagtcagagtttgagatcagcccgaccaacatgataaaacgccgtctctactaaaaataccaaaaattacctgggtgtgatggcacacgcctgtaatcccagctactggggaggctgagacacaagaatctcttgaacctggaagtcagaggttgcagtgagctgagactgcaccactgcactctagtctggagtgcagcctgtgtgacagagcgagattctgtctgaaggaaaaaaaaaaaaaaaaaaaaaacataaacaggaaaagaagttctggtcagatgagaagaaaggttacttggaatgagaatagaggttaccatgaatactgaaaaggccactatatattttttttaagaattaaagtgttttattgattgattgattgattgagacagggtcttactgtccacccaggttggagtgcactggcccaatctcagctcatgcaacctctacctgtcaggttcaagggatcctcccacctcagtctcccaagcaactgggaccacaggcatgcgccacagctaatttttgtattttttgtacagatggggtctccctatgttgctcaggctggtctcgaactcctgggctcaagcaatccgcctgcctcccaaagtgctggaattacaggtgtaagctaccacacctagccagaattaaagtattttaaagtattacttcttacgttaaaatatgtaaatagaattagattttgtttcctttgttttgctatcaccttcctcaatattggctggaaagatctttactacatttggatagcagattggcaatggtcaaatatgtgcagatttaatttggggactcaggggtcatcttagagccagggaggtaccattcagacaagcaaactggggtggactctgaagaagaggtttgagaggcatgccacatctataaaaatcctgttggcagggaaaacacaccctggcttgaggtggccaccagggcagcagctctgagtcagagatggccatctctaatggcaccgctttccacacgggcagccctgcagcccccacggcaggctgcatgttagcaggagcttgtttacgcataaaaacgaacagttctcttatgcaatagaggggtaaggcaaacaagtgataacattttcttaaaaaaaaaaaaaaacaggctgggtgtggcaactcatgcctgtgatcccaacactttgggaggctgaggagggaggatcacttaaggccaggagttcaagaccagcctgggcaacacagcgagaccccatctctatgaatttttttttttaattagctcagcatgatggtgggtacctgttgtcctagctactcagggaggctgaggcaggaggatcgcctgagcccaggagttcaagattacattgagctaggatcatgccatcaatcatgacagcatgggcaacagggtaagaccctgtctctttaaaaaaaaaaaaaaaaaaaggttaatttttctatttatatctatctatcaatttatttatagagatggggtagggtctcactatgttgcccaggttggagtgcagtagctattcacaggcatgaccccaccactgatcagcatgagagttttaacctgctccatttctgacctccttaggcaacctggtggtctcctgctcccagggtcaccatattgatgccaaactggccacctgattagcatagcacactacagcccagaactcttgggctcaagcgatcctccctcctcagcctcccaagtagctaggactacaggaacatgccagcatgcccacaagaataatttttcaaaaaaaaaaagtaaccactgctcactgcaattgaccttctgatgggattttcactctgctcctccccacatcactgtcctggttaacagagagtggtttttactcgccacaaagtggctatgtgtcttttttaaaagcacagttcatcccaagaggaaacctacaaaggaagcaggtgaagacaagagtacccagtgaaaacaccatctgcagcctctggctccagcagtggctcaccaccccagctcagctcacgcaaagcaaggtgaggctttcaggtggtgcttccctctcccacatggggagcatcttaaaccaaaagcaagcagaccagtggttttcaaactgggttctgtgaactgtggagaaccccagggaaacctgtggaggagcctcaagaaggccacaagctcaagggacaagctccaagcccatactccccatcagtgcctctctcgtctaatttacagatctggctctcacctaagagtgcagttaacaaaaaagacctcatggctaaaaaaaataaaaataaaaaacttaagtcataaaagacatttacactttgtacgtgttatttcatttaattgtttgcatcagccctctgaggaaaccatggctaaacagtttcaggattgcaagtcgccacctagaacagtccactccagagctggatagcaccaatcatttttaaaagttcttcctgaaacaaccggcctgggcaaggggagctgccagggattataaaacagacttcagagacaacatcaactaaatgcagtgggtggcccttgctaaaatcctgattttaataagccaccaataaaatgacatctttgagacaagcaaaactgagcatcacccgggcaacttgataacattaagaaattattattaatgcctcatctcttagagacacatctttaagtatttataagaaaaatgacatgctgcctgggatttggttgggagagatgggtgattgttacattatcctctctgttcttccacatgtgtgaatgtctttttcattttttacttttttagagctggggtctggctctgtctcccaggctggagtgcagtggtacactcagagctcactgcaacctcaaactcttgggctcaaccaatcctcccgcctcagcctcccgaatagctggggatacaggcagtgtccccttgctcagctaatttttttttatttttgtagacatggggttttgccgtgttgcccaggctggtctcaaactcctgggctcaaggaatcctcctgtctcgacctcctaaagcgctgggattacaggtataagccaccatgcctggctcttgaaagtctttaatagaattttaaaaggaagaaagacagggagggagaatggttcttccttaaaatgaactcaattctacctccaagtaccttctggcaatcagaccatgttcagctttctgggatcaaagagaatcaggtcttatcacataccctgcaccatctgaaaatgagcagcatctaagtccctctaagtatcctttcctcaaaaacaagctcttcaaggtccttttggaactgaactcacaggtcacagcaatgccctccttaaaaatgtgggcttcaggaccaaagaattgtgaaggtgtcttttgagcagcccagagaagcatgggcctcctcgtccactgcaggcctctgccttgggcatctcccatttgaactccaagtatggcctatgccctgggatgcctcctgattccatgcacaggctgggagcttgttctctactcagggacaagctacccccagtagctccagaggcggcagcagcagcttgctcctgtctcacctaaatcatctccaccctcaccaaagccctgggtgaatattattagcccctcttctacagatggggaagagaaagcaggcccaggaggttaagcgacttgaagtcacacagcttaggagtaaagagctaagatttaagccccagtctgtgggggtccccaagagtggactcatgacattcagatgtctccagtcccgcagccttgctccctggctccaaacccaccaagaatgccccctgggtcattcatccatgtccttctcctcccaggagtaacataacactctgaaagcagagaccaccttccccacctcctagcccagaacctcccaggggctcagcaaagagttgcccaaaacttaaccagtcccagacctgcagccgccaaaccaccaggatggctctccacaaatctttccaaggctctcccagaaaccccaactgtggcccaaagcccagttctcttcactcatttctagtctctagagcaattcaaagaataatgatcacaaaaccaggcttcattcttggcgaactccataggggaaacaggaccagagaagacacacatctataaaataatgactactagccccagaatcacatgtgactatttcagctggtatcagaatttaaaagactaggggctgggcacggtggcttgcacctgtaatcccagcactttgggaggctaaggtaggtggatcacgaggtcaggagttcaagaccagcctggccaagagagtgaaaccccatctctactaaaaatacaaaaattagctgggcgcagtggcaggcacctgtaatcccagctacttggtaggctgaggcaggagaattgcttgaacccgggggacgaaggttgcagtgaaccaagattgcaccactgcactccagcctgagcgacagagtgagatgccgtttcaaaaaaaaaaaaaaataggaacgtttagtgttttggtactctgaatgagagggctaggggaaacgtaaaaaaatgatggtatacgttgatgctccagtttcacacattaatgttttaatttcccaaaaatgcattcctcagaacactgatgtcgcaagatgctccatgataaaggactctgtggttaaatcagtttgggaaacactgcctaataaagccactctagtgaagccccaaagcacactggcttagccctctcaaggggcctgcagaaaagaacctagcactgcctggatgcatttgaccacagaacccttttagggcatagcaacactaacatcccagcaaactagcagttagaagatgtttctttgggaaatgctgatctaggccttttgaaagaaagtctcaatagccttgttatcccggatttgagactgaaaaaccaaaccaatcctaaacgggataaggaggaagtatccaaagagcaaaaataacgaacatgcttcaaggcctttagggatgaagatgtaagtactgaaaacacaaagaaaatgtgtgaacattccttggctgccagatatgaatgccactaggattgtttggttaatgtctggcctccaaagagtcacatgtaggacaggtgtggtggcttattcaataatggattgtttgaggccaggagttcgagaccagcctgggcaatatagtgagaccttgtctctactaaaaataaaaaaaaaattagctgggcatggtggcacacgcctgtagtaccaactactcaggaggctgaggcaggaggattgcttgagcccaggaggttgaggccacagtaagccatgatcatgccactgcactcagcccaaacaacagagcaagaccctgtctcaaaaaagaaaagagtcacagataactactgaactgtcctaagactttccaaaccatatctgaaggaagaaaaaaaatttttttttttgtaagacagagtttcgctcttgttgcccaggctggagtgaaatggcacgatctcagctaactgcagcctctgcctcatgggttcaagcacttctcctgcctcagcctcccaagtagctgggattacaggcacacaaccaccacgcccggctaaatttttgtatttttagtagagatggggtttcatcatgttggccagctagtctcgaactcctagcctcagatgatccacccgcctcagcctcccaaaatgctgggattacaggcatgagccaccacgcccggccaaaaacaatttttagaagaaaaaaaggaaagaaaatgctatccacccccatgtcagggtgctgtgaacagtatggatttccttaattaaaactcagagtaaacagtatggtaccttctcaaaaaattgaacacagaattaccatatgacccagcaagttcacttctgggtataaacccaaaagaagagaaagcagggactcgaagagatatttgtacacccatggtgtcatagcagcattattcacaatggctaaaaggtgaaaacaacccaaatgtgtccatcaacaggtaaagaaacaaataaaatatagaatatatatatatatatatatatgaatattattcggcctaaaaaaggaattttgacatatactaaaatatggatgaaccttgaggactttatgcttagagaagtaagccagtcacaaaaagacaaatctgtattgacttcacttataaaagatacctaaagtagtcaaattcctagaaacggacaacttgagaggccaaggcggccagatcgcttgaatccaggagttcaagaccagcctgggcaacatggcaaagccccgtctcttaaaaaaatacaaaaacaaaaaatcagtcgggcatggtggcgggcgcctgtagtcccagctactcaggaggctgaggtgggagaatggcgtgaacccgggaggcagagcttgcagtgagccgagatcgcgccactgcactgcagcctgggcaagagaacgagactccatctcaaaaaaaaacaaacaaacaaaaaaaggagctgggtgtggtggcatgtgcctatagtccctgctactcgggaggctgaggtgggaggatcaattgagcatgggaggttgaagctgcagtgagccatgagtaccaccgcactccatgcattccagcctgagcaacagagtgagactccatctccaaaaaaaaaaaaagaagaaagagagagagagaaagacagcaagaaagaaagaaagaaaaaaagagacagacaggaaatattcatataatggtgactgtcaaggtctagggggccatgtagttattattcaataggtacagagtttcgattttgcaagatgaaaaatttctagagatggatggtgctgatgtttgcacagcagtgtacaaatacttaatgctggctgggcgcagtggctcacgcctgtaatcccagcactttgggaggccgaggcgggtggatcacctgaggtacggagttcgagaccagcctggccaacgtggtgaaaccccgtctctactaaaaatacaaaaattagccaggcgtggtggtgggcacctgtaatctcagctacccgggagactgaggcaggagaacccaggaggcggaggttgtggtgagccgagatcatgccattgtactccagcctgggcaacaagagcaaaactctgtctcaaaaaaaaaaacaaaaaacaaaaaacttaatgctactgaatttgtacacttaaaaagttattaaaatagtaaatgttatatatatttttccacaataaaaaatggttcaaggccgggtgcggtggctcacgcctgtaatcccagcactttgagaggccaaggtgggcggaccatttgaggtcaggagttcaagaccagcctggccaacatggggaaaccttgtctctactaaaaatacaaaaaaattagccaggtgtggtggcacatgcctgtagtcccagctacttgggaggctgaaggaggagaattgctgcaactggggaggcgaaggttgcatgagccgagatcgcaccattgcactccagcctaggtgacagagtgagactctgtatcaaaaaaaaaaaaggttcaaatggtaaatttcatgttatgtaaattattatcacaattttgtttaaatcctcaaagcaaatgggttatgagccttagtgtgaaatgaacgtcaaggtcaacaggaattatctaccaagggtttagagggatagactgccaacatgggacgctccaaacatctctatttggtttaaaatgtttctgtagcacttttgtggaacgcagtctcaaaaagatcaatagagatacaccgttcagaggaatgcagtctatcccaggtaaaaggcgaaaaaaaaatccaatttccccccagcgcaatcccatttaagattcttccctgctgaacacacatagcatccctactgtccaggccaacacgcagctcagccctctttctctatgtttgctacctctgtggctcacatcttcccagggtttcaggaaacgactatagagccccctcgcatggggcagaacatacaggtggttggaatgaggtgggacaaaaaaaaatgagacaacggccgagagtggtggctcatgcctataatcacagcactctgggaggctgaggtaggcggatcacctgaggtcaggaattcgagaccagcctggccaagatggcaaaatcccgtctctactaaaaatataaaaattagccgggggtgatggcacacacctgtaatcccagccactcggaaggctgagacaagagaatcacttgaacctgggaggcagagggtgcagtaagctgagattgcaccactgcactccagcctgggcgacagagcaaggctccatctcaaaacaaacaaacaaaaaaaaaactgaaacaaaatatttatcctactctgcttactttttcaggaaatggaaaaccagagtatcaaaaaccactcaacactaacattaaatcagattaacagcaatcctgatgtagagctggaagggcccccaaaatcgagtccaacccaatcacccaacctccttggaccaaatgccacctgggaagtgctcaaaaccccacaggaatgagcaagtctcccgtcaatgctcaacctcttctgttttgactgttgaactgggggaaaaaaaaaaaacaagcaccaggaagctaaaaggctctgccaaggtcaagattttgcagttaggaacagatctccagttcagggcttttttttttttttttttttttttttttaaagaaaagttcctcagtattcttttgaggacatcaagttgacattcaaattctatgtgtagaaagggaatgactttctactcttagacagcgtgggtgctccacatggctcctggcagccagctccacaccaccagtacctgatgggcaaccttgggaacttcagacatcaatgtcacaccacctgcttccatcacagacataccgtgggcggtgatatccctgtgtacatctggggcttgctcaagccttcctcctctcccacagcctctgccaccatgaggtcaccacttaggaatctgcatgtatatttgaagatgatctggacaaggatacatcattcactctacacacagctgactattcattcgttcaacaaaaaattatcgaacacctatcttgtactaggctctattctgggcatgaggactataacagcaaattcagctcagggaggacagctctgacacctgcttggcatagtatacaaggagctcccacagaaccctcagaaacaccaggagattcccagttttctggttctaaggctagttgctgtctactactgccactgttgtgctatattactcagggtaacaaaatgctcttccatttttcctaccatggattgtcaaatagcacagtgaagtagttagtgttttaattactttgtagaggagataagctcagaagggttaaaaaccttgctcaaggtctaaaaccttgtaaggtctgatcattactacctagacccaccatcccactccagcaatgaccgcctgtgctaactgtattatcgcacaaaggtggtaatgcttggagtggacattcatctgctcttttacctgcgtgacatcgctgctgcttgtcttcctttagacaactgctctgcctccctctaaaaacccacatagtgttggaatgggctgccaatcacagtagcccatcaccttaccctggggttccactgctgggcacagtgccaaagctgagccagtcttagtcctctagccctggccacagtgaccgggcctcatgtggacacataacactggccagaccaatcagaatcctaccatgaggtttgtctgcctgggctgattggatagagctccctttcttccctggtcaggggctgtgaacctgaacagaggggcctgaggtcatgttcagacccgtgggaaaagcccacagcatcgatccaagaggtcaaacgtcccaaaggccagtttccaccatccatccaaaggttgtggaatattctaagtcaatacatttctctttttctacctaagatgatctgagctaagtttctgtcattttgcaataaaggtaccctgaaatgatacacagataaaatctgcccttcacttaaaaacctcttctcaaccattaatttcaaatgactctgccacttcctcttaaataacacaattaaaaccacctaaattagccatgcagggtggcatgcgcctgtaatcttagctactaaggaggctgaggcaggaggatggcttgagcccaggagtttgaggctgcagtgagctatgattgcaccactgcactccactgtctctaaaaaataagtaaataaacaaacaaaagaaccaaaagaaaaaccacaacagctggagcttttacttatgtcccttgccctgctgaccctccagggcagaggggatgaagaaaaggtggctggtacccgaaggaagtggagagagaacaaaaggccaggcaacctctgctgaataataaataacccacacctgacaatcagcacccatctgcattagtcccactagaaaagcctggcagggttattcccttggggaaaaaaaacaaacttccagctctaatttctgacagtgtacaatgcctaaattcaaacctcccactcagcctagccattaaggtcctccagattacctctgcatccccaattcccttccacccagagccaaggccaaacccctgctctgctcaggctgggtaaacacatggctcctctctatggctcagcctgtgcggtccagcctacgcagcccacacgtcctccctccatggctccatgcattcagagcttcacttcaacaccaagtcccagcacattcgtgaagctctcctcggcttctccagcggacgctgctggctccattctcttaagtttgatgaagcaagccagccagttcactaggaaagtaaagaggaggcacaggaggtgtggggagtgggaacgagaaggaaacatcaggcaatgagcacgcgagaggtccagccaagttctgccatttctgcctcccaatagaggcctggtgggaatgacttgaggagtcccacatttagatggtaatgagagccactaaaggtgaatgagagtatctggggaaagtgtgtagcataccgagttttttataaaagaaaaagcctgtttgtgcatctctatcagttgacctgtctcataatgtcactctcatgagcgtcccattcccccaacaaggcggcaagctacggactagaattacatcctgtgcaccccggcccctgtctacaccccagccccacctgggccaggcacttcaatgctcccggtgacagaggcaggcagtgcagcaccattagccccatcttacagatgaagatactgaggctcaccccaggggcagggagttgagaatcctcaagggaaaaaactcaggtgtttccccaaatcaaagggaaaaaacaaaggactgcatggggctccaagtgaccaagctagacttggttactgggaaaaacaagagacccaactgagccactcagaagtaaacaattctgtcttctccctaccaccagctggggcaaaggtgttcgcttgttccccgcagatccatgtatcaaatccgggacaaaagaaagctacataatttcagagtcccacagtgactggaaatgtcctgaaattgtagtgggaaggcctaaccagggaacaggaaaaaccaccccagacaaggaatcaggggcactgggcttggccttgactcaggcacctttctgccctgcgacttcttccttacagacagggccctggaaccaaagatcataagacaccactcatctccctggggctgccacagagttaatgagatatgaagataggacacaaaatcctgaatgacaatgccctatcaataccggaataagagccacacctccaacaaaaaaaccacaacacagtgtgtctcctagtcactccacacccccaggcctgagcgtggtaggtttaaatgtctggggatctaactcagcaagagttgccccgatgggttgggtttgctcacctgcccaccaacacccaggcacatgtcctccccagtttccttccagttccaggccccacgtggtaggctgctgccgatgcagactccctcagcacccaagtgccagtgggggatgggcattctggatcaggagcccacacagggtgtggaatccatcaaggaagctcctaggtgggtgatggcatcatctccaacagagaatcggtgccaaagcagccaccccttgacgctaaggatcccagggagccagctggttcctctctcaggctccgcaatggcctcgaactgaggccaattcaaacccagagctgctgcccagagcacagagtggaaatcactcaggagtggaaggaggcaggaccaagtgctgggttttcctgactatggctcctcaaggaagaagacttccattccttcagccagagccgctctcttatgcactgagctttgaccataaggaatacttcctggctaaaagaaaaaaaagcaaaaaagtggagacctacaacacagcaatttacccttcacaaaggagcctcccctgcgccggggcagtggctcacgcctgtaatcccaacacttttgggaggctgaggcaagcagatcgcttgagctcaggagttcgagaccatcctagacaacatggagaaatgccatctctacacaatatacaaaaattagctggtgtggtggcatgtgcctgtggtcccagctacttgcggggctgaggcaggaggatggcttgagaccaggaggcggaggctgcagtgagccgagattgtgccactgcactccagcctgggtgacacagtgagaccctgtctcaaaaaaacaaaagcccccaacacgccactgtttgctgacacaccatgtcaccctcttccccaggggcttcaggtggcatcttgccataccaaatgctgtcctaacttttttctttctttttttttgagaaggagtcttgctctgtcacctaggctggaatccaagggcaccatgtcaactcactgtaacctccacttcccagattcaagtgattctcctgcctcagcctcccaagtagctgggactacaggcgcccacaaccacgcccagttaatttttgtatttttattagagacggggtttcaccatgttggccaggctggtctcgaactcctggccttaagagatctgcccgcctcggcctcccaaagtgctgggattacaggcatgagccaccacacccaaccagcgtttttctaatgcattaagtaaaatgaacttaacttctccttgaaaagtatttttctaaggatttcatgaccctctccaaagtcacataactctgcattgtggtaaaactggggtctgaaatcaatgccctaggggataaaatccaaaccctaatctctgccttccttagaggtcaagactagctcctagaacttcagccccatgaggccccacattctccaccagacacggaaagggtgagacctaattaatggcaattgatccatcaatcaattttcagagattaaggcgagcgttgattcacatgcttcccaacgcagacttccagtctgtactaagttctgtgctttacgaaagactttcagaaacagatcttaacttcttcattcagagatagattagatagatacatagatacaattaaaaagaaaaaaattactttgttgagatcccctctgtccttatcctcatggccacatctgacagtcccttcctagcatctcccaaagcactatcccaggaaaggactaggtttgcccagtaactctgacatgaccacaactggggggaaagaatgcaggtttgagggacagagatgcaagtcagaagctcaaagtggagacgggagggccaccaatgaaatgacctgctgtgtggccagcaatttagtctctctgtcagtttcctgcagctacaaaaattgaggttaagatggccaacgtaagagagctgttaccaggaatgccttataaaatcattcccttaataagtggggcttttaacagccaaataaatgggtcccatcagcctttgaccttcaggttgctaagggcagtttctcagccctctcggttcacttgtttttcttttatacatatatccttatttatttttactgtacctatcgattcactgttaaaacagggacaagacctagaaagatggcactttgtttcctggctctgaacaagttaaatcaaacaataggttataattcaaaattcctggtgcccaatactttctgagcattttaaccactccaagccagagttttctctctggcaaagaataacagaaagctcacatagtggcaacgacaactgaacgtgataaagcagagcgcctgccacaacagtagatgcccaataaatgctagttctcctcctccctcagtgccatgtcttcttcctccagctgccttgtctaaaaaggctggcttccacactccacggccaggccaggacaagcctaccacttgtcagaaactcccgccagtatccgttcctgcacccagacacacacttacaaatcagtcatccccaagaccaaagacacaggggttccaaaaggcaccctcaagggaaccagtcaccagccttcctcgttaagcagctctgtgctctcagggagagaacttagccccagcagccactactaggattttcccatggtgcaatgcaacttccccaacttttccgggcccagtttccaaagaaacccaggcaggcgttgtgcacaatcagccaccagtctgggagagactgggctctgagcagagaaaaaggagctgggacagccagaaaatgaaaaagcagttgtggccccggcacaggatggcagcgaccaaaacttaagagtaggggtcctggcccaagtcccattcttctggacggtacccttggttaaaggctagcacagggtgccaaagctagcggacggtgaggagcctcagaaaagggactgatggacatcctccgaggtaccccctacccgctactggacctggtggcccccggggaccctgtcgtcgaggcacctgagagtgaaggccttcagcggggggcattgttcacagcgaacggcgggactgggggaggcggcgggacttcgggatccgcgcaccgccgcctccccaactgggccagaggagcgagtccaccgaggccatcgccaggtggagcggcggccccggcgaggtaccctcggccagcaggagggagaagcggagggcgcgtcccagaggcgggggccaagggtctgccactcacccgcgccttcggcgggctgcggcggcccgacgacgccgttcaggtagagaatgggcagcaggtgaggctgcgtcttctccagcgccgcccgcaggtcctggaagtggtcccgctccttggccaagagcagcttgagcagcagctccgccttggcgcctcccgcctcctcgtccagctgccgccgctcgccgggactgagcgctcccgcggcctcgagcagcccgagcacggcttccacctccgtcatggcctgggccaggctctgctgacactgggcgagcagctcccggcgctggggctccatggtggcgggccgcgccgccccgccccgccggacgcctcccgggccccccgaggccggcgggcgggcaggc

SEQ ID NO: 913 - DNA, 54393 bp, Homo sapiens
atgagatggaattcacacgtatttttatttcttccaagcaggtacagagactcaaatgtaaccctttgagctctcatgcttgaggatgtgctgctacctggcctttgagctctgtgctggcataaagcccaaggcctgggcagggcagatgatcaaagtagggagaattttaacaccagtcatgggacacagtggggagcacaaacagtagggtttaccaggcaatgctgttgatgttgatagtcctagcaaggctggcagttccaggaggaggaccagcacctccaggacgtatgacttccccccctacccatgggtgatgtgatccttcacataaccattctgctccaaggtctgccttgttctcaagtgctatacgctgattcgcacccatcacaatcacacacgtctcacacagactccagaccctgcagcgcccaactgagtactcactcacgcaaggtgaggctccttggcggtgccatctttattattcccagccacaagttatagccacaacctctcttccatttaaagtgtgcgtcacccgcagaagacaacaggtgccggagttcactcctatgattcaattctaccctcccctggcctttgcacggatcccagtggtcctggctcggatcaggcctacagcttacttcccaggcatgcttccaggaaggcagttggggtggggggtacccctttatggctcttcccaggttacatgagaactggtgatctcggtggggtctcaagtagaagccctgaattagtgttcattaacaaacttaatcctttgtcctaaaccaggctctagctcaattcaaagataaaggggggttaaacattaagaaaaatggcattttttttccacatcactgataccccaagagaagttaataggtctaccttgtagatgcagggaaatcaaaaggtcaaactataattttttataaaaactaatttttttttacgcttaatttttttcttttttttttttgagacaaggtcttgctttgttgcccaggctggagtgtagtggcacgatcttggctcactacaacctccacctcccaggctcaagtgaaccttccacctcagccttaccaatagcaggtactacaggcatgggccaccatgcctggctaatttttgtattctctgtagagacggggtttcgtcatgttgcccaggctgctctcgaactcctgggctcaagtgatctgcccccctcggcctcccaaagtgctgggattataggtatgagccacagcacccagcccaaactacaaattttaatagaattttaaacccaaccactggccaaaaatcactcggtcacgaattcctaatccacaatcacatcagtaggaagggaaagcactcattctaacacagatccaagaaccaatggctaccccgggtaccttaacagcatcaactcagaacttaaaaaatcaactagagatcatccaaggaacgtaagtataattctacaaaaaaccatctcatccccattgcagcaggccccaaactccagtgaggcttccataggccatggagaatgggtttggctcttgtcacagggtagagccccatgataggggtctgaggtagatgaaaacaacagggtagccaggggcatctatagaagatgttacagagctgcctgggcctcatgacagttgcacctcagttacaaatcccagacggctctatttgcttaaaccagtttttccagtgacgcttacatgctgactttcttggtttctatagatgcttggtttcaaaaataaaactaaaataacaaaaattccaaatccctcaaatggaacaaataaataatagtaacaatatttacataagtatgtcacattgagagattccagcatgaccaaggaatggaaaatccaagaatgtgccctggcctgtgtggggctcaggcctggctcatcgtcaggtgtgaagacaccatggggagccgatggatgtatgcagtgagctgggatggaccatgacacctggctgggctttaagtccagggaagcagtgtgtgcacgagctgtggggccgtctatagattaggtttcaagcaagcaaacaataaaaccctcagctctcccgagcagcgtggcacagtcagggtcactggtgtgagctgcaccctatcagaggagaagctgctcctggggatgccaagagggcttctctgattgctggcataggtggggacctcaggacccccgtcccagggagcacaaaactctttatacatcagctggagacaggacaaggagtcaaggtcaggcatggtcccctctttctttggactatgtgacaagggggatgtggaattcatttgtgtcgaagatcaggggcctcttgggagggttcgggtccctgtcagccttgtgaagcagcttgaagagcccggttccaatgttcattgggattcccatgatgatgcactcagacacccctgaaaccaaccagaatgaacatcagagagcctctaaacacaaggtacattttcacgaagaaagactattggcttaagtgtcagaaaattaggatgtgagtcccagcgccactccacatcaactgaactttggcaaatccctttccttcccatctaaaaagggtggctgtggagtgcagacagggggattctgcactttcagggaagggcagggcttgctcacagcccaggagcttgttggagacagagtcagctcctccagttctcctctcccacctgagccaaaggcaccctgggagggccctgcctttgagaacacaacttagcaagaatactgaaggatgcttaggaaactctaagtttgccacccagtgcttccttaacttagagcctccaagaaaagcaaacaactgggacagtagtgagcagaatacaatccccttggaaactgcggtaggcagctgttagctgtgctcaggggaaggggccaggccaggcttaagagcatctgagccttcatgatctacagccctgatgagaaacacccagaaggcagggcacctatagagttacaggatcaagggggtggtgcagattctttctccaagccccatgtcaacctggcataaggcttgagtctacgatgagcaagcaaatggctactgtgttgtagactttgtgctaccaaggaaccggagaggcaaacaactaaattaaagaccaacatgcaatgagggcgaacactgggttacaatgtgctgaaggaccaggaggaggggaaaacttcaaattgggggtggggtggcagtgccaggcagtcaaggagactggtggtggagaaaggtgctggtgtatggggccgcagagctgcggcaaaggcccggtttccaggtgtcaggcttgagtgctgggtctcagccctattgtcaggcagacttgctcttctcttggccttgggctttcttccagtcttctgtgtacctccctctggccccattctaactgctgctccttttcttttcccttcatgctagttttttttttttttttttgagacggagtcctgctctgttgctcaggctagagtgcagtggtgcaatctcggctcactgcaacctctgcctcccaggttcaagagattctcctgcctcagcctcccgagtagctgggattacaggtgcctgccaccgtgcccagctaatttttatattttttttagtagagacggggtctcaccatcttggccaggttggtcttgaactcctgacctcgtgatccacccgccttggcctcccaaagtgctgggattacaggcgtgagccaccgcgcccggcccacgcttgttttttgattttaaaaatatttaaatagacacgagttctcattatgttgcccagcctggcctcaaactcctgggctcaagtgatcgtcctgcctcagcctcccgagtagctgggacaatagcaacaccatgcccgctctcacccttctttatcttaaagacttatgtaatatttatttccctccatctccaatccctgtcccttctgaaaagagaaacagttaatcttagaggcaaaaaatgggtatatactctaatgatgccaatctgtacaagagcaggaggtgagagagcaaagggctactgggaagcagagctctggcctggaaacagcagccagacttggaatccctgtgtgggcctgactggtgtgtgccccggggcaggttgctggccctctcgaaccccagccccttaccagctctcaccccaagcctgcagggtcttcctgcggaatcagaaaggctcgagcaaagctcagcagtcagtgctggtctcacggaagaggcagggaagccagacactggggagagttcccctcgtgctccctctcccccaggccagcacagccccataaagccatgttttgtcgagtggcggggatgaggcatggtgcagagcaaggctctgctggtggactcgacagcaagcgaggtcaccttggtcttctgacttgtcaaagggcttaatatccacaccccacgggtgggtagagatacttgacacatatgatgcctggcacaggggctcagcaggcattgatggccacctcccaaggacagtaggacactctgctctgcccagcgcccagccagtacctgctcctgtcagccctggtgtcacacacaggggtcaggatcagtgtggctgactacaaagtcaagggctagaaaaattcttacatgcccagggttgctctttgcttcgtggaccaaaaaccatctgtgctgacagagggaagtcatccaacagatgtaaacggggatgcaggatgctacagtcaggatttggagataaaagatccagcagttccaattcgtgtctattgacattattcttgaaaaaataaacgctctgccactcagtttttttcattcccttggaagcctagccatggtctatttgtaaatagtaaaggcctttgatgctgttcatagaaacatcaaacctaccacacacagagtccttctgcccgaagtaggcagcgtcaaagagatggtcagccgtcttctcaaaggaggccagcatcagcacactctccttcatcttggccaggccaaacctagtgatgcccaggacttcaccctgcgtcaagggagaaagagtcacggtggtactcacaccaatggcaaaagctcgaaaccaaagcacggtgcaccttcaatacaatcaacaaaaatcctccaagacccaacgtcaggtgtgaaaggccctgaggagctatgggtccgccctctgtgtcccattgaggtggtcaatcgtcggcaacatgaaacttcacactcgcatccagacgccatcagaacaaagaagaattgagaactagaattcagagactaactttaaaaaaggggagtatttctgaagagatttcttatggctcaaagaactaaaaataaaagaatgtaaaaacctcaagtatgaagagaattaattaaatttaggtaattctactcaaaggaatattgtgccataatttaaaaagtatatttattaaaaccatgaaacaagatggaaaacatttgtgatgttaaacaaaaagtcacaacaaaaactgcatgcacacagtttcctgcgactaaagcaaaagatgcataaagaataggacttcacagaagacatcgaaccgacagcctcagggtggtaggaaatgggccatttccctcacctggtttctaaatagtctgtaatactctatcgacttgtttggggaagccttatgaaaacctgctgccctaaggcacagctagagggaaatacgttttttttggaaaagagagaaaaaaaaaatcaaaccaaccaacccacctcagcctcccgcccccaacttcagatcatgttaacttattttttcctgggaatggctacagaagagtgatggatgggtttaataagaaagaaacacctcaacttgccatgggactctctgggctttggcagtggctaattttgctttaggatgacattcaggatgaggacggaaccaagctccagctctcttcactccaccgactgggtatgagtttgccatgaggctgtaactctcatactgggatttcaccaggacactcagcctgaccagcatactttggtttttgagcaatgttcacatcttattttctctctatgatggtcctcacagcagcgtattctacatgtcttagaaactccacaggcttattctcctgaaagtgagtttcgggatgcccaggcagcccgggggcctcctgcccacataccttgtaggtcatgaggtcggagagcagcatcacgtgcctcctgtcgatgctcatgccgtggttcaccatggtgtactggatttcattgatgatcgttgtccgggcggcctcgatgcccagagttttctccacctacagagagccagtaatgagcagaagcagccccttccgggaggccactgcaaattctctccactttctcctctgccctgcagtttcaaagcaaaccctgtgccgttttccagaaatggattgctgggcaattttcagttgcagacccacggcaaatgggatggtcagagaagtatgctgggaggccgggcacagtggctcatgcctgtaatcccagcactttgggaggccgaggcgggcggatcatgaggtcaggagatcgagaccatcctggctaacatggtgaaaccccatttctactaaaaatacaaaaaaaaaaaaaaaaaaaaattagccgggcgtggtggtgggtgcctgtagtcccagctactcgggaggctgaggcaggagaatggcgtgaacccgggaggcagagcttgcagtgagcagagatcacgccactgcactccagcctgggcaacagagcaagactccatctcaaaaaaaaaaaaaaaaaaaaaaaaaaaagaagtatactgggaatcagtggaaggcctgcagatggcacaaggaagacagcctaaccctaaggcgaccccgtgggctgagtggtacctcataggtgttattggaggtggttcgggtgcccttcacaccgtgtgtggccatgactgcccgcaggttatcaccttccaccagaagcttgtacttctcctttccactctgctcgtcaatgtggatgacagctctggacacctctggaatgccctgcaccaccacctggattcagagacagagaaagctgtgaggacggggtgagccatgccctgggctgatcaccttgatcaccccagctttcagcagtggtcatctgttaacacactagagctagttttagggataagggagaacagaagttgttcaggggactgcacctcatcctaacatcagttttttgatagaacagagaggaatctaacagactaactccttggggataaggccaagaagaaattaagaaatcggactaagtgacaaagcccttaggtcccagccctgggtgtcacaccacagggagatgctgggtctccatgagaagcgacttctgtttcaccttggggagatcctctttcaggaactgcagcacgtagtacatggagctcttgctgttctctctgggggtgacacacaccacagcctcaccatgaacagccacatcaccgggcttcacacggagcttggatgtgcagatggaatatctcactgtctcagcgttcacctgcaacatggccaggtgtaggtgttactgattccagtgttgttcttcgtttatttcattgttgcccctctaagaagtccttttagtcaggtttgttctaagcaccccccacccgcaccatgaaattaataccataaatatgctacatatgttttatgtactatatgtgtatatatatctatgctttattcataaaaagagtagtttttttcacccacgacaaaatatttgcccttgaaaattcatgctcagttcatggcaacacacgcagcctctgtgggaagctctagggaggctggaggttggaggccaggctaattaaaagcttccgtggggcctcccctttacctgacactttcacaatggttcatgtgctacgttcctggatacaactcatctcttctgcaaaggagccacaaggcaggcagcaagagacaggctagagaaatccccaaactggagagcaggttgctgcatttgagtcaactgttatatgggtaacatatgaacttgatgcgtgagagaacgagctgacagaatgtgttttaagggctagtacagctttaactacccgagagaaagaagagggtgtcgggaagttactcagtttgtaccccaagttggtctgtttgtgagaaaggctgatcatctttcaactgttgcctattacccatgcatgccagtttaagaagccaggttaatctccccatctaaacacatttactgaacttcctaggctagctgccatgctgggcgctggggatccacagatgagtaagacacagccagccctagggtccttccagacactgggaagagggacaacaagaccacttatcataataccgtgtcacagtgaactggtattgcggtctgcacaaaatttcaactaattttctgtgtgtctttagatgggtatatttgtatcaaggtcaggtttagaaagaaaatgtgaggggacaacagaatcacaaaaaccagaaaccacacagaaggttctgcaatgcttcctctgtcttgcttagctcttgccctagtttatcagtacctatcttgggactaacaggatgacttcctctctacatttaattatgtgactcacttccagtctcagaagcctaatccgttccagggagagcttgacgagaataaagcagtcatcaggaagaaacacttcttcaatatactcggaaatctggagtgtcaaaagatcagactgttaatcagccgctttcccctttcctaagagcacacgactgcttgcttttttgaagagcttgagtagtgtggacgccacaggctggtcaatagatggcagctgatttttacacttccttgcaacattgctgagctagttttcttgttatcaatagggatttcttcttacctctcccaagagggttttctcaattctccctttcacgaggcgagcataatccgcgtcgtcatccttgtctagctgtgctgtgataattggagtgctgttgagaagcaaaggaaaaatggcactagcacaagggaggaggctgtttgaggactactgctttgttaaacccaagtgctatttagaatcataatgttactagcaaccccagtttactgagcaagctctgcctcccaggttcatgccattctcctgcctcagcctctggagtagctgggactacaggcgctcgccaccacgcccagctaattttttgtatttttagtagagacggggtttcaccatgttagccaggatgtcttgatctcctgacctcgtgatctgcccgcctcagcctcccaaagtgctgggattacaggcgtgagccattgcgcccagccgactatctttcattcaatgctacgtattatcattttgttaaatataggtcataggtaaaaatcattatttttgtcatcgaaggcattgtaatacatttctatttcttctagccttagatcaactagaaatcccatcatgaaatcaccaggggctcacagaatatgaccacagggcaagtggcagacatttcagtcaggcctagttaggctggaataatgacatcaaaaggatgaaatctccactgacacattgctccaatttttccagtcattttaaacattttctctcttcatgttacttgtggccataacaaaaccattgcttctattttgactgtatccagtttagactttttcttgagtggcttttttaaaaaccaaaataggattaacacagcaagcatgccacccagagtttaagacacagtcctatgaggatatcacacatatgcatgtgacacggggatcattgtttctcaggaaacaggacaggcatgtgtggaacaagaaggaaatgaaagcaggcacctgatggccttggaagcgttgatgatctctttaatccggggcacgcccagggtgatgttcatggaggccacacctgcaaagtggaaagtcttcagggtcatctgggtgcctggctcaccaatgctctgggcacacagagcacccactgcagaacctggctccatctgtgccctagaaggcaaaggtatggatgagattgcagcatgccaaagaaaagtccagcaaaactgctggggagaggcttctggttatcacctttcaacagagaatatagatgctattagggtcggaaagggtatgtctgtgacagagaaaaagcctggcatagaccagaaataggtacagacaggggaaagtaaaggtcagagagggggcagcagtgcaactcaattctgcatggctgcttgtggtcagcatgtaatggatgcagaaaatctaagcagtctgctaaccaatggtactgatggcaaacagagcagtggcatctgccatattcgttagcagtttccccatggggagaagacactaagaaatttccttgcaattatttccgttatcttggagcattcagactggcaattcatcagaccccctacagaaaatgtgacagaatctgatcaaatactggcagttaacaagtgagctggtgcagggttttgtacacatggggaaacagaagggatacgtgagacctatgtggatgaccgtcagtccaagacaaaagcatccctacctcatgtacttgtccctacaggtctccagaaacttttctacttgggtgggggtgatgcggtccagctggtacagcacacggggctgggagaatacaagccaagcacagagttagggccagcggcaactacaaacagctcggggttctaacgcgtcttggagggatattacctctgttgtgccgttatcattgatgccatatttatctctggttttcttgatcttctcagagacccccttaatgaatttttttatttcctgaaagattacacagcaaacatcatttgtaagtttcacagtcatgcagatgacataattcatttcataaacctcagttgtatatgacaagtccatcatattttagtgttagctccatatatagtataaaggacccaatctggatactgcttctactacaaagtggttttccaaggaacacaccacactgtccataccccagacacacactccattggttaatgtgtctctaagaccttctcctccaactgctctcatggcactatctacagagcccacaaagtgcgtgggagcctttgttcttgctctcccacgtgccacgagggctataagaacacagctcaagacaggtacgactgaagcatttatactgttcttctacagattaatttttgagggtttcttctgaaggtattatgctcagtttaaatactaccaactaaagcatagctttgttgacagtaaatgcatttcaaacacactttgagcttaccttcatttcaaagaaaacactccccaaacccagcttatcttttcccctctggtaaccacctctccccacaggcctaggcctacactgtcttcccacacacaattagaagtctgtaaggattcctggaaaccattgtcaaagccagatgtgaagcatcagtatatgctgcgattcccactgtatttaagaacagcactctcagccccgggaggatgaccaagtagagcaagaagaaggtgaaaaatacacaggtggaagatcagagcagggctagagactacagccctgactcaggttttctggcaaccactcaaatgggtaaaactatctgttttaggatttacagtgtgtctgtgaaatagacccagcccaccaccactcctaaagccaggatcagccagcaccttcccctggagagtgctcacagggaaggagcacttacagaggagcggttaacatcctgctcacagtgggtcaatcatcacggactacagactggctcttaaagcaattctcagggtgagctgatggcacctgccatgtagtagcaaccatcctccagaggccattatcctgccatcccgggagctggcatcggctgctctggtgtggcctagggatgatatagtctctgagaatatggggaagaggagatagactgcccctcctttgtagcagcaaggaaatcacagtggcggtaagcttgaatggcactctggccaaatgcaggcattcagctgctctgtgtgtctggatgagtacagatgcccacacatggaggacaagcagcttgagggcagactgcgtactgtggtggccgagaagcctcatgaggttctgtttcttgattctggggtaggctgagggtcccccagagagaaggccagcatgccctgcccaaagtccactcagcctattacatggctgaaaatgcctaagcctgaaccaggagcccatttctgcaaaaataaaatcctataaggtatccacagacagcttaagacttcctagccccattctatcctaaccttgcaaaaagaaatctcattagcctcctaactagccatttctagttactaccctttctacaagcaaactgctagaactttatgttcctgttaaaatagccttagcatctgtgtccacatggtcttatgcctttcccagccagctgctgcccagcttggcaagacctcactgtgaggtggcatggctttagccccaccaccctagagcagaaggcactgaaggcctgaatgaggtcagcgcttggccaaggcaaccaaccactccacgaagtcagatgctttcttcaaagtcttttctctgaacaggggtttcttcgatgtaatctttgcctactgggaaattccgtctgtctcccaggagcccaggcagccaaggggctacctcgggggcccaacacatcctggctgtcagttcccatgaatactgctttctcatgactctctgtgttggcccactctctttcttcccactgagaaagtgcagaggcccacggagggtgaccctgcagcccaatcattgttctacatagaaagggctttttatttaagaagttttaccagctgggtgcggtagctcatgcctgtaatcccagcactttgggaggctgaggcaggtggatcacctgaggtcaggagttggagaccagcctggccaacaaggtgaaaccccgtctctactaaaaatacaaaaattagctgggcatggtggcacgcacctgtagtcccagctatttgggaggctgaggcaggagaatcacttgaacccaggaggcagaggttgcagtgagccgagattgtgagactctgtctcaggaaaaaaaaaacaaaaaaacttttattaattcgcaagaactttagagttctcaagaaactctttttaaagagaaactctcctgattccttgttattaatgatgagtctgacactgtgttttcagatacagttaccttttgcaaaccagagatgaaaaataaagctgtagagggcagtgggacaacctcttctggcatggctctaacagaatattcaaaggcatttgcacttgctgccactgaatttttcctctatatattcagtataagagggggctttgcctggcagtggctgggtccttttgagaaaggtcccgaaagccctcttggcccagatgttgccatttgatcaccagttgttaaaagctgccttacctgttggcacaggaaaaacaggagcagaacctaaggccaagccttagacccagaaggttttcatctgcaagggactgtgcacacatagggagtaaaattaacacacctaaaacaatctgccggcttaggcactgggaatgacatagctcagctttcaccccaatggacacatttcccgtgggtttgctgaatgactttccctacacaaaggttctggaaattaggtttaaaaataaaaaaagaaaaacagctcactttttggaaatgaaaactgaaacaatctgctaaaaattcacactgagtcaacccatgcatactagagggaacgaactcacaacatggctattggcaggcaattcatcacacgattaaccagaagttagtgtctcatgctccacagcaggcctatgagcacgggcattctcctctggcagggacctgggctcaatgccactcaggagtgcctctgtcacctcagctctgatacgggctagggctggagaacatttcacgggctcagacacatctgttctggccagtggattttggaccctctcagcaaatctgagctcatcggattgtgagctgccggtggcaaggacatgtttagtcatccttgcatccccaggatctgtggactgtgtgacatatggtgagggctaaaccagtgctcactgaataaacaaatgctgccgggtaggaggtcacctgtgttaaaccttttcaagggcaagaaaggaaccagtccaaagcaaagcagtgtttgccagaaccgggacagaaacctgctctctctggcgctggcaaatgctggggtgctgctggagtgggccctttctgttggcgttcacagcatgctaagtacgttacctcgttatagctttcataacctgtctcagttaaggtctttgaggacaaacagataaatacgtaaacatgagcgtgaagaaaaaccaaattacaactctaatttgttagttaaaaaaaaagaataagaaagcctttggaggagaaaaacagacaaaggcacccagccttgccacactcttgattttaaaatctggaagagtctctttttcacctttcacaccttgacacatgaacacaagaagcgaggagcttccttaacacaaatattcttatttaagcttcactcgctgtttttatttttgatctacggaaagagatacattcttctttggcctgctgatcttgtgctacatttgaattactatttagtacacaaaggaaaccatttactgatttctgtatccctttgcttttgatcctaaccatgattataaacatgaaggagctgcctgagcaggtcagaaccataaaaaaaaaacaaaaaacaaacgaaccaaaaaaccttaagagggtatcaaagtaacagctccctggaagaatagaaaaggctgattcaatggatttttgatccacaatacagcaaaagaaagagcagtttaaaataaatggtatcaaaacaagactactagtactaataattattgggattcagaatgattgagggaagagttggctcacaagatagagtaggtagtaggctggtgttagggacagcgctcaaacaaaatcagcatttttcttctaacaggggaaaaaaacatttttcttctaatagggaaatggcttgagtgaaagacataaactaagaaagtcatgagataaattctgcttgttggctggtgagattttgccttggccatttttgaatgactgcctgtcatttttttttttttttttgagatggagtcttgctctgttgcccaggctgaagtgcagtggtgccatcccggtgtactgcaacctccgcctctcaggttcaagcgattctcctgcctcagcctcccgagctgggattacaggtgcccgccaccacgcccggctaatttttgtatttttagtagagacagggtctcatcgtgttggccaatctggttttgaactcctgacctcaagtgatccacctgcctcggcctcccaaagtgctgggattacaggcatgagccaccatgcctggcccattcttgaactttctaacaaaggaacaaccctaccttaaaaaacaaccagcttataaaatccacttgccagcccttggcaaacagagttctttacgacagccaggctgggtgcagtagccagcacctggcagagctcacctgcaggaagctgtcctggcagcagaggaactcactcttcttcatgatggactctgtggtcaggatcagctcgtttttgctgagagcaggctcactgggacacgggaagactgccttgagtattaaaagaaaattgcattatgtgtgggtgccacagagagcaggcggtagtagatgagagaacttacaaaggataaaatgaccttacccaaggtgagcttttagcaacctgtgatttttctttcaaaacaaattgtggactctacctttcatgtgaaggtgaaaactggataaatggatactccatcctatgcaaaaatttctgggctattcagcaggtgttgtcccatcacttcccagccttcgccaccccactgccccccaccagatttacattaaaaatataagctgttatttaaaaaactcaaacatttcaagagtgaaaatattctcccacttctgaagctcataaatttctcttttttttgagatggagtcttgctggattgccaaggctggagtgcaatggcgccatctcggctcactgcaacctctgcctcccaggttcaagtgattctcttgcctcagcctcccgagtagctgggactacaggcatgcgccaccacgtacgattaatttttttgtatttttagtagagacggggtttcaccatgttggccaggctggtttcaaactcctgacctcaagtgatatgaccgcctcagcctcccaaaggactaggattacaagcgtgagccccagcagaatttcctcttttttcctctcctctgctttgtccaagttgactcaatgttttaatggctgcattattattcttttgtatagacagaccatcatgtatttgaactatcctctactgatggtttgcctttactgtaagcagcgtagaaaaaacattcttggcatagttagaccatttctagaggacaaaaggagtttctgtaagggaaactactgggtcaaaagggacacgtatttaaaactcagaatggtattgtccagctactctccaaaaaggttgttccaagttatattctcaaagtatgtgaagtgtgcctgcttttcaatgcccatgacttataaaactggtctctagtatgctctacttgacacagagcgaaaccaaacaaagccctcttctgttggcatttgattactaccaacactagactttcaactgaaaacaactttttttttcatcttttttttttttttaagacagggtcttggtctgtcacccaggctggaatgtagtggtaagatcagctcactgtggcctcaaattcctgggcttaaggattcacctgccccagcctcctgagtagctggaactttaggagcatgccatcatccctggctaattctttttttttttttttttttttttgagatggaatctcgctctgttgccaggttggagtgcagtggtgtgatctcagttcattgcaacctccaactccctggttcaagtgattctcctgcctcagcctcccaagtagctgggattataggcacgtaccaccacacccagctaatttttgtatctttagtagagatggggtttcaccatgttggccaggatggtctcgatctcttgatcttgtgatctgcccgatgtctggctaattctttaaaaaatatttttttagagatagagtttttcctctgttgcccaggctgacctcaaacttctcgcctcaagtgattctcctgccttggcctcccaaattgctaggattctaggtgtaagccactgcacttggcctttttcctttaaatattggaaagtaaaaaaaaaaagcaaaacttttttcttttttttatagagacggggtctcactttgctgcccaggctagtcttaaactcctggcctcaagtgatcctcctgccttggcctcccaaagtgctgtgatcacaggcataagccattgtgcctggcccttcccttttaatatcggaaaattatacagagtaacacaaagaaaaaagatactaatccagtgcttgggattataaatactgaagtatttattaactgcaattgatagtccaaacagtacttccgtcctaaagaaacatccttaaaaacactctaaccccagatataatgctaaatcttactttgatgttgtccagaacccttttaaactccaaaggttcatcttttccctccatagctgcaggatctaagccatctcctccataaatgaactggataatatcgccagtagagcttcggactgtcagatcatactgggagcaaagatcttcaagagatttgacaagccttcgctaaaggaaaaggaggaaaaagctcagctgctttgagaagactagtcacatggggagaggataagatttgcaactcaagagtctcaaggttacaagcactttaatcacataaaaatactttattagaaaccctttaaaaagagtcctctcaccccaagaacaagagcaagaatgccttactagcctgtgcagtgggatttggaatatgctccaacctccaacattttagtgtattttagaacacatgcaatttaaaccgcatcacccacaaaggactctgcaactgctgttttcctaggctgttttaccttccttctctttctccctaaggtataaattaatgcaatagctttgcatttctaaacagaacttaagccaggacccctgcagacttcaatatgaattacggaggatcaggtgcaggccctcttctgggacagagggggaagaagagagaacagggacagtattgtgtctgaaccagcaggcagcaatgacttctcaaatctgcttagggagaaccgtccaccagctgaacactccagccagcaatgctatggtggctcagtgaattaaagagaaggaaatcttcctctaggcaacttcaaaacaaaaaatcccttatgccagaactaatttagtttacattaacacactgctctggcaaagtcatactctctaattcaaaaagtaaagacaaaaaaattaagtaaaaacacacattatgacaagagtggtaaaagtatttcacagtctattgggtttctgacaaaagcagcatgctcccacactgaagggcaatttcccattgaaagatgattaattgtattccatggatgacacacacaaaaaagacgattaaaggtatcagatgatacacgagctacaggagagatgatggaaataggcgtctactgacttggaaataggtgtccactgtcacactaatcacagtgtttgttctggcccactcattcacatctctggtttatctaccctggttttccagcttgcaaagggccatgcttccatagtagggagagagaagacacaaagccacagcaagttcatggcccagcaacttgtagtgttgactttatctggtgttttaagtagttaaaaacattacttaaaaaaaaaaaaaaagcagaagactcagtagccaatgcgatcaactggaagaaagggtatcagtgatggaagacgtaatgaatgaaatgaagccagaagagaagtttagagaaaaaagaataaaaagaaatgaacaaagccttgaagaaatatgggactatgtgaaaagaccaaatctacgtctgattggtgtacctgaaagtgacggggagaagggaaccaagttggaaaacactctgcaggatgttatccaggagaacttccccaatctagcaaggtgggccaacattcaaattcaggaaatacagagaacaccacaaagatactcctcgagaagagcaactccaagacacataattgtcagattcaccaaagttgaaatgaaggaaaaaatgttaagggcagccagagagaaaggtcgggttacccacaaagggaagcccatcagactaacagcggatctctcggcagaaactctacaagccagaagagagtggggaccaatattcaacattcttaaagaaaagaattttcaaaacagaatttcatatccagccaaactaagcttcataagtgaaggagaaataaaatactttacagacaagcaaatgctgagagattttgtcaccaccaggcctgccctaaaagagctcctgaaggaagcactaaacatggaaaggaataaccggtaccagccactgcaaaaacatgccaaattgtaaagaccatcaaggctaggaagaaactgcatcaactaacaagcaaaataaccagctaacatcataatgacaggatcaaattcacaaataaaatattaactttaaatgtaaatgggctaaatgctccaattaaaagacacagactggcaaattggataaagagtcaagacccatcagtgtgctgtattcaggaaatgcatctcacgtgcagagacacacataggctcaaaataaagggatggaggaagatctactaagcaaatggaaaacaaaaaaaggcaggggtggcaatcctagtctctgataaaacagactttaaaccaacaaagatcaaaagagacaaagaaggccattacataatggtaaagggatcaattcaacaagaagagctaactatcctaaatatatatgcacccaatacaggagcacccagattcataaagcaagtcctgagtgacctacaaagagacttagactcccacacaataataatgggagactttaacaccccactgtcaacattagacagaacaacgagacagaaagttaacaaggatatccaggaattgaactcagctctgcaccaagcggacctaatagacatctacagaattctccaccccaaatcaacagaatatacattcttttcagcaccacaccacacctattccaaaactgaccacacagttggaagtaaagcactccttagcaaatgtaaaagaacagaaattataacaaactgtctctcagaccacagtgcaatcaaactagaactcaggattaagaaactcactcaaaaccgctcaactacatggaaactgaacaacctgctcctgaatgactactgggtaaataatgaaatgaaggcagaaataaagatgttctttgaaaccaacgagaacaaagacacaacataccagaatctctgggacgcattcaaagcagtgtgtagagggaaatttatagcactaaatgcccacaagagaaagcaggaaagatctaaaattgacaccctaacatcacaattaaaagaataagagaagcaagagcaaacacattcaaaagctagcagaaggcaagaaataactaagatcagagcagaactgaaggaactagagacacaaaaaacccttcaaaaaattaatgaatccaggagctggttttttgaaaagatcaacaaaattgacagaccgctagcaagactaataaagaagaaaagagagaagaatcaaatagatgcaataaaaaatgataaaggggatatcaccaacgatcccacagaaatacaaactaccatcagagaatactataaatacctctatgcaaataaactagaaaatctagaagaaatggataaattcctcgacacatacatcctcccaagactaaaccaggaagaagttgaatctctgaatagaccaataacaggagctgaaattgaggcaataattaatagcttaccaaccaaaaaaagtccaggaccagatggattcacagccgaattctaccagaggtaaaaagaggagctggtaccattccttctgaaactactccaatcaatagaaaaagagggaatcctccctaactcattttatgaggccagcatcatcctgataccaaagcctggcagagacacaaccaaaaaagagaattttagaccaatatccttgatgaacatcgatgcaaaaatcctcaataaaatactggcaaaccgaatccagcagcacatcaaaaagcttatccaccatgatcaagtcggcttcatccctgggatgcaaggctggttccacatacacagatcaataaatgtaatccagcatataaacagaaccaaagacaaaaaacacatgattatctcaatagatgcagaaaggcctttgacaaaattcaacaacccttcatgctaaaaactctcaataaattaggtattgatgggatgtatctcaaaataataagagctatctatgacaaacccacagccaatatcatattgaatgggcaaaaactggaagcattccctttgaaaacgggcacaagacagggatgccctctcttaccactcctattcaacatagtgttggaagttctggccagggcaatcaagcagaaggaaataaagggcattcaattaggaaaagaggaagtcaaattgtccctgtttgcagatgacatgattgtatagctagaaaacccaatcgtttcagcccaaaatctcctcaagctgataagcaacttcagcaaagtctcaggatacaaaatcaatgtgcaaaaatcacaagcattcttatacaccaataacagacagagagccaaatcatgagtgaactcccattcacaattgcttcaaagagaataaaatacctaggaatccaacttacaagggatgtgaaggacctcttcaaggagaactaaaaaccactgctcaatgaaataaaagaggatacaaacaaatggagaacattccatgctcatgggtaggaagaatcaatatcgtgaaaatggccatactgcccaaggtaatttatagactcaatgccatccccatcaagctaccaatgtctttcttcacaaattggaaaaaactactttaaagttcatatggaaccaaaaaagagcccacatcgccaagtcaatcctaagccaaaagaacaaacctggaggcatcacgctacctgacttcaaactacacaaggctacagtaaccaaaacagagatatagactggtaccaaaacagagatatagaccagtggaacagaacagagccctcagaaataatgccgcatatctacaactatctgatctttgacaaacctgagaaaaacaagcaatggggaaaggattccctatttaataaatggtgctgggaaaactgggtagtcatatgtagaaagctgaaactggatcccttccttataccttatacaaaaattaattcaagatggattaaagacttaaatgttagacctaaaaccataaaaaccatagaagaaaacctaggcaatagcattcaggacataggcatgggcaaggacttcatgtctaaaacaccaaaagcaatggcaacaaaagccaaaattgacaaatgggatctaattaaactaaagagcttctgcacagcaaaagaaactaccatcagagtgaacaggcaacctacagaatgggagaaaatttttgcaacctactcatctgacaaagggctaacatccagaatctacaatgaactcaaacaaatttacaagaaaaaaacaaaccccatcaaaaagtgggtgaaggatatgaacagacacttctcaaaagaagacatttatgcagccaaaggacacatgaaacaatgctcatcatcactggccatcagagaaacggaaatcaaaactacaatgagataccgtctcacaccagttagaatggcgatcattaaaaagtcaggaaacaacaggagctggagaggatgtggagaaataggaacacttttacactgttggtgggactgtaaactagttcaaccattgtggaagtcagtgtggcgattcctcagggatctagaactagaaataccatttgatgcagcaatcccattactgggtatatacccaaaggattataaatcatgctgctataaagacacatgcacatgtatgtttatagcggcactattcacaatagcaaagacttggaaccaacctaagtgtccaacaatgatagactggattaagaaaatgtggcacatacacaccatggaatactatgcagccataaaaaatgatgagttcacgtcctttgtagggacatggatgaaactggaaaccatcattctcagcaaactatcccaaagacaaaaaaccaaatgccgcatgttctcactcataggtggaaattgaacaatgagaacacatggacacaggaaggggaacatcacacaccggggactgttgtggggtagggggagcggggagggatagcattaggagatatacctaatgctaaatgagttaatgggtacagcacaccaacatggcacatgtatacatatgtaacaaacctgcacgttgtgcacatgtaccctaaacttaaaagtataataataataaaattaaaaaaatacagttaaattattgagtggagagtacagggattgaaaagacatcttttgcctgtggtcttatggaagaacacaagaagacgtatttttcactcctctgccattagggtacttttgtggtaaagtttgagaagcacaaatgctgagaagcctctagtttagccctgtgccccagagtctattatctcagagctatacactctctgaggaaatgctttccttctaagcatccaagccccgcagcaagcactggaataggtcattagagttaattagaatgatattaataatgagttacataaatagttgcaaagagagaggcagaggccttgcaataaccctcattgtcacgtgttagtaaagcgaggcttagtgaggttgaatgacatatcccacaatgtacttccatccatgttctcctctaacagcgctttgctatgcgtggctctggcctggtcttgatcatcataggatgattcggaacatactacattttttttggttgttcatttccagggcatctacctttctacattttttccttttaaatttaacccaagactagataaattacagctcatgtgcaaaacgtgtactcaatagtcaaaacccacagagctctgtcctgctctgttgctaatggcctacatttcttcaggttacctgcatgtatcccgtttcagctgtctttacagccgtgtcgactagaccttcccggccggccattgtgtggaagaaaaactcagttggtgtcaaaccggaataaaagctattagccacaaagcctttggcagctgggagctaaagagaggtagaaaaaagaaaaatcaaacaaaaaaagttcaaggcccacgattctgaaatccactcaaatcagaaaatgccccaccttgagactataaatacctggccagtatattctcactaaatggcaggctttctttgccctttccttatggagaaatactttataccagggacaaggagaatgagggcccagccagggctggtgctggtgccagtggcaggcaagtggcccaagagagggaaacctaagatctggatgctctccttaaaataggcaagcagtcaaggacctcagaggacaccctgtggatggaggctgcctgcccattccctgggaaatgacaccttcaagatatccttcctgtgggccagacctgcccacctacaaaacataaccatgcattgtcaatgtctacagggtttcattctgggcactgaaaatgttctaaaagtaggttgtagtgatggctgcacagctctgtgattaacagtcactgaactgtgtgccttacatgggtaaattatatatgaagtataattgtaataattacatatgaagtatatatgtatttaaagtttatttatttgtagagatggggtctcgctatgttggccagacgaactcctggcctcaagcaatcctcttgccttggcctcccaaagtgctagaatttcaggcatgagacactgtgcccggcctgaagtgtatcttaataaaatggcaaaaaatacatatataaaactccacatgaaattggccaacggtctttgatctgaataggtctgtgttccttggaggaaagtgtagattaagagatcttcacagttctacctgatctgctactgcttacctttgagtgtttttcaaaatgaggcaaggacctgttttcaaagccgtctggcactcgagagccactgatggcctgctgtcccacacaggcaatcatctgtgatatgttaatgaaggaacctggggacatggaccagaaatgtaacattcatttaccaaaataacactaattgaagtgcatgcagattggaagggtaaaacaggaataggcccttatgctcaatgaggtcatggtcctggaacagtagaagacagaaatacaatcaagacaacaaggagctgtcaggaacccaagaaaggcggaacgacggcgagaggagccaggagcatgtgtgggttggaggaaaggctggggaagtgacaggtgagtcttcaaggaggcttcagcaagtccaggttggactcctggaggacattatgatttggacataaagggagagggggaggaattccaaagtgggtgggaaagtaggaagcaaagacagagaaatggaaaagtgtgggctatgtcctgagggtaggaagcaggagagcaatggggtaaaaggcagcaaagttaaagagactggactttatcctgtttaaaaaaaaagtgtacagaaatagaagcacagaggttttgaatttgaatgcattatcataaaaccaaatgctttgagggcctcggtatctacaaaatagaagaattatgccacatcattaagtacattaaaaaatccctggctttcttctgcttcaacctgcctgacctgctgggctcaagtgatcctcccacctcagcctcctgattagctgggacgacaggcacaagccaccacgcccagctaatttttttttttttgtattttttgtagagatggggttttggcatattgcccaggctgatctcaaactcctgggctcaagcaatcaatcggcctcggcctcagcctcccaaagtgctgggattacaggcatgagccactgcatctggcctcatttttttttaaagaccacgttgctcaaagcaccctcaaactcagaatccagacacattaccaacaagttccttcaaagcagttaaacttcccaaaatgcaaataattaagtctctctctctgatttaaaaagatcccttaaataaatgaaatgtctgtttggagctgtgactatcacattttctggagccaaacagcctgtacggagaacacactgccagcaggtgagagaggggcatgcagacctttggagccgcacagagccatggtgagggggctgttgctcttgtccagctcccggaggcaggcactgccagcgtggtcacggatcacagacagctccttcaggatcagtgcctagtgggagaaaaggagatccttggtgggttgtcctcattgtctctgtggattacaaatgttcaatctaacatttaaagaaatttgaaaatactgaggcaagatgcccgatttccgatcagtaaatgtttcagaaccttagaggagcaaaatgccctggctatatgaacatgtacatcttctacaaggttctaaaattggtgtataaggcaaacagtttatcttttttttgtttttgttggagacaggatctcactctgttgctgaggttggtgtacaatggcataatcacagctcactgcagcctcaaactcccgggctcaagtgatcctcctgccccagacccctgagtagctaggactacaggtatatgtccctaccaggcctggctaatttttaaaattttttttgtagagatggggtcttgctatactgcccaggttggacttgaactcctggcctcaagggatcttcctgccttgattataggcataagccaccaagcctggcctaaaattgacagtaataaaaacttgaagaatcctttaaatggcccataaggtagaatgtatggctttgtgtatactaccctacacaacaaaatatctgtatataaatagctgtgtggacacacacatgcaccccatacaaatatataagataatatgtggtatgtaaaagagaattgcctgtactatttgtaaatttgtctttctactttttcttgccaagcacacatctgaatgtctgcaagctaggcatgtgatgaggtgacttcacaagaatattccggctcatgagctcatccacagttactcctcaacttacaaactaggatgctgaatcagttacaagtctggttccatgaaaaattgctgctgccgaggtctcaagtaattttctaggaggtaccggtgagggatatccttttctctctctctaagactcagtaagattaagaatgagctaatggtaaatacctcacaaaattctggtttctccctgctttagaaaatgtatttcattagaaaacttcccaatgcttaaagagcctttcttccacactcaggtgagtcaaagctcagtgccacgggtttatcggtgaggcagaagacggccaggtgaaagcctggtgcactcagactgctgagggagtttcaggttctcacaggctggtggtgattctgattctgacccatgctggttgagatcttagctaaaatagtttcaaatgaggggcagcaggctggggatgtgactattagacatgaattctccctcttccgcatccaagtctctttcaaagaccatacattcaaagagctgtggtgaggctgggcacggtggctcatgcctgtaattccagcactttgggaagccgaggtgggtggatcacctgaggtcaggagttcgagaccaggctggccaacatggcaaaaccccgcctctactaaaaatgcaaaaaaaaaattagctgggcatggtggtgggcgcctgtaatcccagctacttaggatgttgaggcagggataattgcttgcacccaggaggtagaggttgcagtgagatgagattgcaccactgcactccagcctgggcgacaaagtgagactccatcttaaaacaaaacaacaacaaaaaaactggctgggcgtagtggcttacacctgtaatcccagtactttgggaggccaaggtgggcagatcacgaggtcaggagatcgagaccgtgctggccaacatggtgaaaccctgtctctactaaaaatacaaaaattagctggtcatggtggcatgtgcctgtaatcccagctacttgggagggtgaggcaggagaattgcttgaaccagggagtcagacgttgcagtgagccaagatcgtaccactgcactccagcctggctggagtgcttcataaaactatgaaaagcgagactccgtctcaaacaaaaacaaaaacaaaaaaaaccaaacccccaaaaaccaaagagctgtggtgtcagtttctacttgaaggatgctgaaaatagaaaaggcaggagcactcgagtaccagttacagaagggacctgagtgtgccaccagaacaagagcagcctcgtgtggccgaatgaacagatggctatgttttcaccacctggatgtgaaagttaggagggacatgaggatctgatgaaaggccctaccctcaggaaacaaacaaggacacacacagtgagcccagggccccaacaggacagacgaggacatacacagtgagccctgggccccaacaggacagacgccaatgccttgacttgcccactcctttgctacctctattcatggctcagcacaaccccagagagcaccaccgtagccactgtgcacggcaagtggcgaccctgaaccaaagggccgggctcacctccagggtctcctcagcagtgcagccaggctgctgctgcagcttgcccgtgttcagggcttcgatgtactcatcacatttcttgtagccggcattcagcaactcatacttggccttcagcagtccttggccaggtgtgacatcaccgatcccaattgagaaaccacggttagctgttgagttggtagagcaggaagaaagggccataaatgagactcagcaaacctactaaatacagtttatgcctgctagatatagtttgtactatatataaactatgtatgtatagtttaaagtataaaaaagtgtatatcttcacagaattcatcacaattcaattaaataatggctttctttctcagtcattagggagttacacaaaatgactaggactcaactgacttctctcagagaccttacgatctggtggggaaacacaataccgtttccaactattatctaaagcagagtgacattaaacactaaagggtggcctgagggctgggtgcagtggctcacgcctataatcccagcactttggaaggctgaggcaggaggctcgcttgatcccagatgtttgtgatcagcctcatctctacaaaaaccttaaaaaattagccgggcatggtggcacatgccagtagtcccagctacttgggaggtggaggttgcaatgagccataatcacatcactgcgctccagcctgggcaacagagcaagaccctgtgtcacacacacaaaaaagtattctccaactttgatggaactaggtgccaccattgatcctagccacaatatactgtatgtagaaataaagagagtgaatgagtggcttctggcttagcaggataggaaggtatgacctacaagtatctgtagatgagaggactaatgggcctggaaaggctcagaaatgagatcattaggttctgcaactgctggaaatgatgaatgtgctggaaacaaggaaacctagtggaaagtctgtataaggaaggctccaggcccttattcctgtaggagatgggagttcgctcccagcgaaatggaatcagagaggctctgggtctgggaataccaggcagatgaaataactgtaaacaagagcactgagggaaagtctgtatattccttttatataaaaaaactgagaggtccatcaaccagtcagctccatttccaatcagtgtttcagtccttactcctcaaggaccaccagatatttgaggaaagattttaacatgaaagacaaaagacacaaatgcacaggaaaaagaaagtaaaaggatacagaaaattcaggaagcaaatataataaaactatgaataatattctctcagagtgatcagagaagatacattcagggatcaaaacaagaaagctttaaaaacaaaacagcctgggcatagtggctcacgcctgtaatcccagcactttgggaggccgaggtgggcagatcacttgaggtcaggagttcgagaccaccctggccaacatggtgaaaccccgtctctactaaaaacacaaaaattagccgggcatggtggcaggcacctgtagtcccagttactcgggaggctgtggcaggagaatcacttgagcctgggaggcggaggttgcagcgagctgagattgcatcactgcactccagcctggcgactgagcaagactctgtctcaaaaaaaaaaaaaaaaaaaaaaaaaagaaacaaaaacactacctgtgaataagtatattgaaaaatagtattggaaattaaatacatgacagtgataaaattttaaaaatcaacagaagtattaaaagataaagtgaatctagaataaagaaatggcaaatggaaaagaagataattagataattaatctaggagttctaatatgtaattaactgaagttccaaaaagaaagaacagagaaagtaaaagagagaaaattattaaagaaataacataaaatttcccgaatggaaggacacacagctgcagattaaatgaaattactcagtgcttagcacagtgaatgaaaaaagacccacaccaaaggtatattgttgtgaactttcacagtgagaacagagaggattctgaaagtttctaaaatgaaaaaaacaattcaagggccaggcatggtagctaatgcctgtaatcctagcactttgggaggtggaggcaggtggatcacttgagaccaggagttcaagaccaacctgggcaacatggtgagacttcatttctacaaaacttagttgggcatggtggcacatgcctgtagtcccagctgctcgagaggctgcgtgagccaagatcacaccactgcactacagcctgggtgacagagcaagaccctatcttcaaaaaacaaaaaaaaatcaaatacaaaaactggggaataagaacgacaatacctgttaacaacaactctgaaagcaagaagaaagtagagcagtaccttcaaaattctgagggaaaataattttcaatctaaaattgtatacccaggcaagtataagagtggaataaagttttgggggcatgcaaacatcacttgactcatggcccactcaaagcatgagcaaacaaacaaacaaacaaaatagaacagtgaaagcatagtaggcaaatattgagtaatcttggagaactgaatcatggatagccccaagtgttctagtgcttccacagggaccttggaagcagcccatcaaggatggtttataatctaaccctgtctagaagaccgtagggagctactgctggttttgagaagagaactgaaaagcaaattcaaatctgttgtgaaactattcagtactgagttaatttaattaataacagcacacatgatttagcctggaatgagtatctttttctgtatgtatatgtgtggtggggatgaaatggcagtaaaagaacaaaataacgtaaacccttaagactctaacaattgcagctttaactaaaagaaggatgctgagatacttacacaggtagacaggagccagcctggcgagccgtgacatggcatctgcagcttcattctgtccccagtctcgcagcaaaatgtaaaaaatattgttcttggatcctgaccctagggttcctttgtccatgctgccactcatcaactcactgttctggattgtaacatctggaagaatgattatatatttagacaacaattatttattactttgccttattccaaaatgaatttgagacagttgagaaaatatgttcccatactgacacttaaagcagaacaaacagaaattctcctcaaagcttttttttggggggagggagggggggttaaaggaaaacttgggaatttttgaaaaatatagaaactccagttagtgtgtagtcctaaccctgaaatataccagttgaccctcactctcctcatctgtgaactgtgggtaacagtatcaagcacttgtcatctttatgttatgggatattttgagcatcagatgaaataacatacagtgaagtgctctataaactataaataatttgttactcatataagatattaaatattaacaaaggtaccatcatgtacagcctatacaacaaccaaatgaaattcatatccaaaaagaaacaaaacagtctaaaacaagaagctgaagtattttgaagatcagagagcatatttccaaagaaataaatctgaggagtatcagtgcccttcaaaacatttgctcttcattagaagacagcagaaatcctgaccttcagaagaactctgcaattcagttcttcagtacagagtcctggagatccacttctagtcccaaggtctcactagcaaagcccattctaaatcagtgctactcaaactaggctgctagggaactgtttggtagtggtctgggtgagtgaacgtgctcacatcagaaagtaactcaatggatgctggctaaacagcagggctctgtggactgcacttcgggttgaactggtttagacagactcagatgacttgcatgtaaatcctttccctggctgggtgaggtggctcacacctgtaatcccagcactttgggaggatgaggtgggacgattgcttgagcctaggagttcgagaccagcctgggcaacgtagggagaacctgtttgtctttgaaaaaaaaaaaaaaaaatcaatccaggctgggtgcagtggctcatgcctataatcccagcactttgggagggcaaggcagatcacttgaggtcaggagttcaagaccagcttggccaacacggtgaaaccccgtctctactaaaaatacaaaaataagccaggcatggtggtgggcgcctgtaatccaagctactcaggaggctgaggcaggagaatcgcttgaacccagtaggtggaagttgcagtcagctgagactgcaccactgcactccagcctgggtgacagagcaagacttagtctcaaaaaaaaaaaaaaaaaaaaaaaaaattaaatgccttaaatagtaaaatccttgtttattgccccccccgccgccaaaaagatgacaaaatacagacaaactactaagtgagaaaaactagtcacttaagacaaaacacatttggagagaacattctaaccactgcgtcatgtgtctacatgatctctacttttaagagaaatggggaattacatctgagagaagaaaaaccagctacattttcctgaagaaaaaactttccacctaaggcttacagaaacaatgaatttgcttgcttcgcgaaggtaccagcaaagctgatgaccagccacttgcttttctgtcacgttcctccttctccccacccgagttccgtccactcacaggaatcattggcacagagatcttcccctttgccacagtactgcttgcccttggttcgcaggttggccctcactggattgtcatcgctaggcctgaggatgacactgaagatctgctttcccgtccacagggtgacaggctgagggggggaggaagcctgagagtcagtgggctgagcctggtctcaatcccccttcagtagacgaagccaggcggcctagggactgcactcaagcctagcaccaacacggttccactcatttcaccagtctacccccacagacacatacacacacctgtgcaccaacacacaactcccacacacacctttaggattgtaggcggtgggaggcgaactttaattttctcatccttgccaaccagtattgaagcaatgatttggcaagccttggctcgatcaaagaaagtgtccttgagagtgaggagataggcacctaagcattaggaaccaacacaaaacaaagaaaaggaatgaaattgtgagaatactgcaaggtttcaattttaaaataaatttgaaccatgaccaacagcgtgaattgaaacaaacagctgcttactggctttctcctccaactaggatctacctccacaggaacgtgactttgttttgttcactgctgtatccccaggcaaaagggacagattctaagccagacactaggtttagaaaatgcccagtccatgagaggagctcattaaagacttgctgaattaatgaataaccaaccaattaaaaaaaaaaagaaaaaaaaaaacccacggggaggttcatgatcaaacttagtaaacaaaaaaccaaattaaacacaggctattaaatagcttttcaagtcatcacatgaatcactatgaacgaggaacactgtgttccagtcagaaatctcctttcaagtgaacttcaccaacctacctgttagaaaatcctgaatagcagcaatcagcggttccccattcctcggggttacaagatttgctttagtctgtaggaaaagtaagcgcagtcagttagctgttctcggatgcatgatgcagcccaaagcctgaatcacaaggtttttgaatagttatgaacaaatacagagtagcagaaggacgaggctgagaaatgaaagccaggggtctgaatcccagctttgtcactaactcccagttcctttatctgtcaaggggagagaaaaaaataccagcaagattgacctaggagggtcctaccaacaccaaaatgaaatatcaagtgaagttgtttcagaattctatgaaaaactctacccatgtaagaagattttattgttgtttgtttttgagacagagtcttgcttatagcccaggttagagtgcagtggtgcaaatatggctcactgcagcctcaacctcatggggctcaagtgatcctcccagctcagcctcccaagcagctgggactacaggcccacatcatcatgcccagctaagtttttgcattttttttgtggagacggggtcttactttgttgcccagactggtctcgaactcctgggctcaactgatcctcccaccttggcctcccaaagtgctggtattacaggcatgagctactgcacccagccctattgttattactataggtgcttctccaaagaaaattcatttctgtgaatgatgaggagcgttgtgacctctgaagtcaaccaattccacacttgtccacaatgatgacagaactgttaaatgtcccttggttaagacattacgttctaataataatcaatccaacaacagaatttaattaaacatttaatgagggcctacgttgggcaaaaaagggtgttaggtagtaaaacataattaagtcatgtaaagaaggctctgtgtgtatgagagtacatttgctctaatcttgatatgaaaatgcacatgtgtatttgtgggttttctgggccttttcacccagaaagcagggtcctctcagacaaaggcccattaccacttacttctgagccactatccaaagcagggacccttcaaccagagtgggagacagctatttagccagatgtgcctcttcattgcacaccacctgactgctcttactcctggtttagagactctctctgaggtgggatacaggtagtctacggatagaagcagagtgcaaggggctgagattagtgtattttgaaaaggtctcctgggtaatttgggcccacatccaaattagagccctatgcactacacggagaacagcattgctaaatcagaacgataggtattttcttacttgaaattgaggaaacttgtccacatggtaactaaggattcttctaccccaaaatccttggagactttgttttattattgccatttgtaaccaatgaaatatgcagttgtaacacaatgtccacagtatggatcctcaatggcagagttgacagcaaagtctaaatggttggttgcaagctgatagctattatttcaagcagcattctaaacattactttttgttacaaaaataatatatgctcattatagaaaataaatctaaggccaggtgcaatggctcacacctgtaatcccagcatctggggaggccgaatcgggcggatcacctgaggtcgggagttcaagaccagcctgacgaatgtggtgaaaccctgtctctactaagagtacaaaattagctgggcatggtggcagacgcctgtaatcccagctactcaggaggctgaggcaggagaatcacttgaacctgggaggtagaggttgcagtgggctgagatcacatcattgcactccagcctgggcaacaagagtaaaactccgtctcaaacaaacaaacaaaaaaaaaaagaaaaagaaaaagaaaaaaaatctaaacgtatagacaacttaaaaccccaaaatgatgcatgcaatactaaaagcctaaaccaaaacaggttaaaagcatcacatcagaaatggtaataagtgattttggaggtagggacacttacaactataagacttaccagttcctaatataggaagctggaatactgaaaaaagaaagcctgaagctctaaaatactcagtagttggggatcatgaagttcaggaggagagaatcctacacagccggtgccatgtcccactgtgctattgctgggtcaggagtgaatagtacatgtagtgccaacaggttttttttttttcttcttttgagacagggtcttgctctgttgcccaggctgaactgcagtggtgcaatcacagctcactgcagcctcaacctcctgggaccaagcaatcctcccatttcagcttcctgagtagctgggactacaggcgtgcgccaccacacctggctaatttttgtagttttcgtagagatggagtttcgccatgttgtccgggctggtcttgaactcctgaactcaagtgaaccacctgcctaggcttcccatagtgctgggattacaggcctgagccacagcgccagcctgtgccaacagttaaagctcaactgtaagctccttaagagcaggcacgtgcctcactatcaccgatctcctgcagcatctactgggcactccttatgcatttgtcaaataaagtggtggtaagagttattatcattatgtataatactgcatcctctaagaagacgaagtatgtaatatagtttaggaaggtttccattcagaatgttcaataaaatgtgctggtgcttaaagaatcttcagctactggaaaatttacttaggtaggacatcttcttcccctgtgacagccaacattgatattgctatattcttttcttaccttgtcataactggccctcatgtatacattttctcccagaacccacatttataggccagaaaatcccctcaacgcatctgttacagaccctaactctcatgtatatactataatttctaagagattcttcaaaggctcaaaagaaaccaataaaaagagagatatataggcagttagtggtcggtttaagaacagaaagagcctggcttctttggcgttgttagttgtggtggtgttttcatgtaagtttcctttgcctcctttcaaggagctgttatgcaaaagctgggctgtgccaccctacatacccccatcagaacaagggcctctgctttagcttcttctgtttgaggaagatgaaggttcatttcatcaccatcaaagtcagcattatagggtgtacagacacactcattaaatctgaaggtccggtggggcttgaccctggcctgtggaacacaaaacaaaacaaaacaggaagaggacttaggcatttatccaaaagcttctctgttttgaaacattaaaaatggcttcctggaatactgggcactggcttaagaaagtagatttccagtatgttctgtcaagtgatatatatcatttaggactcattcccagtctggccaacatggtgaaaccccatctctactaaaaatacaaaaattagccaggtgtggtaacacatgcctataatcccagtaacttgggaggctgaggcaggagaatcgcttgaacccaggaggtggaggttgcagtgagccaagatcgcgccattgcaccccagcctgggtgatagagcgagactccatctcaaaaaaagaaaaaaaaaaaaagactcattcgagaagctttattagattgaaccaaagcagtgaatttcaacaaaggcgccagtgtgaaggctcccactggccaaggatgtcatggtttcaagtatcaaaaagattaacagcagaagttgattaaaataaaccaactaaataaaaacccatgtgtttataatgacactgaaaaaacagaaagtcaaaacaaacaaaaaaccccaatcaatctagttggaagttactgagcactaaccccctttttttttgagacgtagtctcactctgttgtcctggctggagtgcaatggtgcaatctcggctcactgcaacctctgtctcccgggttcaagcaattctcctgcctcagcctcctgagtagctgggactacaggcgtttactgccacaccaggctaatttttatattttagtagagatgaggtttcaccattggtctagaactcctgacctcatgatccgcccaccttggcctcccaaagtgctggcattacaggcttgagccaccgcacctggccctttctttaaaaaaaaaaaaattttttttcctaagcacacgaacacaggagagcactaagttcttacttcccaaaatcacaataaaggaaaaagacttaaccatttacacagcctttgctttatgagctgcacctctgggcaagcaaacagacctaattaacaagcgggtattttccattataagaattgtaggtaataaatgttaaaggaacgatagattcaaaaagtggggttccattttgcagcccaataaaataacacaggcaatgataacaaatgaattaattagaatgaattcattgcttgcatcttgactcaaacaaaccacaaaaagacaattttgagacaaatggggaaatctgaatatgaactaggtatggacctgggaatgccaagagatgactgttaattttgttaggtatgattacagcactgtggttatgtaagtttttcttacaaatgtaaactggatacatattgaaaaatgacacagatatgggttcatcgaagaaaaatgggaaagataaaacaagtgtggctaaaccttgaaaattattgcatatagaggatgggaatatgtaagttcattagaccattctttctactttagtgtacatttgaaaattttctttttctttttttgagacggagcttcattctgctgcctaggctggagtgcagtggcgcaatctcggctcactgcaacctctgcctcctgggttcaagcaattctcctgcctcagcctcccaagtagctgggattacaggcacgtgccaccacacccggctaattttttgtattttagtaaagatggggtttcattatgctgtccaggctggtctcgaactcctgacctcaagtgatacaccttggcctcccagagtgctgggattacaggcatgagccatcacacctggcctcaaaattttcaaacaaaaaaaatttctacttctttttttagagacagggtctcattacgttgtctaggctggagtgcagtggctatttataggcgtgatatagcacactgtagccttgaactcccaggcccacgtgatccttctgcctccgcctcctgagtagctggggctataggtgtgtgccattgccagtcaaaaaaacctaataattatattttgtaatgttccaaagccaagcaaaacattccagaaagagaaggctttagttaaccctctacattctcacaatcataatcccataatcacaaactacttcttagttatttctactattatgtaaatgactgatataatgtgttcagacgaccccaaaatgaatctatgaaaaaatattaccataagaggctgcttaaacactgtttgcaaaggctcatggattaacagctttacagataggagaatctatgaatattgaacaaattaaagctgtatttcatttccattttaaatctccagaaaaaggaactgctgctgttgcaaaactaaatcaccaaaaaaatatggtttaaggtcttagttggaggattactgcaaagaaaaaatcttttaagcattttagttgcttagttaatatgcaaagttaaatcaaaagtcaattttctggctaggcacagtgggtcatacctataatcccagcactctgggaggctaaggtgggaggatccattgagcacaggagattgcgacccatctgggcaatacaccaagacctcagctccacttattaaaaaaaaaaaaaaaaaaaaagggtgggcacagtggctcatgtctgtaatcccagcactttgggaggccaaggtgggtgaatcacctgaggtcaggagtttgagaccagccaggccaacatggtgaaatcctgcctcaactaaaaatacaaacattagctgggcgtggtggcatgcacctgtaactccagctacttgagaggctaaggcaggagactcacttgaacctgggaggcagaggctgctgtgagccaagactgcgacactgcacaccagcctgggcaatagagtgagactctgtctcaaaaaaaaaaaaaaaaagctggccatcatggcacatgcctgtagtcctagctacggtaggctgaggtgggaggatcgcttgagccgaggcggtcaaagctgcaatgagccagactgtgccactgcactccagcctgggtaacagagtgagactgtctccaaaaaaaaaaaaaaaaaatccattttctgccatacctattttatgtaagtttgtgcacacaacacatatacgtgtatatgtttttgtgaaaccatgctagtcactttcaattaaatcctctcttagtgttttgtatgaatattacgttgcaaatattaaaaatttaatattaaaaaatattaaagcttactaaaaggaagcttgaaattaaaaagtttcactcaaactaaaatgtgagagaagagggagaccaatagttatgaaaggttgggccagctgtaggggctactcacgcctataatcccagaactttgggaggctgaaggaggatcgcttgagcccaagagttccagactagcttgggcaatatagtgagacccccgtctcaaccaaaaaccaaaaacaaaaaacaaaaaaaccccaaattagccagatttggtggcacatgtccgtggtcccagctactttgggggctgaggtgggaggcttgcttgggcctgggaggtccaggttgcagtgagctgtgattgtgtcactgcactccaacctgggtgacagagcaagagcctgtctcaaaaaaaaaaaaaagttatgaaaacttgagataacaggcaattttaattttagaagtccactgtttagcactgaacagtcatggcaaatttctacgtgatggaaaatttaaaaagcagtgctactcaccagatgagccataatgctcaatttgtgcagcgagggctgccgattgaacagcaccacatctccatcgatgaggtgtctctctacgatgtcaccatacttgagctcttgagccatcttttctcgatttccgtatttcaaaaacctgaatgtgcaacaataaacatgatctgtgaaagcaaagttctctcaccaagtttctccctcttcagatcaggattcaatctttaatatattatttcatcaaatctaagatgcctccattttaatgtcatatagttttatgtgccaagaaaaaagctccctattaaactatgacagggtgggcgaggtgactcactcttgtaatctcagcactttgggaggctgagatgggcggactgcttgagcccaggagattgagaacagactgggcaacatggtgagaccttgtctctacaaaaaatacaaaaattagccaaacgtggtggggtgtgtgcctttaatcccatctactttggagcctaaggtgggaggatcacctgagcagaggaggtggagactgcagtgagccatgattgtgccattgcgctccagcctgagtgacagactgagacatcaaaaaaaaaaaaaaaaaaaccatgataaattgatcttaagatatatccagtcggatgtggtggctcatggctgtaatcctagcactttgggaggctgaggcagctggatcaccaggtcaggagttcgaaaccagcctggtcaacatggtgaaaacccgtcgctactaaaaatacaaaaattagtcaggtgtggtggcgggtgcctgtaatcccagctactcgggtgactgaggcaggaaacttgcttgaacctgggaggtggaggttgcagtgagtcaagatcgtgccactactctccagcctgggtaacacagcaagactctgtcttgaaaaaaaaaaaaaagacatatcctaattttagaaatgctaaaagccctgagagcccaggtgacacaggcaatgatccactttatatatttattgtatttctgagacagagtcttgctctgtcgcccaggctggagtgcagtggtgtgatctcagctcactgcaacctctgcctcctgggttcaagtgatttttgtgtctcaggcttctgagtagctgggactacatacgtgtgctaccgtgcccagctaatttttgtatttttagtagaaaaggggtttctttgccatattggccaggctggtcttgaactcctggcctcaagtgatttgcccaccttggcctcacaaagtgctgggattaaaggtgtgagccaccaagcccagcaataatgatcctctttagactttagtatccatggtattttgtcctcctggatccaataacattacaagcctgagaacaaaggagcacttcatgtatattcaatgactgaacagagcaaatgacataccttggctcacggaaatttaaacagatattttccacatgccaaaatgtcacgcaaactgtatttctggattgcattctgtggctgagtatgaccacagtgagctttgccatgagaaagtagttaaatccaactagattgggaaaagattaccttttcatctgcgtatgtctctgctgaatgaagtttgctcctgggtgaacctcagggccgttttgaaccagtttcctcaagaaattgatgtttgctttgtttacctgcagtacaaaaaaaccacaataagttactcccaggtaactagaaactaacaaatgatactgaaatgcgtcttaatctttactttccttgttcagattctaggagaaagagaggcatcctgggcagcctgctgcctatggtcttgagtataatgtgaacaacagactggcaaacaagcttccagcttccagtgtcaactcagctgtttgctcactgagtgacatggccaattcctttcctggtgcttggtttcctcactggtaaaacgggtaggctagactgatctataggaaccttctgtgatcctagaaacaggtggcgacttgatctgcaataacttactgggggcttgtaaggtttaaaagttgtgacaccagcaccacaagccctggtctgcattgaatgtgttctggaacctcttaaacaactgtcttgtggaacaccattttggagaagttaactcttggatcattagtaactcaactgaggacacacaacacaagctgaccaggaacatctatgatctgggctaactgtgagtctcataggtaaagctaatcaatattctcgttagcaggccctgcagttacctagacctcaatttaaaaaaaaaaaaaaaagtatgggctgggcatggtagctcacgcctgtaatcccagcactttgggaggccgaggtgggtggatcacttgaggtcaggaattcaagaccagcctggccaacgtggtgaaaccccgtccctactaagaatataaaaattagctgggtgtggtggtgggtgcctgtaatcctagctactcaggaggctgaggcaggacaatcacttgaacccaggaggtggaggttgcagtgagctgagattgtgtcactgcactctagcctgggcaatagagtgagactcagtctcaaaaaaaaaaaaaaaaaaaaagtgctagctgggcacagggccctgtaatctcagtgactttcagtgacttgggaggctaaggtgggatgatcacttgaggccaggagttcaagaccagcctgggcaacatactgagaatcccatctctaaaaaatttttttaaaaaattagttaggcatagtggtgtgcatgtgtagtcctagctactcgggaggctgaggcataagaatggcttgagcccaggagtttgaggttacagtgagccatgagcacaccactgcacttcggcctgggtgacagggcgagagtctgtctcttaaaaaaaaaaaaccaggccggatgcggtggctcatacctgtaatcccagcactttgggaggccaaggcgggcggatcacgaggtcaggagatcgagacgatcctggccaacatggtgaaactccgtctctactaaaaatacagaaaattagctgcgcatggtgatgggcgcctgtagtcccagctactcgggaggctgaggcaggagaatggcgtgaacctgggaggtggagcttgccgtaagcagagatcacgccactgcactccagcctgggcgacagagcgagactccacctcaaaaacaaaaaataaaataaaagcctttctgggtatgtagcaatagccttaaaatgttcaaatgctttgactcagtgactgtaaagttttaaaaataaaaaatctatcccaagaaaattaactatggataatgtttaccatttagttagtttaaaatatgaggcatgaaccaacatagaaaagtgtctacttttttttcttaaagatggtctcactctcacccaggctagagtgcattgacgtgatcttggctcacaacctccaccttccatgctcaagcaatccttccacctcagtctccccagtagctgggaccacaggcgcctgccaccactcctggctaattttttgtatttttggtagagacaaggtttttactgtgttgcccaggttggtcttgaactcccgggctcggatgatccacctgccttggcctccctaagtattgggattacaggcattagccaccatgctcggtcaagatgttattaattggaaaaaaagttgcaaaaaagtatagcatatatatgagtaaatacacatgaaactagaaacaactgtggctgcaaatggtttacagaatatataccaccaactatgtataaagcaaactgggaagacacatacactcatataaaccaaactgtgggttgagtgggttactggggactttctactgcctgttgtttgcaataccaaaatataacgtaaaagactgaatttaaaacaaagaattgagcagctgagtggtcacttaccttctcaggaaaagttagaattttggccacatgaactggcacagctacctcatcaatccggaggttggggtcgggcgagatgactgttctgccagaaaaatccactctctttcctgagagatttcctctaaatcgacctaaatagccaaaaacatgtcataggtccccatggcataccatgtgctcatgggaacaataagaacggagagactgaggaaagcctgtgacctccaatcagagaagctggacagacactcctgaaaaaggaaccaaagagagtgggctggcttctgcacatcttgtgggaaacctaccctgttttcccttcaggcgttggacgaagcctctggtccacttcttgggtgccatgttgaggggaatgcccgagagctcactgttaatgtagagggcacactgcagctgcaggaaatcccagtcctccatgatcatctgggtcttggctcctgagatccgatgctaaaaccagcacagcccaaacagaaacaaacctggtcagtttgatttttctcacattttcttgaccagaagtttttggatagatatactatgaaacttacaaggaaatgggaggcactgacctttttaataacatcgtttaggaaaatgatttctgtcagtttcattgtcagatcatcttcattggtgccagacttcaaatcactcacaacggagggtctgatacacaaaggaggcaccaaaagtcgtgtgagaatcaaatcagacggctttccggcttctgggttcatcagaagtagaggaacatcttcagctgggattcgtttaaataaattcagaactactaagggattcaagttttcctatggaaacgaagaaaggcagaaatggagatactatgttagttttccatagcttgggcaaggttttccttcactatgttttctaacctatctgtcactaaggataagtgacaacagagatttctatggatgatacgctatgctgcaagagccttaaaattgtgtatgtcttttattccaatttttcaagccaaaaattccacttctcattattccaaggggtgtaacttcagaaatgaacacaaagatttagctacaagaatgttcacaaaagctgttttttgttattttttatccgtgtgacagaataggaaggtaataaaagctgttcttaacagtgaaaagttggaaagagcctgacagtttattggctaaataaaatcacggtatatccctatgtggaaaagcagcaagccattggggggaaaaaaagatactagacaaacacagcaattgacataaaaaaggtccataaaatattggtagctggaggctgggcgtagtggctcatgcctgtaatctcagcactttggaaggccgaggtaggtagattacctgaggtcaggagttcgagaccagcctgacaaacatggcgaaacctcgtctctactaaaaatacaaaaattagctgggcatggtggcacacgcctgtaatcccagatacttgggaggctgaggcaggagaatcacttgaacctgggaggcagaggttgccgtgagccgatatcatgccattgcactccagcctaagcagtaagagtgaaattccatctaaaaaaaaaaaaagtgttactggctgggcatggtggctcatgtctataatcccagcacttagaggggctgaggcgggtgggtcacctgaggtcaggagttcaagaccagcctggtcaacatagtaaaaccctgtctctacaaaagtacaaaaattagccgggcatggtggcgggcacttgtagtcccagcaactcgggaggctgaggcaaaagaatcacttgaacgtgggaggtggaggttgcagtgagcctagatcgtgcaaccgcactccagcctgggtgactgagcaactctgtctctaaaaaaaaaaagtgttactgttaaaaaagaactaaggtaagccaggatgcagtggctgacacctgtaatcccagtactttggaggctgacgcaggaggattgcttgaacccaggagttcaaagcctgggcaacatagcaagaccttgtctctacaacaaattaaaaaattgttgctgggggtggtggtgtgtgcctgtagtcccagctacttgggaggctgacatgcaaggatcacttgagcctaggaggtcggggctgcaatgagcctcgatcataccactgcactccagcctgggagacagagagagaccctgcctcaaaaattaaaataaataaataaacaaatatataaaataataataaaaaaaaagaactgaggtaaaaacacaaacaaggggccaggaatggtgacctatgcctgtaatcccagcactttggaaggctgaggtgagaggatctcttgggctcaggagtttgagaccagactgggcaacacagcaagaccccatctcaattaaaaacaaaagcaaaaacaaaaacaactggtgttacaaggccagtccacattagccttagtgccagataaacactgttacggtcaaataagaattactggagagctggccgggtgtggtggctcatacctgtaatcttagcactttgggaggctgaggcgactggatcacctgtggtcaggagttcaagactggcctggccaatatggggaaaccctgtctctactaaaaatataaaaattaggtgggcatggtggcacatgcctgtaatcccagctacttgggaggctgaagcagaagaatcgttttaacctgggatgcacaggttgcagtgaaccaagatttgcaccactcactccagccagggtgaaagagcgagactctgtcttccatctcaaaaaaaaaaaaaaaaaaaggaattatcggagagctgtcgaacctaactggacctctcattttggaagaaagtgggtgtctaggggtggggcggagttgggggagagagtgtgcatgtgacgtgcggaagaggcaggcgggaggcaggcggaaggcaggcgtgcattctcaggctcacctgtgcccttcccagcagaggctccacttctttattatgttcaatggctgtttcaaaagactgaaggaaatttgatacaatgggatccaccacttttttgttggtcttgtatttctcatgaattattttcagcagtccacacttctttacggtacctataagggttagtttatttaccaagaaataaaaaattatgttctcagattggccagagattgtagtatggttaatgaaattactgaaactactatagcaatgaaagatgagaggtccgtttcccaataggacatcagttgttgggctcttaagcctaatttataaggagaaaagctgactcccgaacattatgtaaacctaataaactaaacagaagacagtgagtgaaaagggctattgcttagccttctgtgcattccactcaccattaaaagcgccacagtgatggcagatgtttttcttccggcacttgtcagagattttctttttcagtcctcgcttctgaaggtaggtcaggccgggcctctttagatagtccagaaactgcttcttctcctcttgggacagcatgatgtggcagcaggttttgcagatcatctttttcaaattaagcaagacagataaaagcataagtgagaatgaaaaattattttcttttaaaaatgccatcgccctgttttgtacccttaaccacgtgaccatatacacagatctgcaaatggctctatactatggatatgcagagaggaagcctgtgttcactagattagcagtactcacagccagtaggcagactttgttacctttatctttttctttgtgctattctgtattgtttgaattactactattgttatttttttaagaacacgtatctaccatcttctcaaggtaaataaacaaaataaataattcttgagtgatttaacgtagtgtgagatgaaaatattatgtacttagtataaaagagtcccctagatgtatcccccaccactcacagttcctaagttcattccagcatccctgaccaatcactccagaatttatgtcttggaaatcagcacctgtgtgcttacctgtaagatgcctatgactgctctgaagtaccctacatgaaaacacggcaactccaggtcgatatacccatagtggcctagacagtcagccaagtttttcccacaggtttcacatggacgatccttctcactcgtaccctttgaaaaaaagcacacccaatgatcaacacagactgctggacgggaaagagtgcccagccatcatgcctggctggtgacacagaatcatttcttttgcttcttaaatttcctttctgagatcacttcctactgtttttctttcttttctaattttcatgactcagaatcgaatcaggttgctgactaaaggccggagttcttgacctagtctaatatgtgcaggggggaattgaggagatggaaggaagcccctgctcctttcaatctggtaagtcaccagttttatcagcagggcaagacacagttaccaggaggggtgagggggccttaccatcctatggtcgagcaccccatatagcaagggggcatgttggttgtcctggctgtacaggttcttactcacaacttggatgtgcgcctgctggcgcatctcctcaggtgacttcattccaaaacagatgtggcttctggaatgggaagaaaaaggtgaaaattacagcaaaatctgtgaccaaaaatgtctattacatacatagcccaccataaccaacctatccttccaactgtctccactggcttttcctaccagtattaaatatatttaaccctctctcatttttccttcacaaacatcccttcatcttactggaatccagtttctactctcaccatcaaaggaacagtgctcaccaaggccacctagacaacctgcctgctgctgaatccaataagaacttcctcattttacctctgcagcactggcagcaccctgcccaatcctgaagtgcttttctctcggctttggtgacaccatacactctgagttttcttcttcccttctctggctgctccttgtacagtctcttttgaggtcttttcttctactgctatcccttaaatattggtgcactgtaccacctagcattacaaccttcatcctcttatcttctcatcctacacattctcctgagtgatcatgccactcacatacatgttgatgtctatcaaatctatctctataggccagctactgctacccaactggacatctgtatagacacctcctcctggacagttccacctagatatctcataggcacttcaaaccccacacattgaaaacagacctcaatactttttctcccatgtctgtcccttcattcattcttccaacaaattgactatttcctatgtgccaggcaccatcctacaggctgaggatacagattagctaagacagacaaggtccttgccaacaaagagctcacaggtcagggtgggaaagacagaccacaaacaaacgaatatacaaatgtgaacagatgcagaagtgatgtaagcagtggagtctgaggaattactttacgttgcatggtcagaaagcctcactgtaaaactgacaatcagaaggaagagcatctgaagtggagagaatgactagggccagggtcctgggactggcacaagcttggcattttcaaggaaccaaatgaaatcagtatatactggagcatagaaagctaatagtacaagataaagtcagtgaagcatgcaggagctaaagcatgagggcttgggaactttggtagggaatttatttaaataacataaatgcagccgggtgcggtggctcatgcctgtaatcccagcactttgggaggccaaggtgggtggatcacgaggcaaggagattgagaccatcctggctaacatggtgaaaccctgtctctactaaaaatacaaaaaatttgctaggcgtgatggcccacacaatggaaagctgctagaggatttttttttttccctgagacagagtcttgctctgtcacccaggctggagtgcagtggtgcgatctcagctcactgcaacctctgcctcctgggttcaagcgattctcctgcctcagactcccaagtagctggggttacaggcatacaggcatgcgccaccgcacccagctaatttttgtatttttagtagagatgaggttttaccatattggccagtctggtcttgaacttctgacctcatgatctgcctgccatggcctcccaaagtgctgggattacagacgtgagccaccactcctggcctctgctagaggattttaattgacaatacccttaatttgcactttgacagaagcactttctctgttttgtgagaatgtattatatctgactgggcgcaggtgtacaggtgggtgtgaagggccagtgtcgatgtagagctaccacatgggagaatgctgcattcacctaggtaagacacctgttctagtgaatggcaaccatccacacagctgcccaagcaaggcattctgtatatccgtctcaaggtctctcgacctctaattctttccaccatgaatcaagagattttccagaaggagaactcttatcaagatactctcctgttgaaaatccttcaaaggttcctcactgcctacaagatgacttcttaacacagcttcaagtcttctgcttccttctgatcacctgtgttctctccctcaggtctgctccttgaaaaaagcagtttggtctgctttcttttgcctggacccattatgtgctctcaaaaccccctggacctacccttgtcattgcacttgtcgtacccagtgttgacttgtgtaccttctccaactagattaggcagtaaaagttttattcagaccgtatctttaacgtccaacactgggaataacgcgcagtatcctcctcagtgtctgctgtaagaatgatgaattcacttttttttttgagacaccgtctcactctgtcactcagggtggaatgcaggaggttgcccactgcaacctctgcctcccaggctcaagtgatttttcggcctcagcctcccgagtagctgggaccacaagggcgcgccaccacgcctgctaatttttgtatttttgatagagacggggtttcgccacgttgcccaggctagtctcaaactcctgagctcaggagattcacccgcttcggcctcctaaagtgctgggattacaggagtaagccaccgcgcccggctggattcactttcttaccgagaactctaagaaggagccaccgcctaataacgtatttctgaaggcaaaagtccggatagcagctttatttctgacactgccatccgtcggcctgtggtacagctttctagtgggcaaccccatccttttggtaagcaactactgcctccgtgtcagacgctctgcggctgacagaattagagacagtccccgccccagattgctcccctcgctgcagcaggggatagttcgctgaagaacagggatcattgtatgacttcaggagaatgcgagctttggcccagggtgcacaaatcattaaggctcaggccactccgacttctccgcccaagtccagggacctctcgaggtgctgaaatcccctcagcctgaccaatgctctttgaccaacgctggtagttctgggcgctggtcacacctatggactactggccctccccttcccattgcaccccatctctgaccctgcaagacccgggaccgctgacctcggaccccttgccctatttctcagccctttggccactcttactccgtcttacattttcttggccacatccgtctcccggaactgctccttcaccatgatgaccgctgccgggacgcctccttggcactcgggaggccagattagagaaacgatgcccccagcacctcctggggctgcttctggactcgccgctaacacatctgcggcatcctctcggccaccgtagagt

SEQ ID NO: 914 - DNA, 1619 bp, Homo sapiens
ttttccagttctttcttttttattctgcagttttctatcagtgtcgggtcccccactccagccagtggctgtggggaagggaagacatctctagggacacgactacagaccaggcagtgagcctagcaaccatacatcgaaggtgtcgccagcctcagtgccggtgggcgtctgcaccaggaatagctaaagccgacgacatctagccacctcgagcgccagggaagacgctccgcgtaaaaccgcggcctcaggcggactcccgctccagctccgcgctgctggtggcatttccggggacccaaagtgggtggcctgggggcaaaggaacagaggccgaagaacttggggtatgttccactagagcacctaagggacggagtgggaggttacatcagatatgcgacctcgacacattccaaaagtggcagccccgtgggctacccccaatagtgggatggatctccccaacttctctcgcccctcgaagtccccctgttatctcgggccatgctcctcccccgggattcccttgtgcaaaattattctctcccttgcccaaaggatttttcccttctttctgaccccacgaactcatctccccaacaggttcctaaagtatgggcggatgtgctccctctcgcccaccgccaggagccgagccccggcaggtgagcggtgcaaaacacgcacccagctgcccccagcttcctccgtccccgctgagttggctgtccccaccccgcaccacggcacccgagcctgtgagtccccgaccccggccccagccgcagccgccaacaaccctacaataaacaagaggacaggattgagcgtccgcgtcccggagcgcactggctgggggcaactcctcacccccggcgcgccgcccgctgccccgatccgagagcaccgggagagccgagggaagggaaggcggcgaggggaaggcaggcggggatggagggaggcacggcgcggcgcggagcgaggaggtgggctgcaggggacgccgagaagcggtggggctggcgcagagggcgggcgcccggggcgcgcgttaccttcgtcttgcccccgcagtggcagcacacggtccacaggtacttgagcgtccgccagagcaagatgatgaagaggcccccgaagaaagtcaccatggaggaggccaggaaagcccaccacatgcgttggccccggctgtcgcacggcacctccatggtcaccgggatgatgagcgcatccatcttgggctcgtggaccgaggacgaggaggaagaggaggaggaagaagaagaagaggaagaggaggaggaggaggaggaggacgcgtctaggctgagatggttcgcgtggatattgctactcattctaagactgctgcctccgccgccgccgccgccgccgctgctgccgccgccgccgccgccaccatttgccatagctagcaacgggcagccggcgcaggggctcgggggagctcctcccgccgccagcgccaccccaaacacccatcaacagccatattgctgctactgctgccgccgccgccgccgccgcggagcgcgggaggggggcggggaggcgcctgggctcggggcgctgtgcgcgacctggcg

SEQ ID NO: 915 - DNA, 1619 bp, Homo sapiens; identical to SEQ ID NO: 914

SEQ ID NO: 916 - DNA, 1619 bp, Homo sapiens; identical to SEQ ID NO: 914

SEQ ID NO: 917 - DNA, 3015 bp, Homo sapiens
cggccggggcgcgccccgaggccgggctccagccgggcatgctccccctccccctcagcctccgcgcgcgccgcccgccccgcgagaaaactcgccccgaaagccgggccgcgcgccgcccccagagcaagactacaactcccgggagaaagtcgcctgggccgtgtttcccaggctcccgacagctccggcccggctcggaggccgcctcggcccccgtgcaccccggcccggctcaccggggccccgcggccgccacccgctcccccgtggccacagccccgccgccgccggcccgtccctcctctctcccctccccaggccgtccctccgggaggcggcagcaggggaggaggggacgggcggaggggaggggtccccggcccgcccgctaggcggggacgcggcgccggctggttcccggtcccccgaggcccaggcgcagccgggggtgggggacacggagtcaggcctggcacgcggccagcccacaagctgctggagaccccctcatacaaatcttgcccccagtccagagggtcctaatctgagaactccaaaatacagcctggagacaaatggtggggagggtttcccctaaatttggacatctccagattaagacctccgccgaatccgtgaggctttccctctccaaggagctcctaagagaatttcccagtaaaatcgcctcaactgcggtaaataggctgttccccgcgccagcatttgagaagagctggtccccagagtgtaaaggagttaggatgttggcaggaggaaggatgtgtcgccggatgaggaaaagaaaggtgggtgtctgcggtgcagtccttggtctttctggcaagtgaggcgctctccccctaaatgtctcagagggagacaaatcagcggactaccttgcttcctttgatgacttggaaaggatctgcagtcccccttaaagcccaagaatgtcttctcttccacgacagccgtttgtggacacatactgcttacctccctgactgcaggacaaggtccttcaaagctggaactctgactgcgctcagtgatcccgcagtgctcctctgtagagtgggaacccaggtccatttcaaatatctacgttggaatgagtggatctcgctgggggtgagaggcactttgtctacccacactgccagtcccagccacatgcctcctcccttccctcaaaaagcagtgtcttcttagtctgcttcttcaaggggagaagtcgtttttatttatggaaacgaactcactatatggtagaaagaacaagagtatcagaatttgcactttggacttggactcccctctaagcagctgcacaaggtggaacaaaccaataatccttgctgatctgttttgtccttaggaaaaatggtggagggagaatattagatcaggggttcttagccttggcttcatgaataagctcaaggatgtcaatgaagcttttgacatgatctcaacttttttgtgaacatttatatatttttctggaatggggtccatagagttacaagttctttaagacctccagatggaccccaatatggcagaaatgaactatttaaagatacctgcctgctcccgtagtctgaccctctatggctaagcaaggttttagaggagtggaaggctggccattgcacagtatcagggttccagacaggctccctggctcttccctcccagtcctgctcctgagatatagttctttctggccgccacttcccttagggcaaccccagagcttaaatcatctgcaaggcagtcacctttcaggcacctttcatccggcacctgtgttcttagctggattaactagaaagctagttggaggaaggaaggtgaaagtggaggaaggggaaaagaggaaaagttggagacgaatctggcttatggttagaagcatattttttggccaggcaaagtggctcacgcctgtaatcccagcactttgggaggctgaggtaggcggattgcctgagctcaggagttggagaccagcctggccaacgtggtaaaaccccgtctctaacaaaaatacaaaaatttagccaggcatgatggtgcaagcctgtaatcccagctgttcaggaggctgaggcatgagaattgcttgaacccaggaggtggaggttgcagtgagctgaaattgcaccactgcactccaggctgggtgaccgagcaagactctgtctcaaaaaaaagaaaaaaaaacttattttttgagacagagtctcactctgtcgcccaggctggattgcagtggggcaaacacagttcactgcagcctcaatttcttgggctcaagcaactatcctgcctcagcctcccgaggagtagctgggatcataggtgcttgccaccacacctggctaattttttaaatattttgtagacacagggtcttgccacattgcccaggctggtcttgaactcctgggctcaagttatcctcccgcctcggtctcccaaagttctggaattacagatgttagttaccacccggaccaattttaggattcctttagccagtgaccttggtgtgaccttgtacttctgcagcattttataccttctgcggcacacccttgtagtgggtcgaattgtgttcccccaaaagatatgttctagtcctaattcccagtacctgtgaatgtgacttatttagaaatagggtctttgcagatgtaatctagttcaaatgaggtcatactggattagggcgggtcctcatccaataactgttgttcttattagaatagggaaatttggatgcagagacacagagaaaatgccatgtgaagatggatcagagacagaagtgatgcggctgcaagccaaggaatgtgaagaatggccagccaccaccggaagctaggggagacgccagcacagattctccctgagagtatccagaagaaaccaaccctccaacacctggatttcagacttctgaccttgagaagtgtgagccaataaaacaactgcagtgga

SEQ ID NO: 918 - DNA, 23055 bp, Homo sapiens
caggcatcggcgcggtcagcctcgtggcgcgcccacgcccccacgccggctcttcccggggtccttccgtgcgcgttgatatgattggccggcgaatcgtggttctcttttcctccttggctgtctgaagatagatcgccatcatggtgagtctccctgggcccgtgcagtcatctgccgcgtatccgagccatccgtggtccctgggtcccagtacttgagctataggcacgcgaagcccggttgctcttctctggccgtttctgtcagaggatggttgtcgaggggctcggggctgttggcagggcgtccgggctggcgggctgcgctgtagacccggacacgctgggcttcgggctccagcgcctgggcagtgcaggagctgttgcgcttgttgacttcgtggagcacggtggatgggggtagggggcgggcgggatagatggacactgggaggcacatctcgtctgcagttcctcattgggctaggtaggcggcttgcaggtgatggcagtacaagaggtgaagaaggtgcgggcagcgcctgggcgagttgcggcaagtgaaaccattcccacgtgtaagctagaaaacttgtcagctggatggatcttcatgtttcatagtggggaaacaggccctggaaagagatgttataaaaaggtagtcctgccctaagtcatgcgttattagctcctccagcatccgtttttaactttaccagcaatcttttttttttctccttacctttgatccgttactttcaagaattgagtaccactgacgtggatttaatttggtgtggtttctcaaagtaaaatggagaaagtctaggaagttatttgctgccatgaaagtctcttgcgcctcctttttggtaaaattgttagcataaattgcttaatgcccacattttttgttaggtattaagtaaaggtgcagttcagtccttcagaagggaatatcgttttctctgatctctgctatggccattctagaaggatagattacatgtaggtagtgagtacaaggtttggggcacatttgtgcaagacatgataaacacagttcattgagtgacctttatatgagccacagcagtttttaccccagagaagtgattctcaacccggagtgatttttctcctaagggaacagttggctaagtctggagacatttttgattgtcacaactgggaaaggtgggaagtgcttccggcatctagtggttagagggctgggatttttatagttattctaaaacatacagtccccacaacatatccatatggaattatccatatggaaatatcagtagtgctgaggttgagaaaccctgccccagagatacacataacctagtgaagtaagttgtacagattcatgtgtaaaaccattgtgttttcctggtattttatgtattccttaggtgtatcctgtgagtttggccttgcccagtgggttttatttactttagttcgctacatgactaatggctacaaattggactgcaacattctaggtcttggaaaatcacagcaaggccaagaaaagttggagtagttttattaaccagagtgtttatgttttcagaacgacaccgtaactatccgcactagaaagttcatgaccaaccgactacttcagaggaaacaaatggtaaggaagggcacatcaatctttgcttaattgtcctttactctaaagatgtattttatcatactgaatgctaaacttgatatctccttttaggtcattgatgtccttcaccccgggaaggcgacagtgcctaagacagaaattcgggaaaaactagccaaaatgtacaagaccacaccggatgtcatctttgtatttggattcagaactcattttggtggtggcaagacaactggctttggcatgatttatgattccctggattatgcaaagaaaaatgaacccaaacatagacttgcaagagtaggtgtcttttcatttgttgatcagctcctgaagacctattttttcaatagcgttgtgttgtgagtgtggtaaaaagggcaagaccaagcaatctgggatacaactctgaaaggattaagagaaaaagttatttcataaaatgcacaggtggagtacgggggttcaaaattgaagtctgacatttgagctgagttcagaagggcagctgaagtagtgttcttggagatgggctaggggtaaggattgttttccagaggagaagtaaggggatgtgtttggaaaggtagcctggcaccaaattcacttagtttggattaagtctgcatctgggcttaaacccataggtagtcaggaaccaggaaaagtttttgattgtatactgagtgtcaaacactgcagagtgaactacagcagtgatctgggcaagctccccagcttacattctagtaaacaagtaagcatcatcacctcgaagtgcttgttttgtttgttcctttaactcactttatcctatcctgttagataaaccttcccatacgatagctgtgagggaaaatcctggtgatgtcataggtagaggctgcacttttttttttagagagagagtttagctctgtcgcccaggctggagtgcagtggtacaatctccttggctcactgcaacctccgcctgccaggttcacgcaactcttctgcctgagcttcctgagtagctgggattacaggtgcgcaccatcatgcctgggtaatttttgtatttttagtagagactgggtttcaccatgttggtcagcctggtcttgaactcctgacctcgtaatccgcccacctcggcctcccaaaatgttgggattacaggtgtgagccaccgtgcccagctgaggctgcactatttttaactgacgttcggtcatgttaaaggccttgctgaggtggtgacattgaagctgagatccttgtaaagatttggaagtagtctttgtaaagatacagaaacagtcttgtaggccccaggaacagcaagtgcaaaggtgggcagagtggagatgagtagatccggaatctccatgatgtgggggttgtaaatgcttgtctgtcataagggagtaatggggagttgaaatgggaagagatcccctcagccacttcggaggtgccttgttttggtagtgcaaaagaagaaaaaatagtgatctgtgagctcaagtctggacaagaacagccagtctcccaaactccctgttgagagaatgttgagtggaccatttgtttcctgtgaggctattccatacctaaaatcccttgatgatcctttctgttccagcaaaaacatgcattaaatgtacttgaaaagttttggtttagaaagctgtgtttcttaagctcagactgggtcagtttccctaccagagtggtgggtaatgattttaatgtttacaagtcacctggatgtactcttttctcattcagcatggcctgtatgagaagaaaaagacctcaagaaagcaacgaaaggaacgcaagaacagaatgaagaaagtcagggggactgcaaaggccaatgttggtgctggcaaaaaggtatagttcattaaggaaaatatagaaacgtcattaattgtaggtctttagtttctaggaaagaagggatcttattaatttttaaaataacttttcttaatgtttcttcttttccctcttcttctggattacagaaggtaacatgttttaagaaactatgtagcatagtgtcttaacacctcagtaaagtagcttggcccaccccttgtcagctcacagcacaatctggaggccacattggttcattgatcccagctggtgggcacctttcaagcctatcacaagaagttttaattttactaattggcatagaaccttcaatgcagagcggatcccattccctgtgattttacttattaatatggacactggtttaagaagcagttggatcaatgtggcccgtgttttcctggcacactggaaaggcaactgagatctcaggattgctttcctctccagttggccaagacaagtgattttagcgataagcagctttttaccagctttgctagctgtaaatagttggacattgtaaatcattgaatagaattaaggtgttgggttgttaaattaacaaataatcaagtgttctgtgaactttttttttttttttttttttttgcttttcctctctactttcttggatttcttgttcatcagaaatgaagtgtctagcaggtactgagattgtaagcacggtgtggggatgcatcaccttcactgagtttgctttgatgatgctttgcatgttggcctttggacgacagttttatagtatggtcgattataatgccagtgctatttaggctggtgcaaaagtaattgcagtggcaaaaaccacaattacttttgcaccaacctaatatgttttaagatagtatattatgagcaaaggagaaaacgtttaaaatcatgtttattttgtaaactccaaaatgcatgttacatgtgaagtgactcactggaggaaggtgagtactttaccaagtaggcacttgggaaatgctgtgtccacatacttaggaaatggcttcagttaacactgggcttgggaagggctctcttatccaaggagcagtcttctctggagccatgaaaccagcctggcagcactggtaataaactagtctgtgaaatctggcaaagcctctgtcctgtttggatatacgcaaaactgccttttaccatttccattgctttttattacttaatctcccaactttgtgcctggtgtctttttttttttttttaaaatagaaaatttttgaggtaattatgtattcatataaaagtctttggtggatatgctttttcccacaagcacttggttagaatggcccattacctcatttgtttattttttgagacagggtctcttgtcacccaggctggagtacagtggcatgatcatgggttactgtacctcccgggcttgggtgattctcccacctcagcctcccttgtagctgcgactacaggcatgtgccaccgtgccctgccaattttttgtagagacaggatttagccgtgttgctcaggctgctcttgaactcccggacttgagcagtctgcttgtctaagccttccaaagtgctgggattacaggtgtgagccactgtgcccagcctgttacctcatttaaaacaaattttgcacatctgaacagcctaaaattgtaatgtgataagtggggtaggagtggggtgggcgtagtgggattttgaatcaatgaaggcccttgttcttgtggcatccttttgcagtgattccctgccaggcaaggcagtaaacctgggattgcctgcccaggactgtaatcacattgatgtcccagcgccatggagtatgtaatgaatgaactgccagcagaactactcactaagaactactccctgtttgtgaggattgtacctgttgagagaagttgcaaaaagaattagtcaaaagaattagtcaaaatttgtcctctgacctaggtctgaaggacatttaacacattgattgttctcttcatccagcctttgagccctatgagttagtgcccttagcctttgagtcccacaggtatggaggagctacctgtggggacctgagccatcactattcctgcttcaagttacactggtgcctctcactagcactgctctgaaaagccagctggaaaaatcaatgcatttgagtacataaattctttggctccaaagaaatgccatagcaatattgcttttaattcagttttgtttagatgttagaattggtatttgttcttgctttttggttgcgatggagttatatactaagttacttatactaaggcattagtagtctcatatctgaggagcaattgtatttttagttcagctaaattaatgcctctttttaaatactaacttgtactacttttgtggctgtgaatggtatcttttattgaactgaggcagcttttaaaagacttgcctgatcatttagagcactcccattgaggttaaattagacttgaatctgtaatgattctcgtaactgttcctggtgtgtgtccagcacaatgttgctgggcagagcagaggggcagaggctcaggtatgtacttcattgacaagtgggcaaggccatcctgggtaccacattggcttaatgatctcttcattgtgaagtccggctacctcgtttgcataagaactacagtaatcaggcaaggcattgtcagaattgggaggaataaaatcagtgagtctggaaggagtgctctgtatacaattgcaaagaacaaaatggtcatctttaaggtacctgattgcatgcacttaaatgcagattattttggagtttgaaaagggactattaatgaaatctttcttttccctcctttctctttttcccttccccgccactgattcagtgagctggagattggatcacaggtataattcaagcttttcatgtagtcatgtagatcactagactccttggtgtactgacgtagcaatttaaaagcagatcatgtgtagtacatctagaagtagatttacaaatattctgaagagttgtaaccttttaaaatactaacagtgacatggttttgtttttaaggtttagcaatatttagcccattatttttgttttattcttaacttgaatgtttgtaaattttatttcttgatgctttcattgtgttatgataacatcaaaataacttgatattctaggttactaataattgttgtgcatgagtgttactacttttggaattgaagactttaaagaattttaaaggcagttgttgactaaacttctttctcttgattcacagccgaaggagtaaaggtgctgcaatgatgttagctgtggccactgtggatttttcgcaagaacattaataaactaaaaacttcatgtgtctggttgtttgaaatgtatttgcagtttcctgggactgctaggaggttagtctgctgatttcagttgctgtccaagttcacatgctccatgaagcattcagtgaaaacttaatgtcatggggtggtgtttgtttgctgcttggtttatagcttaggtgggttcatctgggagtcaagcttgtaaatgctgtgttaagaaccatgtccgcggtggacgcagtgtagtggctcacagtcatcagcacttttgggaggtttgggtgggatgattacacttaagcccaggagctcgaggctacagtgaggtgttttttttttcgagacagggtctagctttgttacctaggctggtcttgattgaactcgggctcaagcgatcctcctaccttggccacataaagtactggcatgagcgaccacgtctggcttagagtctaaaaagtaccatgtctggataaactggagaaatctcaggaagcagtagagagctgaaagacttggttgggcatgaaggggactcaggaaaagcaataccgtgaaggcagaagggttgaggttgcaggaaggaagggtagtggaatgttttggagaaaagatggtcacagcccctgcatggagcacctacagacaggagggcagggctgagaagagttaagtcatggggctgggcctgctggccagggggtggttggagttctgttttcatatctacagaggctgtgtacttcggtttgtggggcctctggccctgtaggttctcttgctaaggaatctgctactactttgctaggaccaggaaatggcttactagtacagaacgtgtggaagaatggggtctttgatgtgatttgacattttttgatgaacagtgcataccaggctgaaggtaatgctaggggcagcaaaggttggggtttgagatgcagtttcctgtgactgagctggagtgtggaagcagagaaggcaccctgtgagcagcttgcagaggcaaggtggtgaggatcctgacagtgctgcagggatgggatgggatgggatgggacaggacgtggagctgggggtggttgctaagttgatgcagggagagtggaaggaagcaattgagaactgaagggtaggaaatagtttctgatgtgaagaaaaagggcatagctgcagagagcctgaatgattgaaggttggcatcaaagtcacgaagtggggaggcttttctgttcagctgtgctcagggcagaagttgtagtctttcagccagtagccttgggaagggaggtgggatgaaactcaggcttggcctatttttccagaggatccacttgggttgtgatattatagaaaatgtggcagtcttgctgtgagccttgttaggcataacatttggaaacttggcaaattttacgtaaaggtctggatttccagcctcttgaaataccagaagcagcagtagtagcccaccttcctgtttgataacaattggcagggctccaggctggctgcatctgttgggacaggtattctctggtctccacagcctttgctcctacggccagctaacaccctcctctacctgccctctggtcttctgtccctgctgcctgcttctcttccatctagtccatccaagtgttttttggggaagtcacctggtaccttgttagggttaatttgtcttttaaattgggctcccaagggtatctgctagctaccctggctcacaaggctattttgaggctgaggatgtaacaactgtgaaaacagtttggaaactagtgctaagcaattgtttgtcaggaagcagggacttgtgggaactcaaactgtggacagattcagcacattgtaggccctcacagtaaccaggctaccctgtgctgtcagcaggctttggaagagcctccataaaatgcaaacttgactttactaagctgaatcaatattgagggagcacatcccttccttcagcttgtcactgatgggaagctgtggcttagagagagcagggatctttgaagagtgatgagaaactcagctagaggtggttctgggaaggtacctgcagtgaatatttggggtgctgctttttagcttttcctagcaccacaaccatgagttctgtttgtagctggatgtgcctatgtaatcaggcagctttcaactctgcactcttcctttcttccctggcaagttgcttattttaggctgcccttaaagacagcatcttacatggtgctctcatggagccgaaacaggtgctgtcctaaactctgaacaacgatctccattaatctgcgcgcgcacacacatacacacatattttttttgagatggagtctcactgtcacccaggctggagtgcagtggcagaatcttggctcactgcaagctctgcctcacgggttcacgccattctcctgcctcagcctcccaagtagctgggactacaggtgcccgccaccatgcccgggtaattttttgtatttttagtagagatggggtttcaccatgttagccaggatggtctcgatctcctgaccttgtgatccgcctgccttggcctcccaaagtgctgggattacaggtgtgagccaccgtgcccggcctaatctgcatgttaactccaagaagcatgtcttcctggacccacgctggaaagggtgtagagcagttaagcatcttaccagtgtctcacccatgaagtggtggggatgggattggaatgcagtcatctgactccaaaacactgcattttttcaggcactccagtattaagctactttgcactgtgcatataatggtatataaaactcatgactgccagcagggtgccagttgccatgggtttattgaacaagtgttagatggctagccaaattcccaatttactgaccacctgctgtgtccctgttctgcaagttggggataaagaagctgttctgtcttgaaagctctgaggtagttaatgacgatcccatgatctggcttctgttcctttctgtgaagtagcagatagtgtatgactgtgacgtgatagaaattgagagccaagaagatcagtgcagggaggctgggtcttggaaggcttccaggagacatacagcagtccccacctatctagtttcagttgctgtcggtcaactgcagtctggaaaattatcatggctaaatggtctgggatcacccaaaagtgatgatcctcttgaagtgtcatcagaaggtcaatagtagcctaacacgtcaccatgcctacgtcatttacctccctctcccttccacataggcattttatctcccatcaagaatgtgaatacatgtacgtattcagaggaaaagagttcatgcagcctactacagtataattattaatatcttactccctaaattatgaactttaattatgtatatatagcaacaaacttggtgtagatagggtttgcggtttcaggcatccactgggggtctaagaacgtttgccccatggataagggaggattactgtaacaccagcagtggcaagagacatgatctgatttggatgcacaggagaaagttctcatttgaggccatgaaaaataggaaagaaagcagggagatgggagcaggcagtgtgggacaaggtgagaccagtcattctgcaaggggaagagaggatgacactggggaggtgggagcagagtgggtaggtaggcattctcttgaatcaacaagatggaaggccctacatgactgatgcctttgagcagagttttgcacaatgcatttctggtgggagatactccatttcaaaaatagtcttcaggttggctgctagagcacagaagtatgacacctgactcatttgtgctggcagagaggctctcctgggttttagagctttgtgaacacacctccatacattaatccaactgtccttccccatccactcacccttgaacttcccgcatgccagatgttgaggggaggcagaaatgagacctgcctcccagtgcccacagtctggatgagagggtacaggtgaggtcctggtaagaaacgaagctggagaggtcagcggagaataaatcagggaggatcttgtatgccaagctaaggatttcacttgttcagtgttttggttaaagaaaataaaacgttggagaattagatgttctgcagtggattgtgtgttcttttcacatgccgagttcctccacacaggaaatactttggcaacgctctggctgctcatcatgcatattggagagggaatttatgtagaaggttatgggtcgatgagatggcatccaagtatttatcgtatttttttgagatggagtttcactcttgttgccccggctggagtgcaatggcacgacctcagctcactgcaacctccgcctcctgggttcaagcaattctctgcctcagcttcccgagtagctgggattacaggcatgtgccaccatacctggctaattttgtattttgtagtagagacggagtttttccatgttggtcaggctggtcttgaactcctgacctcaggtgatctgcccaccccgcctcccaaagtgctgggattaccgtcgtgaggcaccgcgcctggccccaagtattaataactcggaaaaagggaccagatcaggaatcaggagtcacagttcctgatctccactcagcttacaatcagctggggccatggatgggcaaaagacttcccttttctgggcttctatttccctccctgtgtctgtctgctatccgggctagatgagtaattccgaaacctggcaggtgggggctttctttttttctttttgtgagatggagtgttgctttgtcacccaggctggggtgcagtggcactgttttggctcactgcaacctctgcctcctgagttcaagcgattctcctgcctcagtcttctgagtagctggaactacaggcgcctgccaccatgcttgggtaattttttgtatttttagtagagatggggtttcaccatgttggccaggctgggggcttgttaaaaatacaaatgctggctgggtgtggtggcttatacctgtaatcccggcactttgggaggctgaggcgggtggatcacttgacgtcaggagttcgagaccagcctggccaacatggtgaaacatctctactaaaaatacaaaaattagctgggcgtggtggtgcgtgcctgtaatctcaattactcaggaggtggaggcacgagaattgcttgaacccaggaggcggaggttgcagtgagccgagaccatgccactgcactccagcctgggtgacagagcgaggctctgtctcaaaaacaacaaatgcccagcctcttgccccagttttcagagttagtagatctgggtagcgcccaagcacctgatgttttaatagcttcccaggtgaggctgcttcaggaaactggactgaagcttcccaggtgagctcaggcttgggaagctggactgaagtttctctaagatccgttctgcctctgagaattctgtctctaatgggaatactgtctctgccctcaagaagctggcagatgaacagtaatactattgctaattaatgaccacagaatagctaacatttattgtttaccatgtgccaggtactgagctaagtcttgcacaaattatctcatttacctttttttttttttttttttgagaatgagtctcgctctgtcacccaggctggagctctggattgcaccagtggcgcaatctcagctcactgcaacctccaccttctgggttcaagtgattctcctgcctcagcctccatagtagctgggattacaggtgtgtaccaccacacctggctaatttttgtatagtagagacagggtttctccatgttggccaggctggtcttgaactccagacctcaggtgacccacctgcctcagcctcccaaagtgctgggattacaggcatgatccactgcacctggcctcatttacctgcactcggagggaagtactattacccccattttatagatgaggaaattgaggctcaaagaggttaaggaacttggttaaagttacacaactatggcatcctatgataagcctgggggcatttgtggaacatcttgccaaggagctagaaatggtcctgagccttaaatgggtggaggtgattagctgaggcagcgattctccaggtgtggtcctggacagcagcagcagtgtcaccagggaacttgctagaaattcaatttcttgggctccaccctagaattactgaatcagaagctgtgggtggggccaggtaacctgtttttttttttgagttgcccaggctggagtgcagtggcgtgatcttgcttcactgcaacctccgcctcctgggtgcgattctccacctcagcttcctgagtagctgggactactggtgcctgccaccacgcctggctaattttttttttttttgtactttttagtagagatgggatttcaccatgttggtctggctggtcttgaactcctgacgtcaggtgatccgctggcctcggcctccaaaagtgctgggattataggtgtgagccaccgcgtccagccagaacctgtgttttgataagctctccaggtgattcagatgcatgctaaagtttgagaaccactgagcttagggaaggggaggatattccagagggggacagctgtggagacccggtaggacagtgctgtagactgccccatccctgccttttcacttggtgaaataaagacgtgtgatgcactatgcagactcccacaagggggcactgtgggcacagacgtggaagcggtctgctttgttgtcaagaccgctacccttgtggaagcatgaaaaaagcttgatgccagatcaactggagaggtcactctttcttctcagagaaggtctaatgggggtggtaatcttgtttataggattcggccctcgtagggaagctgaacctggagggctttctgctgttcatatgtgcatggtgatgtctacccatccgtgctgcgaggtctctgcagatcctgtgcaaacagcattcccccttttgtagctgcccagccaggcagcttgcggtttctattgggggaggtgggggccgaaggctgggaaccccagcagcccgattctgcttcagccttctgcctacagtgctatgcctctgtcctattctttgacaagcatgggtccggggccacagtgctgggtccaagacctgttttcaagccttagctctgccccaccacactttaagatctctggcaagacccctttctcctctgggtctcagtttcctacactgtaggatgagagagtggtgctgagaaagtggctgtcaacatctctttccactataaaattctgccctgggagttgaggaagagactgccttgtgcttttcaaggacctcggattgcaggggatctgtaaaccctgctacatgacatccatctccagtagccacttaaggaagcatttccagggatatggtgcaagtcagtaaggtggaatctctcaaacaagattttttaaaaagtccatatcttcagacatccagaatttgcttttataggtttctattctgcactgtttggaagaaggaaaatttataccatgttctcttttctgctgcagtgtgtatttcttccaaaaatacattgcctcggagggtctttggcattcacctcgttaatccagggattggcatcctatactctcggtgactgctcacccagctgagccactgctctgcctgggcaggaaatctccagaactgccttttcagagcgctatagatgtgctcatccctgggttataaggggattcaaaagagtggtccagccctctgctggctcccaccgtcgatgatgatattcagagagtctggttagaaattgcccaacccagccgcgtgcggtggctcacgcctgtaatcacgttgggaggccaagatgggcagatcacaaggtcaggagttcgagaccagcttggtcaatatggtgaaaccccgtctctactaaaaacacaaaaattagccgggcatgggggcatgcacctgtggtcccagctgctcaggaggctgaggcagaagaatcgcttgaacctgggagagggaggttgcagtgagccgcgattgcaccactgcactccagcctgggcgacagagcgagagtccatctcaaaaaaaaaaaaaaaaaaaaaattgcccaacccataggcaaacattgttaactgcagctgtccttggtggaggaaacaagttaaacatgatgtctctttccatcaggcctccttggagcggggaaggagagctcttcagttcctttggcaccttcacgcagcatgcaagacgggctgctttttcttctgtttatggatgaggcacagagggtagatgacttgccccaagtccttcagctcattcatgctggggaaaggagtaagcttcaggcgtcttcccctggagttcacgccacctctgacagcaagtgagccgtttgctactcaagtgctgtttcttgcttttttaaggtaacaaaacactgcatgctgtctggggtaccttttccctgctgttcagttcattgccctgtgtcgtctcacagagcgtgtcactggtacagaaatgttccctgggaagctagagttgaaacatcgcccactggtgctcctgagctggctttgtcatgggtttagagggtatgttagggaggaggccttctgctgcaagtctctgagaagtcagcttacactgccttgaacagtgaggttgcttattagctcctgtaagaaccccctggatgcccaggagccttcagggttggtggacactgcagtttaacagcgtcttcgagggcctagacgttttctctctccactttgctgccaatgctggtgccattctgagggatagttgcccatcacagtggggctgggactgggtgaggcaatgaagcgcttagcatgtgaaatccaaggaggtcttcacccacagtggtgctagtgcaaggtcagcatctccttgaccctaagagcaccttgccctagtactggggcctgtgggaggccacccactctccacaaaggccagaccagaagtcacctgtgttttttctgctcctcttccatcggctgggacttagtctcctgcaacacctaataactgtgaggtgggctgggaaatataggcttgttccagctcaggcagatgtgggagcacagttttgggggacaatgaccagtctttgccacagcaggaagaaaatggttgcttcatagggatcctttcagcagaaacctcccagcaaaagggggaagtttactgggaagctgtgggtgatctaacaaagccaaaaggtaggcggtgctggcagcctccctggatttgggtctggaaaatcatttcagaacaaatcagctcttccttctcccctccttcctccttccccctctttgagtctatgcctctctctctctctctacaggctggcttttctttgttcccctttctgccccatggctgccacaaccaggattttattgctccccattccaaacttccggccagattagttagacctgcatcctccttgccacttcccagggacaagatgctgactggtctgtcagctcatggagcccactcccacttacctggggctgaggagcacctgctgggaaggtttgagggcaggagggctgctgatgtatccaatgcagccaccactcccaccgctgagacatctgtctttctttccttcttgtcactcccagacctcagcaagtggccgctttaaaaagagaataagagctttattgaggtttaattcacagaccatatattcacccttgtaaagtgtgcaattcaatgggtttcaatgtatttgcagagtggtgcaaccaccaccaccacctaatttttaaacattttgatttttatttggtctcactctgtcacccagcctggagtgcagtgatgtgatcatagctcgttgcatcctcgaactcctaggctaaagtaattcttccacttcagcctcccacataactaggactacaggtgcacagcaccaggcccagctactttttttttctttttttttagtttttgtagagacagagtctctacattatgttgcgcctcctggcctcaagctatcctcccaccacacctattcatttttgatcatttttattatgccaaaaagaaacccttagcccggcaggtgtctcatgcttataatccctgcactttgggaggctgaggcgagcagatcacctgaggtcaggcgttcgagaccagcatggccaacctggcaaaaccctgtctctactaaaaataaaaaattagacgggcatggtggtgagcacctgtaatcccagctacttgggaggctaaggcaggagaatcccttgaacctggaaggcagaggttgcagcgagctgagattgcgccactgcactccagcctgggcaacagagtgggtgagactctgtctcaaacaacaacaaaaagaaaccctgtagacattagcagtctctccctatttccctcaacctctgccccagcccctggcaaccacaaatctgttttctgtttttataaatttgtctattctggaaacttcatataaatgaaatcatatagtgtatataggtttttatgaccggattctttcactcagcctaatgtttccgtgctatgtccacaccgtagcatgtatcagtaatttattccttttaattaccaagtaacattcccttgtgtggatttaccacgtcaacatcagttgatggatatttgtgttgtttctgctttttggctattctgaataattttgcagctatgaaaattcatgtgcaagtttttgtgtggatgttttcacttctcttgggtatatacctcggggtggaattgctgggccttatggtgactctctggttaactgttttccacagaggcagcaccattttatgttcccaccagcaatgtacgaaggttctaatttctccacatccttcctgacacttgttattatctgtacttgattttagccatgcaagtaggtatgaagtggtatctcattatggttttgatttgcatttcataataactaatggtgttgagcatcatttcatctgcttattggctgtttatatgtcttctttagaaaaatgcctgtttgaatcctttgcttattttcaaatggggtgatttgtctttttattgtgttgtgttagtttatatatcctggatgcaaatctcttatcagatatatggtttgcaaatattttctcctattctgtggattgtccatttttaaaatttatttatttatttatttattttgagacagggccttgccctgtcgcccaggctggagtacagtggcttgatctcggctcactgcaacctctgcctcccaggttcaagcaattctcgtgtctcagcctcctgagtagctgggattataggcatgcaccaccatgcctggctaatttttgtatttttagtagagacggggtttcaccatgttggccaggctggtctcggactcctggcctcaagtgatccacctgcctaggcctcccaaagtgctgggattacaggtgaccgccaccacccccggcttagttcttggtttttctgtccttggaaactgctgtcagggttcccgagagactttgaatgtaacaataataccttccttttattgagtgcctactattcactgtgttgggcacattgtatatattaccttttgtcctggaaatagttttacaaggtggggattattgtccccatttcatagtgtgatgaggatgctaaaaaaaagcaaatgttgcctctagctgccgccatgggaggtaggcacctggagcgaaggcacggcaggttctgctctgccctatctccctttggaccccttctaggggttatgttggatttggaagccacgaggaggagtctactcagacaagagcatcctgatgggggctgccttgagatgatggggtgtaagccctgtttagctggaaatgaggagagagagacgtacccttggtcaagggctatcatgtgaaagaagggtaacatttgtcctggagtgtggagtgtgaagcatatggggaaatggtttgggctggatagcaggcagtttttaaaacttggagcaagccgggcgcagtggctcatgcctataatcccagcactttgggaggccgaagtgggtggatcacctgaggtcaggagttcgagactgtccttaccaatatggtgaaatcccacctctactaaaatacagaagattagccagatgtggtggagggcgccttgtaatcccagctgcttgggagcctgaggcaggagaatcgcttgaacctgggaggtggaggttacagtgagctgagattgtgccattgcgcttcaggctgggcaacaagagtgaaattccgtctcaaaaaaacaaacaaaaacaacaacaacaacaacaaaaaaaaaaaaagaaaagaaaaaaacctcggagctaatggaaggggcctgccccctgggaagcagcaagcttcctgttgctggtggtacacaagcagagcctggctgctttctaggtgaggtggttgtagaagctctttgggttcagagtcctgggggggttttagggtttccttgaatgcccagagcctgtatgtcatagcttctgatttcacagggacttcctgtccacgcagctgggatctctcccagcccagattcatcatgtctcacccatcctgagggctaaatttggaatttaataacaacactttggatttatgtggcccgtttccttggaggcattacatctgttatcccattaattctcctaatatctttgggtggaaggtgagggaaggtgagggagcctgagaggggagaaggaacctctttggcttcttcagctcctgaaggggagaggaaatggcagagcaggagcgggccggggatgggggaacgtctgcaccacagcccctctggctttcccctctcataaaaagcaggttgctcaccggatgaaggggtgtctcccagcaggaagctcctgtgttgggcacagtatattggtgcataagtctccaggtggactctttgagggctggaagtgggtagacatcaaggtgggcaagatgaagcctgagccctaagcttgggaggagaccaacatgtctaccacgaaccaatttgcagagctggatggtctggaggaagcagtatggcttcctggggaagggggatttgagctgagtttggaaagagtcctggagcaccctggagtccagtttcctacctcctagtcacgtggtgtgggtgaaggccataccttggtgagctttcccagggtatgggggtgcctagggtgctcctcaagatcctaaggcttggcctggagtgctgttgggcgaatggccagagagtctgggcaggcagaggagggctggggactagtgcagggaaggagccgctggcactggccatgaagaaggagtgggaagggaagggaagggtggcccaggtggagggctctgtggggcagaggcagattggtgtgggggttcttgtctactccagactatgctgttttcattcctgcctctgttctgaggcttgaactcctgcaggtacctggcttttacagccctcccaagtgcccttccttcaagctttggctctgactgctgctgatcttccctggtaccaagtgagggaggtgcagaatcccaggccacaggcgcagaacagggcggctggaaggcacctggacaatcctctgagactattctctccttcccgcttttgcagatgagggaattggggcttggagtgcaagcattgggaagaatttcccaggaagagagatgcacagatgtgaagaactcgaaggcaagagaaagccggggggttgtgtggcaggtagaagtgccaggaccgtggagcgtgtggacatgtggcagattgcggaggggctgtggcaagtatttacaggtggccgttacctggaggaagactgaaaacagagaacagtgctgccaggcgtgccttttggagagggcactggtcagaaacggagccttcatgtcgcctgcctcacctgctcctgctggttctccccaccctgtggacggtgacttggtcctccacttgccagaagccttgtcagcaaccttgactctgtcaccccacatccaggccatcaacaagtcttttggccctttctttgaaatccaccaggaatccagctgcttctccccaccttcctgcctctctggtctgggccactaatgtcactgccatggccgccttgctgcatttctgaggatgcttcatctctccaccttcttctccactcagcagccagcagggcactgtggaaatcggagtcacatgagctggcacctctgttcagaaccctccagggctccacatctctctcacccaaatgccaaagacctccccacgcccccacaatcccccacgacctggccactggcctcccaccaccttccagctccagcggctcctaccacatttaaggctttccttcctagttttaatttttcctcgtcagcagttgattttattattttcttgtttattggtattttcccactagaaatgaagctgcgtgaagttagagatttttttttttggtctgtgttcctaattagctcattgctatacccctggcgcccagaacaatgccttggacacagtacgcagtagactaaataaatacttgttgaatgactgactgacggaatgacggctgtgtggggagtggattgggtcgtgaggcagaggctgcggtggaaactcaggcaggaggtgatggtggttcttggggctgcggaatgccaagtttagaagctcttcctctgctgtggcacatgaaccggtcactcgagaaggcttttagatttactttgcctaatcccctcttagtgcatgtggggaaactgaggtacacaaaaggaattccccaccaagttaggggcagaacctagcccccttgtctcccagatggatatcttcttttttttttgagacggagtcttgctctgttgcccaggctggagtgcagtggtaccatcttggctcactgcaacctctgcttcccaggttcaagcgattctcctgcctcagcctcctgagtgtctgcgattacaggtgcacacaaccacgcctggctaatttttgtatttttagtagagacggggtttcaccgtgttggtcagggtgacctcaaactcctgacctcatgatccacccagctcagcctcccaacgtgctgggattacaggcatgagccaccgtgcctggctggacatcttgttattaaagcttcttctctctttgtaggggagggggagatgcctctggtggagaagaccagtgtggcagtgactgtgtctgttagtgaacctggtggctggttgagggtctgtcgtggtgactgaggacacatacaaagtgcttttctcagtggtcaccttggtgttggtgaataagggtcagaagatggctcctgtcctagggcactgccagtcggtttggaagctgaaatgcctgcttagcagtttgaggaaacacagaccttggaggatcttctggttgcctcttcaagaattcattctattccccttctgctccccaaatttgcttttcttggggtgggtcttggttggcctaagccaagaaagtatggcatctactccttccatagcaatagctcaggaataggcagtgacccagacctgaaccaatcagtgcatggaattacccctggccaaagtggttgattgaggctgggtgcaagcagagttgtgagaaggctcccatttggtggttggagagatcgcacttgctccagaggtcataatgtgcagatctgaggcttggaactgctgcagacattttgctaccacaagtgaagccaccctgacgacacagttgacaatttggagcagggcagagctgagagaacagcagggaaacagccagagtcttgctcaagcctccctgaagtatctatacccctggactctagttatgggggctaataaatgttatatactgtttaaggta

SEQ ID NO: 919 - DNA, 6957 bp, Homo sapiens
caggcatcggcgcggtcagcctcgtggcgcgcccacgcccccacgccggctcttcccggggtccttccgtgcgcgttgatatgattggccggcgaatcgtggttctcttttcctccttggctgtctgaagatagatcgccatcatggtgagtctccctgggcccgtgcagtcatctgccgcgtatccgagccatccgtggtccctgggtcccagtacttgagctataggcacgcgaagcccggttgctcttctctggccgtttctgtcagaggatggttgtcgaggggctcggggctgttggcagggcgtccgggctggcgggctgcgctgtagacccggacacgctgggcttcgggctccagcgcctgggcagtgcaggagctgttgcgcttgttgacttcgtggagcacggtggatgggggtagggggcgggcgggatagatggacactgggaggcacatctcgtctgcagttcctcattgggctaggtaggcggcttgcaggtgatggcagtacaagaggtgaagaaggtgcgggcagcgcctgggcgagttgcggcaagtgaaaccattcccacgtgtaagctagaaaacttgtcagctggatggatcttcatgtttcatagtggggaaacaggccctggaaagagatgttataaaaaggtagtcctgccctaagtcatgcgttattagctcctccagcatccgtttttaactttaccagcaatcttttttttttctccttacctttgatccgttactttcaagaattgagtaccactgacgtggatttaatttggtgtggtttctcaaagtaaaatggagaaagtctaggaagttatttgctgccatgaaagtctcttgcgcctcctttttggtaaaattgttagcataaattgcttaatgcccacattttttgttaggtattaagtaaaggtgcagttcagtccttcagaagggaatatcgttttctctgatctctgctatggccattctagaaggatagattacatgtaggtagtgagtacaaggtttggggcacatttgtgcaagacatgataaacacagttcattgagtgacctttatatgagccacagcagtttttaccccagagaagtgattctcaacccggagtgatttttctcctaagggaacagttggctaagtctggagacatttttgattgtcacaactgggaaaggtgggaagtgcttccggcatctagtggttagagggctgggatttttatagttattctaaaacatacagtccccacaacatatccatatggaattatccatatggaaatatcagtagtgctgaggttgagaaaccctgccccagagatacacataacctagtgaagtaagttgtacagattcatgtgtaaaaccattgtgttttcctggtattttatgtattccttaggtgtatcctgtgagtttggccttgcccagtgggttttatttactttagttcgctacatgactaatggctacaaattggactgcaacattctaggtcttggaaaatcacagcaaggccaagaaaagttggagtagttttattaaccagagtgtttatgttttcagaacgacaccgtaactatccgcactagaaagttcatgaccaaccgactacttcagaggaaacaaatggtaaggaagggcacatcaatctttgcttaattgtcctttactctaaagatgtattttatcatactgaatgctaaacttgatatctccttttaggtcattgatgtccttcaccccgggaaggcgacagtgcctaagacagaaattcgggaaaaactagccaaaatgtacaagaccacaccggatgtcatctttgtatttggattcagaactcattttggtggtggcaagacaactggctttggcatgatttatgattccctggattatgcaaagaaaaatgaacccaaacatagacttgcaagagtaggtgtcttttcatttgttgatcagctcctgaagacctattttttcaatagcgttgtgttgtgagtgtggtaaaaagggcaagaccaagcaatctgggatacaactctgaaaggattaagagaaaaagttatttcataaaatgcacaggtggagtacgggggttcaaaattgaagtctgacatttgagctgagttcagaagggcagctgaagtagtgttcttggagatgggctaggggtaaggattgttttccagaggagaagtaaggggatgtgtttggaaaggtagcctggcaccaaattcacttagtttggattaagtctgcatctgggcttaaacccataggtagtcaggaaccaggaaaagtttttgattgtatactgagtgtcaaacactgcagagtgaactacagcagtgatctgggcaagctccccagcttacattctagtaaacaagtaagcatcatcacctcgaagtgcttgttttgtttgttcctttaactcactttatcctatcctgttagataaaccttcccatacgatagctgtgagggaaaatcctggtgatgtcataggtagaggctgcacttttttttttagagagagagtttagctctgtcgcccaggctggagtgcagtggtacaatctccttggctcactgcaacctccgcctgccaggttcacgcaactcttctgcctgagcttcctgagtagctgggattacaggtgcgcaccatcatgcctgggtaatttttgtatttttagtagagactgggtttcaccatgttggtcagcctggtcttgaactcctgacctcgtaatccgcccacctcggcctcccaaaatgttgggattacaggtgtgagccaccgtgcccagctgaggctgcactatttttaactgacgttcggtcatgttaaaggccttgctgaggtggtgacattgaagctgagatccttgtaaagatttggaagtagtctttgtaaagatacagaaacagtcttgtaggccccaggaacagcaagtgcaaaggtgggcagagtggagatgagtagatccggaatctccatgatgtgggggttgtaaatgcttgtctgtcataagggagtaatggggagttgaaatgggaagagatcccctcagccacttcggaggtgccttgttttggtagtgcaaaagaagaaaaaatagtgatctgtgagctcaagtctggacaagaacagccagtctcccaaactccctgttgagagaatgttgagtggaccatttgtttcctgtgaggctattccatacctaaaatcccttgatgatcctttctgttccagcaaaaacatgcattaaatgtacttgaaaagttttggtttagaaagctgtgtttcttaagctcagactgggtcagtttccctaccagagtggtgggtaatgattttaatgtttacaagtcacctggatgtactcttttctcattcagcatggcctgtatgagaagaaaaagacctcaagaaagcaacgaaaggaacgcaagaacagaatgaagaaagtcagggggactgcaaaggccaatgttggtgctggcaaaaaggtatagttcattaaggaaaatatagaaacgtcattaattgtaggtctttagtttctaggaaagaagggatcttattaatttttaaaataacttttcttaatgtttcttcttttccctcttcttctggattacagaaggtaacatgttttaagaaactatgtagcatagtgtcttaacacctcagtaaagtagcttggcccaccccttgtcagctcacagcacaatctggaggccacattggttcattgatcccagctggtgggcacctttcaagcctatcacaagaagttttaattttactaattggcatagaaccttcaatgcagagcggatcccattccctgtgattttacttattaatatggacactggtttaagaagcagttggatcaatgtggcccgtgttttcctggcacactggaaaggcaactgagatctcaggattgctttcctctccagttggccaagacaagtgattttagcgataagcagctttttaccagctttgctagctgtaaatagttggacattgtaaatcattgaatagaattaaggtgttgggttgttaaattaacaaataatcaagtgttctgtgaactttttttttttttttttttttttgcttttcctctctactttcttggatttcttgttcatcagaaatgaagtgtctagcaggtactgagattgtaagcacggtgtggggatgcatcaccttcactgagtttgctttgatgatgctttgcatgttggcctttggacgacagttttatagtatggtcgattataatgccagtgctatttaggctggtgcaaaagtaattgcagtggcaaaaaccacaattacttttgcaccaacctaatatgttttaagatagtatattatgagcaaaggagaaaacgtttaaaatcatgtttattttgtaaactccaaaatgcatgttacatgtgaagtgactcactggaggaaggtgagtactttaccaagtaggcacttgggaaatgctgtgtccacatacttaggaaatggcttcagttaacactgggcttgggaagggctctcttatccaaggagcagtcttctctggagccatgaaaccagcctggcagcactggtaataaactagtctgtgaaatctggcaaagcctctgtcctgtttggatatacgcaaaactgccttttaccatttccattgctttttattacttaatctcccaactttgtgcctggtgtctttttttttttttttaaaatagaaaatttttgaggtaattatgtattcatataaaagtctttggtggatatgctttttcccacaagcacttggttagaatggcccattacctcatttgtttattttttgagacagggtctcttgtcacccaggctggagtacagtggcatgatcatgggttactgtacctcccgggcttgggtgattctcccacctcagcctcccttgtagctgcgactacaggcatgtgccaccgtgccctgccaattttttgtagagacaggatttagccgtgttgctcaggctgctcttgaactcccggacttgagcagtctgcttgtctaagccttccaaagtgctgggattacaggtgtgagccactgtgcccagcctgttacctcatttaaaacaaattttgcacatctgaacagcctaaaattgtaatgtgataagtggggtaggagtggggtgggcgtagtgggattttgaatcaatgaaggcccttgttcttgtggcatccttttgcagtgattccctgccaggcaaggcagtaaacctgggattgcctgcccaggactgtaatcacattgatgtcccagcgccatggagtatgtaatgaatgaactgccagcagaactactcactaagaactactccctgtttgtgaggattgtacctgttgagagaagttgcaaaaagaattagtcaaaagaattagtcaaaatttgtcctctgacctaggtctgaaggacatttaacacattgattgttctcttcatccagcctttgagccctatgagttagtgcccttagcctttgagtcccacaggtatggaggagctacctgtggggacctgagccatcactattcctgcttcaagttacactggtgcctctcactagcactgctctgaaaagccagctggaaaaatcaatgcatttgagtacataaattctttggctccaaagaaatgccatagcaatattgcttttaattcagttttgtttagatgttagaattggtatttgttcttgctttttggttgcgatggagttatatactaagttacttatactaaggcattagtagtctcatatctgaggagcaattgtatttttagttcagctaaattaatgcctctttttaaatactaacttgtactacttttgtggctgtgaatggtatcttttattgaactgaggcagcttttaaaagacttgcctgatcatttagagcactcccattgaggttaaattagacttgaatctgtaatgattctcgtaactgttcctggtgtgtgtccagcacaatgttgctgggcagagcagaggggcagaggctcaggtatgtacttcattgacaagtgggcaaggccatcctgggtaccacattggcttaatgatctcttcattgtgaagtccggctacctcgtttgcataagaactacagtaatcaggcaaggcattgtcagaattgggaggaataaaatcagtgagtctggaaggagtgctctgtatacaattgcaaagaacaaaatggtcatctttaaggtacctgattgcatgcacttaaatgcagattattttggagtttgaaaagggactattaatgaaatctttcttttccctcctttctctttttcccttccccgccactgattcagtgagctggagattggatcacaggtataattcaagcttttcatgtagtcatgtagatcactagactccttggtgtactgacgtagcaatttaaaagcagatcatgtgtagtacatctagaagtagatttacaaatattctgaagagttgtaaccttttaaaatactaacagtgacatggttttgtttttaaggtttagcaatatttagcccattatttttgttttattcttaacttgaatgtttgtaaattttatttcttgatgctttcattgtgttatgataacatcaaaataacttgatattctaggttactaataattgttgtgcatgagtgttactacttttggaattgaagactttaaagaattttaaaggcagttgttgactaaacttctttctcttgattcacagccgaaggagtaaaggtgctgcaatgatgttagctgtggccactgtggatttttcgcaagaacattaataaactaaaaacttcatgtgtctggttgtttgaa

SEQ ID NO: 920 - DNA, 6957 bp, Homo sapiens; identical to SEQ ID NO: 919

SEQ ID NO: 921 - DNA, 6957 bp, Homo sapiens; identical to SEQ ID NO: 919

SEQ ID NO: 922 - DNA, 6957 bp, Homo sapiens; identical to SEQ ID NO: 919

SEQ ID NO: 923 - DNA, 6957 bp, Homo sapiens; identical to SEQ ID NO: 919

SEQ ID NO: 924 - DNA, 10780 bp, Homo sapiens
tttcatctcatccttctaatcaatggaatccactgtgcccttttttctgaggaactccttctggagacaaactggccaaagtgaggagcagctcccggctacccctgtgagttttcagtggacgtgctataccccaggaacagcaaatcaccggcattcaggccaccacatcccatcggagccagtggcagacattgctaatcaaccacagcacagtggccttagacgctcaatgcggtgctctgggtagccatcaccaatcaatcgagatggaaccgattgccacccctggcatggtgggtgtccacgctggcatgcccagatgagtcctgaccttcggcccctggcagagccctgctgactaagcctcgggcccattagccagggcctgggtgagggcgtgagggccggcactgaggatgtgatgacggcctgagcccttggagctcctgtgcatgctgaccacgtcaccgctgctgggctcacgctctccgtgctggccgaagaggcctcggacggtggcctggaagccactggtgacgaagcagtagacgatggggtccatgcagctgttgaggctgctgagggtcacggccacgtggtagaccacgaggctcgtgtggtgtggcatgtcgggccacagcgccacggccacttggcgggcgtggaagggcgtgaagcagacgagaaagatgatgagcaccgtgagcaggagctgcatggcccgcacgcggcgctggcgaccctggtggagcagacccggccgcgacagtgcacacatgatgcggccggtaaacacgctgatgaccagcaggggcagcaggaactccaggacagtcagcgcaaagacacggcagcagggccggctgcctgtcacgcccagcaccgacagggtgacggcaccggcggccagccacacgaaggcgcacacggccctggcacaggcaggctggcggcagcggcgggagccttcgggccgcacgatggccaggtagcggtccacgcagatgcaggtgaggaagaggatggagcagtgcatgttgaggaagtaaccgaggacgtgcgggaaggcacagcgcaggcagcccctggcgccgtagtacacagcgaagcgcgtgggcagggacagccctaccagtagatcggtcaccaccaggttgatggtgtagatgactgagggtgtcttggcccgggtgcggcagcagaagacgtacagcgccagcccgttgagcaccagccctgccaggaagatggctccgtgcaccgccatcagcgccagccacaggcctgggaaggtgccatgcagctcctcgtccagccgggcaaacaggtggaacaggggcacctccagcccgctggcattggtccgcactgttgtcactgcggtggcattggggactgccccggccgagggccccgctggagacacagagggcatgacggcagccagcacaccccaggcctggaagcaaggagaccaggtcaccccaggcgccagcctggccttaagccctgccctgaggcccagaactcagctggcccgtctgcccctgcacgcccagcatcccccttctccatgccctcgcctggctggggcctcaaatgcctgctcccttggctctacccagagggagcctcggacagcagcagaaaaggcacaggctttcagagtcagacgcgtgttcaaattccaggactggcacttgccagcgtggagactcgacaaaatacggaggtttctgcgaccgtcctggcacgagggggaggcggaaacacgtgcggtgcagggctgtcctcgggatggagagctgataagggcaagaccacggggctccagtgtgcagttccagggcctggctccagccccagctgtgccactgactagtgtgcttgctcgggtaggccacttaacctctctacctgcttcctaatccatgtcactgggatcgcgttgctgctggggtgactaagcaagcgggtcagcacggcagcgccagcagagttggtggctgatgacccagttctgctgggacagagccttgttcatggtggggacctctgactgccctgcccactcccctgtccccacacccaccgtcatggcccccatcctccgggaccacccatctgttctcccctcctcctaggccagcatcaggtcaatgccctggatgggggtcctcatgagggacctttacaaagggaattaggctgtccagtggggctgcatgggagccaaggaccagtctcactgggcaccccaggctcctactggccctgagaggcgggcacccctatgatccccccaaactacagaaaaggagacagaggcccctgtggggtggctggttggggctgaagcctggagccagagtgtgagtcaaataaacaccgagctcccgtctggcctgggcaggggggccagggtggggggcgggcgaggggctgtgccggagccacccactctgtttatgttcctgccctggcgtgtttaactcggcagtgatttatccctctatttataaatgaagggttaacggccctacccccaccctacagctgggctgaccctccaaataagggcatttctggctttttcaggagaaaggagaagtctttggggccagcagggtggggaggctcgtgggccgtttcttctgcacagcgcccctcccccacctgctggagaagggaggacacttaccccttcccctcctggtggcccctgctgtaaacaggctgtgccccgccactccctctgaccagtgcgtggccccatcccacccctggggaacaatgagccctgccttcaaacagcccctggcctggctcagggcagcaaaagaactcttgctttcagagggccaggtccctccagtcggcggccaccttcttcctcagagtcagagaggtcagtgcctgcatgaggtcacccagcatgccctctgcctctgggaccccagccctgggtgcgtgctaccctggaggctgctgggaggagtcaagtgctgcccaggcctgtgcccagcccctcctgccacccccaccacacaagggcccaggctcagctcccagctccccccgactgcaagcaagctctctatctccaggccctgacacgcgggcattgatgggtgcatttgttggatgaataggtctgtcctccctcagcccaggtgtgccaccagagacgggatttgggggcacagcaggcagccaggggaggagaggaggctgggcacatgggggctgggaacctggcgtctcagggctgtgggcttcaggagccccagaaggtccccccgaaagagatgcgtccctcccctgctgtggatgaaacgctctcagaaaaggtcgaggcggctttgcagctggactgagggactgcatggccaaaaaagtattttgggattcctttctatgtgccttttgcttttccaatttgtctgcacggggcctatattagtgtcccaatcagagacaaatcataaacaacacagaacgtttcctgtgggagtgagtcccagggtgatgctggcccctgggaattctgctgtcccagaaaactccccagggccagcccagcaggctcaccagcaacgctgcggtgctggggtcctggctagggatgtgggggctctgcggtctctggagctggggggatgggcagaatgtgctggacaccccagaggccagaccggagaggagagggagctagcaaagcatgctctgattccccgcactaagggtctgaccctgatctcaaacaaagctgaaccctcatcttggtcacacactgagccatgatcccagtaatgtgatgaacctcgatccctgtcccactctgagccctgaccctggtcacacactgaccccaatcctaatagcacaatgggcgttgattcctgtggcgctctgagccctgatcccagccacgacctgggccctcagcccggaccttctgtccctgtctctgccctcctctcccagcttcgtctggctgtctctgtctccatattgtcaacccccacctgcctcccacagcgacggatgtcccgattcgattattacggggcctctctggggctcccactcaccaccctctttgttcagaaggaggaggaatgcaagcggggactctagaccctgcaggggcccatggaagtggctccctggcgagtgcctggggaaaggagaaggttccgcccctcctgggacagcctggctctgcctgtgggagaggcacagactctgctctccggagggcccgggtgatgagcagtcaccagcacagagacccgggtttgagtccagccctgccactccctcagctgagacctgggcctggtcagtaggctggccgtcctcatctgctgaatggggtcactcgtgccttccacagctctgcctcgccctggtagcctggactgaggggagaggcatggttttaccctcagagccggccggagaggggaggcagggccctgtccccaagcctagtttccctaagccaaacctgggtgtgggggagatggtcctgtctcctccctctttcctggcaggcaccctgggtctgtctgagacagcagactccatggcgggggccaactggccagagtctcatgggcagggactggcaccgtgtcctgatcgtgctgacatggtgttggggctcagggcctggaggctgtgccagggctgggaggtttctcttttccactggcccaggccagctctgctccccacccacacacaggtacttccttggggacagaacagagggaacgagggcctgctctccagggctgagagtcagtgagtggagacccagcagggtagggacctggagtgtggccatggagccctggctctggcctggatggccctgccaaagcctggctccatctctgaacggactatgtggccttacagtctctgagcctcagtttcctcatctgtagagtgggcaaaatagaatctcccctgggggttcttgtcctgatgtgccagcccagagtaggggctcagacacaggaagtgatgaaagtatgggacaagctgccagcgggggacccagagggcgagggggcgagctctgctccaacctgggtgtgcagcctagaccaggtccagctcccacactactcactgcccccgccagcctggagggagggctctgacctgggtgggtcctctctgagcctcagtgtctcctcctgtgaagtgggaatggccggacacgctgccctgcatggctgtcttgggccttggctgaacagagcacctgctgcaggtgtggcggggcaggggcaggtgtgctgcggcatctctttcttttctgtttctggcccacccttccgggtgggcagacccccagagcccccacccctccaggtgggcacacctcccagagccccggcctttcaaggcttcgctgagctcctccaggggagggggcagagggtgaaggaggatgtccctcatgccctccccgtaggtatcacatcacaaaacagccgtcctaggcggggctgccgctgggttgggggttctccctgggaggggcctgaggcctggactgctgggcagggctggggatgtgcctctccagtcactgcacctgactgatgcttctgcaggcgaaactactagcggggcctaaacactccatgcgccctccaggcccaaccccaagctgttcctgctctctccctttcggcttattcatgcccatttttaggacttccccctggacttgcctccttaaggaagccttcttcctccctgggctgcctctctctggtgcatcctcccagggcaccctgcgcttcctcaatcccagggttcatcccacggcgctgctatgtgctgcaggcttccctgttggactctgagcatcttgaggcggggctgtgggtgggggctgagctcccatctgttccaccagcccagcacccagattggcctggcagagagcagcacccgtcttcccccttgtctgaatgaacgccctgagcaagcctcatcagggctggcaaggtgtggcctggtttctcaacctggcattcagggtgaatgccacctggcctggccccctctgaaacctgcctacccagtgtcttggtactggtctggaattggcttccacccccagccccatcgtcactacccatgagtcctcccagccgagcaaggctgacacctcctcccggaagcccgtcctaatcactctgaccattgtgtccacacttacattccttcccaccctctatctcccatcaccactctttctttctttcttttttttttttgagacggagtgctgtggcgaaatgtcggctcactgcaacctccacttcctgggttcaagtgagtctcatgcctcagcctctggagtagctgggattacaggtgcccgtgccacacctgggtaatttttgtatttttggtacagatggggtttcaccatgttggccaaggtagtctcaaactcctggcctcaagtggtttgcccaccttggcctcccaaactactgggattacaggcgtgagctactgcgcccggccccatcaccactcttgatagcaatggtctttggtttgcaggccagctctaccacccgccaccttcgaggcctcgggcaaatcatttcatcactgggagcctcagttccctcacctgggactttgggaaccatatttgttgaatgaatgaatgaaatcaggcagggtggctggactaagtgagaaatactgcagacacccccaacatgggaggcgtgcgatataagagcacgggaggctcctggttttggcacctggatggggccctgtgtggaccagcccgctcacacgtggggagaggccagggccaacacgtgtgctcagtgcaggacttctcagagcctttgtgaaactcacggtcctgggaacttccaaggggtgggagcgagcatcgagcatggaagctatttgaccctgtcccctccctgggggttcctgctccatccatcccaatggccacaccactagtccatgcccagagcactgatgggggctgctgcctccctgccctcacccacagcttgttgaatttctgctgggcacccggccatggaaggccagacccctgggcttggggtgctggcacctgcccagaggcctccagcggggcaccagggtcatgccggcctccgtccttggccggtgggtggggagggctatgtcctctcttccctgggctcctctcaaacccaccccaccaacctgggagttctctcttggctgcccagcagcctgtctgcctctgtcctgccacatgtgagaccaggcagcagagtggccccggccccagggcagcagatggcccagggtggctgttgagcctgcctgggggtctggctcaggaccctgtgtgctgtctgtggacgtgtggaggacgggcccagccttttccccacagaggggctctgagcacctgctaagggcgctttgcatccacacagcaatcccaggttttacagatgaggaaccggaggcccagaggggtgagtggtgtcctcacggttacccagcatggagctggtggggctgggaatcagacccaggtccactggcaggacccggcacaggccggagtggagcagagtgcgggctggggagcagaggggctggattaggcatctctggaccgggagtttgtgcacaaggggattctccgggccctgaggccgcatgtgtgaccacgggtctgtgtgtgcttgagcctgcaccccagacggcgtggccctcatggccttccagggctaaaatagccatgattcggggaactgtctgcctgtttatttttatgattattcttggtttcacagcatctgcttttgaatatcatctgctgtttttgataagtctgagcctccgtttcttccaccaagaggcaggtgggtgcttgctgagctctccaaatggggtcagactcaccccaggtcacctagcaagtcccaggtgaccctggccagaagccaagtctttctccctgtcccccacgcccacaggccagggctccctccaccccagtgcagagagagacgtcactggtgggcacagactgagctctgtggggaaggacacctgggccccatctgacccgactctgcctcagttccaccagctaagagccctcttgctgagactgcggctctaacggaaacaccagtgtctctgggaggggcatagccagttggaggtcctgcatgtcacctgccagcccctccctgcctccccatcattgggttcattgctcacctctagctgggtgtctctgggaggggcatggccagttggaggtcctgcgtgtcacccaccagcccctcctttcctccccatcaccgagttcattgctcacctctagctgggatagccgtagctgcagcagctcctgaaacccctccccaacctcagcctctccaggagctgctgggacaggcattctgtcatgtgcacctgcctggcctcagcctggtccttccgcctgaagctcctcagcctggtcctctcagcctcttccctctgcatgtgctgttccttctgcccggaatgctgtttctctccctgtgccacctggtgaaggctccgggcacccacagtcattgttccacagagctctccctgagcccctctgatgccctagtgccctggatgcccctgccccagggggagagctatgatcccacaatctgaagggcacccgctgggctcatccttcccagggtcttattgacttccctcaagatgcccctgggtgggtgtttctggccccactgtgcctgtggggaaccaatacagaggggctaagtcatgtgtccgggctcacccagctggggtgcaggaggggctgagctctgcctcaatctgcctgctggcactttgtcccagtgcctgggatcagccttctgcggcacccagccctgtgtgtggagggaatcagaggccccaggccacacagccccgtgcagtttggaggtgtcagaccaggacttagaccccagcactgcgggcacaaatgggtcccaggcagacctggccccacctttccgagctgacagctcagggtagggtgggaggtggctggtcacggccgggatgggcctcaggacaatcagagggaagagcgctcccggcagcaggaagggcacagtgagcatgaagggccagaggtgggaaggagagtctgtgttcagggctctgtgagacaccgggggcgtggggagggctttgggacgtatggtgaggggatcaacttaaggttctttgggccctgacgcccctcctcagggaggccctccagagcccacagccccgcacgcctgcaccgcctggcttccttcgcagtgccctgccacgcgcagttccctatgtccctgctttcctgttcgctgtgcttccctcactgaactggagtgcctcaggggccctggccttggctggcccctctgagtcactgagtcactgctgagtgatggagtggatgattttagaatacccctctgatctccttgagcctcagtttcctcatctataaagaggagatgctaataccacttaacaagaagacaatgaagccaccccgtgggctccaggagctgctcagaaatggtccaaactgcatggcccccacgcccggctctccagccgcagaccccgcctttgctgatgggcccacaccgtgtggctcagagaggggcagcgacttgccacggccactcagcagaccgccctggagcccagcgactggatgagtcctggggggagaggggagggaagacccaggatgaccagctgttgaaggaagaagacagggcaagtggacaggcccagcctcctgcggggtgcattccccgtcctgcgaggtcgccagctgctccacgtctgccccgccagcaccctggctgctggccagttcccagcccgctgccccctcgggaccctgtcctgccgccttctcacagcgcagtcccagtgcgagcttcgcggggctggagccagcttctaggtccacactgagggctggcaagcaagccttccctgggactcagtttccccacccctaaggggtagagacagcaccaaggctactgcagagggcctgagctgtgggatggcaggacgggcactctgaagagggagcatggcgcttggagcccatgcccacaaagccctcaccatggccctgccccagctgcggggtggtggtggctgaggccccagagcctgccaagtgcctctggggtcccccaactctgtccctggcttggcctgtgggccaccctgctgccttgccaggtggggaaaccaagacccagctctgggcacccagcagatgctcggtgagtgttgaacggagggatgaatgagtgaatgaatgaaatccagagttgggtgggcacctagcagcgcagctcccccttatgcagccagcccaactcacgcccatgttctccctcaggtctctgttttctcatctgagaaatggctccctgtccagcaggacctgctctgagctctccccagcccggatctggaggcagtttctctgccctgcccttcccactcctgcttggctgggggtgagaacccctgcagggagcagctcaggagcctcctatctagggaagctggggagagggaggctggggccagcccacaggggaacttaccgcgcttcacccgggcaggctggagatgggagtcctcagctctcagctctgcatgcagcccggac

SEQ ID NO: 925 - DNA, 4074 bp, Homo sapiens
cgaggtttcatcatgcagatgaagcctccaggcagcagactgcagagagaatggatgggagatgtttattatcagactgaaagactgttctgccagtcattccaaaagggaggggggataacaaggtatgtccgtctcccgcttcccaccgtggcctgaactcgcttttcaggttcactttggaatgtccttagccaagacgagggtccgttcgtttggctgggggtcttaggattgattttctggtttccatatgcaatgggagtgggggagagatggggtgggggcagcctgaggctcagccctggccaaggaagccccctccaggcattggccaggttctgactcctacagtgttacagccggcagggaacttggacccacaagctcctcccctccccaagcctcagtttccttgtttgtaagatgatgcctggggtccttgcttccttgtagggctcaaacaagatcccaggctctattaggaacagtgccaaggcagggggcccccaacagctcaagcaggctggagtttggtgctcacggagtaggggaagctggtggcttctcaggctcatgacattgtccctgcagggtgcagggctattccctggtggggctgggggtgtgtgtggccattggcaggagccccgatgttctcatccatgagtcagcagagatgggaacatcaatttatttgagtggctggtgcagccgagtccttggaggacaaggagtttttgccaagcctgggccgaatgtgccagggcttggggcagggaaactgtgtccagggacacagcttcaagggcccctggttgatgtccccagggcctgctgagtgccaggccctgggactcagagaggacaccacccgatgcaggccctgggactcagagaggacaccaccggatggagctgcccaaagggagtgccagtcggatgtgggggtgggggaagaggagggaccaggatgtgacgggtccgaggtctcacggggtgcccaggtgggctggatttacagagcatgggcggcctgcaggaccatgaaggggcaatgggggcagaagacagaggttggaggcagggtggcatggagggtctcggggcaggggcaggagggtctccagggtggtcagtctgctgcagtcagcagagggcactggaggggcctgggctcaggctccaggtagagctgacctagcccagaatgggcaggtgagggaaggccaccgcctggtgggcttggctgtcccctcacctggaccccatcgccggcctcttccttgcacggggtagatgctcattgatgtggtgacgtctagcaggaggatggccctgggcagggctgtgagctgggagacctgggctgggatctcagctttgggcccacacactgggatggaggagtgtttactgctgtctctgaatggctgcaggaaggctgagggggcacatggttgatgggccaggccactctgggcacagttgctgagagtcggctcttcctaagtgggggcacccggggtggtggaagggagtcagatgccaattcccaatgggtcctggtggtcgtgccctgctgcagggccttggcacccgccgccatagccatggagtccaggggggcccccaggggctggaaaggcagggaaacagattctccttgggagcctccaaggaagccagccctggctagcacgtctgtgctctgtctctggctttgcctgttctggacatctctggaggtgtgagcaccatgtggcctttcgtgtctggcttctttcacttagcacggtggcttcaggtccctccgcattatcgcatgtgccagtgctttgctcctttttacacctgagtaatcgtccactgtggagtcatcctttcagctgctgagagatgcgtgggcagtttccacctgcagccatcgtgagtagtcgggtgaggctgctgaagcagacgagtgagggcactgcccgggccatttgggctggagcgggggtttgaactcctctttgtgggacggaggctgtgttcttgcccacacctctccctgctccaggcctgtcttccccttgggactgggactatgacttggtggcttcagcctccgcagggtgagcctgatcctgagagtcaggctgggctgaggaggacgggtgggcctcctgggggaggtgacgacttcggactggaccttgcaggagggatgggctgtctgaggatgggagatgggaggaggtattgcaggttgggcagcaggtgaggctgagctgggaagggaggtggttgaggctggttcttgggctgagtgctggggaggggtcggccggggatcaccgagaggtccctccaggctgcatgagcagaggagacaccctacgggtgatcttcttgcctttgtttctagaattcacaaatcctacaattctaagctctcagaacccttggatctgaaggttctcaaatgctaaggtttctagatgttagcagacgaaggtgtcaagacgcatgggatctacgatgcagagttctgagtggggatatgcgtcccccaccccgactcaccccacgacacatatcagtaacagcctctgcaactccgccttggtgcccccgcacgttccaggggcagccacactgatggattgctcagaacgggctggaggtgagatgtgtttgcccggagcccccacacactgtcgtctccagctgtgcctgtccctccccaccttccactctgtgtctcttccctgccccccttgtgccccagccccagccccccctgttctttcctgccacccaatcctgtgccccacgacaaggaggctgagcccagggatggccaggaaggaacccccggcaggctctcagggtgggagagaggttgtggggatcaggggctttgcagaagggacagggaggcagcccagagcaccccagcttcttggccagcagcaggtaacctggctggagggcggggcccccatgggccatccctgggccagctgcccagggctaccaggaaggcagcttgttttgtaggaggtcaggcagcgccctaaccccacctcttgtcttccctgatgtcacaccccagggtcagccccttgggccagaatgggggtgatggtgggaaccgggaagctgagagaacagggaggaggccgggtggggcacaccaggctgtggctgtggggatggggagattcctcgcctgggcaggccgggcagcagcggggcagtcctggggggtgtggtaaatgcttctgctctcttcccctgactacatgggagcctccgtcccacctcacctggaaaaggggcttggaactgggctgctcggccttgggcacaccaaacggggcccttggagccctgggcttcctggggtggctgggtccccaccctgcctctgatccatcctgagtctgcatttcttctccaggtgccccctgcccttggcctcccaccacggcctgggagtagatagtgggctggggcaggcccagcgctgtcctctgtgggaaaggaggactctgggcctggaaatagttgagtgtggacagaaataaccctgactggcctcaaaacagaacatggaaaattaaatagggaacattagcattcaccccgcgcttgccacagccactgtcccatttgggaggcgggcgcgcttatcctcatttagagacagggaaactgcggcccagagaggggaggtgaccttcctgaggttcctctgccagccggccaggccctgtgacccctgtgcctctgtgcttccactacacagccgcatctccacttctgccccgacagttcctgctgcagcagatgcccttccagatgcaaactcctacgcatccttcaaaacccagctaaatgtcacttcctccggaaagccttccccacctctctagcaggcagttgagcccagcttacatttccgacaggccctcactgcccgggattgcagctgcgggctccttgagggcagggattgtccctcattcatcctgattccatgccaaggcttatagtaggtgctcaataaatgcttgctgaatgata

SEQ ID NO: 926 - DNA, 9615 bp, Homo sapiens
atgactatccagctctgagagacgggagtttggagttgcccgctttactttggttgggttggggggggcggcgggctgttttgttccttttcttttttaagagttgggttttcttttttaattatccaaacagtgggcagcttcctcccccacacccaagtatttgcacaatatttgtgcggggtatgggggtgggtttttaaatctcgtttctcttggacaagcacagggatctcgttctcctcattttttgggggtgtgtggggacttctcaggtcgtgtccccagccttctctgcagtcccttctgccctgccgggcccgtcgggaggcgccatggctcggatgaaccgcccggccccggtggaggtgagctacaaacacatgcgcttcctcatcacccacaaccccaccaacgccacgctcagcaccttcattgaggtgagtggagacggaggtgtggcaggcaggtggcccaggtgtctgggaagcccggctgagctgccctcaggcctcgcaagaggggtccccagccccggctggccagacagggctcacagccttggaacaaagcccagtcgcctgttacaggatcctggaggagggagatgggggtgccccgggggttggggttgagggtgttgggggatcaacggggtcccctgggaggcctgcagggggctggcgtgtgataggagggactccacgctgtgtggatagaggcagggggtgaggcagggggatacatggaccaggctgtgcgtgctcagccgtggcctgggctggggccctcccgagccctttgctgtcccagatgttgctgggctctggatgaggcctcaggttagaccaggctggactaggggcttcagggcccagatctctgtgtgaggagggactgagcaagggtcagcgctgaccacaggagggagggaccactgtgccctggagaggcagcagagatacctgccgctggcaaccctggcagatgggacgagatgcgtttacagaagctttcttgggagtggagtctggagcgacctgcatggcctcctggaggagcctggcctctgcagaacgccctgctgtttgcaggcctggggccgtttgcagcgtctgcagttgtgtgcggggccgttgacagagcctctgactgtgccaggctgtgtgagaggctgcagctgtgtgcagggtcatttatggctgagtcctttcccctgtgacatgagataagccatcatggtcttgtcataatgaaacagatttgggcgtgagagggcattaagaactgtagagcagcaggaggcattgggcaccttgccatcagggagcctggaccctggacactgagccaggtgccctacagaagatggctgtccctctcgcagctgagacccctgagataacagcagcatctacagaaagattggcgagaacagcacggtgagtggccagggtgaggcctcagaatatgactgggatcagggttaagtctgtaaccaaggtcaggtctcagtgtgtgaccaaggttggggctcactgtttgaccaggatcagggctctgtgtgaccagggtcagggttcggtgtgtgtctgggatcagggctcaatgtgtgaccagggttgaggctcagtgtgtgtccaggatcagggctcagtatgtgaccaaggttgggactcagtgtgtgtccaggattagcgctcagtatgtgaccaaggttggggctcagtgtttgaccaggatcagggcttagtgtgtgaccagggccagggtttggtgtgtgtctgggatcagggctcagtatgtgaccagggtcgaagctcagtgtgtgtccaagatcagggttcagtgtgtgaccaggattgaggcttagtaggtgagcagggttagggagggctcatcctgtgaccagggttaacgcttagtgtctgaccaggatcagggctcagtgtgtgacccagatcaaggctcggtatgtgaccaggattagggctcaatgtgtgaccagggttgggggctcagcacgtgatcaggattagggctcagaggtgtgtgactatcaaggctcaggacgtgaccaggatcagggctcagtgtgtgaccaggatcaggaagggctcagcctgtgaccagggccagggctgagccgtgggctgggtggccattccctctgctgagggtgcagagggcctctgaggtaccccatggccacagagcccagcaccctgcctgctccctgcattctcagatagttgggtgctggcctctctgtgttccaggtccctgtcccgtgaccagcaagacccatcagctgattcctcacccctcccaaaatagctacgagagcaggtggggtgggaacagcccccgcacgtgacccctgtggagtggatcctccgcagtgggggtataactatcggcctggctgtgaactaccaccaccttttccctggtcgtgtggggcttccctgctggcgtacagggcccagcttcctcctggctgccatctgagcggtgcccaccctccctgctctgaggcgccccagctgatgcccgcccctcttagaccctaaaaactggacccatccctgcggctcagctggggtcgctgttcggatgcaggggctcacacgtgggctggggagtccagttcctgctgtggggacccagtagcttttctggaagaaatgtccttgctggtagatctggggtcctgagcaccccagaggagggagtggtgtgctgggcagctggggtcccagctgccagttaccgtgaatgtaggtggggacacctttgcctctgctgggtggcccaagggacctaggacaggctcttcgacagccagacactacctcgaccagtagtggagcctgaagtccactcttggtggacctcactgcatcagggtctgcctggctggagggtgacatgcccttccctgggggcttcaggggccatgaccctgccccaggggactgaggggacagggctccaccccgagaggtctgaggggacatgtccaagtcctgggtgactgtgggggacacagctgtgccctgggagccctggtgagtgggtcctgccccctgagccctgcagccccagcccagccctgcctcctccgtcctcccacccccaggacctgaagaagtacggggctaccactgtggtgcgtgtgtgtgaagtgacctatgacaaaacgccgctggagaaggatggcatcaccgttgtggtgaggcgcgcgccacggggaccctagtcactgctgccaccgggggagggtggggcggggggctccgggcctgcgcagagggtttggtgcccctcctgtggcagccctgggcatgtctgtgcctgggccacgtgtgtgtctgggtacatcaagggaaggccagggtgttgggccgtgtgacctcaagaaagtcacccttgcgcacccgtctttctgtctctagggtgggccagcacggttcgccaggcaggggtggcacatgcttggtgcatcggccaaggtggcgggtgggctcctctgcctgtctcaggccctcctctgggcctgtcttgggtgcatctcagtcttgctgcctgggcggctggggccctgttgccaggcagcaggctcctggggagggcccttgggcagtttcctcggcttctttggccctggggacccaggtctgggcggggggtggggcggttctgctgcgatatccttgggggggtgggccacagcagctgcaggcccagagccagccccaggggggtccacccccggcccggtggacgactgcccccctggtgcaggcctgcccagctgcgcctgggcctcagtctcctcagtgcggagcacccctcagtcactgcttttcatcccaggactctgcttttggctggggttgcagttttgtgacctcagcttggcggtttggaatggtggcagcgctggcggtttggggtcagacaggccttgggctgcgtcccgcctctgccctccccagccttgcgaccctgcaggtcactccgagccttgggttcctcacctcaaagcgaggctgcttggaagaatgggaggcaaaggcatgtccccgcttctcgcacggggtgcgcccacaccctccctccccttccacagcagcgggagggattggggtcagacgtaagtagccgtgacaccggttgtctctaggagttgccctgcctggaggctggggaggggtgagatgcccccgagggctgtgtgtctgcctcagtgggcccagcgggctctccctggtaccagacagccccatgcctggcacagtccctgcatgaacccgccttcccaagactgaaacgtgtccactcctactgcagcgccctggcccgggccctcccctaggaagactcacgttgcccaccgatctagggcgctgggggacgggacagtgggaagcacaggtcatcttccaagaccaaattaacccccaggagcaatgggccggggcccggtggaaccgcctgtttcgagtcctgccctcagaaatgtgggccctgtctcgccccacagccctgtcttcagtccttcctggcacctgggctgtgtgtggcatgtgccagccatctttgcatgccagcacaggggatgagaccctttgcaccagccgacccaaaacctctcaggctgccaccggcacacaggcgtgagggattgtgaccccagaaccagagctcgggctgacaggtgtggggattaggatttgtgcgactctggagcaggctctattcagaaaggggtggggtggtccaggaaggcttcctggaggaggggatagctgcagtgtacagggaatgatgaggagtctgaagcactcaccatggggtgcccataggcaagctgtgcccctcctgtgtgccctctgggtctgctgcccccaccctagtgggctcctggcaccctctgcctctcagagctccctttcctcgcctgagccccagagccgcctctctaccctccctcagccgggggtcctcatgtctgcttccctccgtaggactggccgtttgacgatggggcgcccccgcccggcaaggtagtggaagactggctgagcctggtgaaggccaagttctgtgaggcccccggcagctgcgtggctgtgcactgcgtggcgggcctgggccggtgagtgtcggggcggggtagggctcgccatgtcaggtggttgggcatctcgtggtctgacagcctcgcttttggatgtgggtcttgaacacacgtccacgcgaccttcccaggaggcccatgcccctagtgctggggctcccagactggtcctctcccagcatcacagagaggaagtgcttcccaaagtctaacccaacttcttcctgctatggttgaaaccatcctgacatcttgtgtaggaaagggctgccgtccccctctccagacacaaagatccccccacacacagctggggcctcagactccctgctgggagaacgggaggaagaatggcagctgggatcggatgacatgaccagtgggacacccccatctgcagagggagacccaggcgagcagagttgatagcaggcatggatccggctcttagcacttcacccgccagctcttatttaaccctcccccagcagatcacagagaggttgcctaggagggagccaggatttagacccagtgctcaggctgggctgtgaggctgtggcctccatgggggagcttcaggcaggggggattctgggccccttgggcccccgtgccctgcatcttcagcaggtgccctgccaaggggacaggggtgcgcaggctccgatgacccccgccctgctgtttgcccccagggctccagtccttgtggcgctggcccttattgagagcgggatgaagtacgaggacgccatccagttcatccgccagtgagtggccgcggtggtggggtgggctgtgagcgctgggggaggggagatccggctgcccacgaagggtggcggcattggctgtgtggttccgtcgctctgaggctgcgtcgatcagcacaagctgggccttgctgcagaaacggggaagcctgaggtgtttctgatgggtggggacagcagcccccgagtgaccatgcagccacacagggacacagcgaggccacccgccacgccgtcctgcccgccctccacagacagagctccttctgtcgcagccatcctgacgggggtggaaggacccccagagccagccagttcagtccctccatgaaaaactagaacctgaaaccccacaccacaccgtgtccacccccagggacgctgacagtgggctagtgtctcaggactactctgagtctagctgctcaccacccctccccccaaccccgagctctccagctcagcccctccccgccctccttagaggcttctaggccagctcgcctgccccatccctgtcacttggtggcctccctggggagggctgccatctgcccactgcccagggggtcctgggggagtctggccgggatggcagggccaactctggaggaacggatgcggcacctgaagcctgcccctgcccagcccaccatgtgtgtgcccgtgagtgtgacacacctgtggtactcctcggacaggcttggctggtggggccatctcttcctcccagaggcaggcttgttcccagccatgccagctggccctgtgggtctgtgtgagagtgtggcccgccctgtgggtctgcgagagcgtggcccgccctgtgggtctgtgcgagagcgtggcctgcaggtgctcaggtctccctggggaccatgggatgtgcacgctcacacacagacacgcatgggggtcatacaggcacacattcacaagcacatgtgtgcccacacagacccaggcatacgcaggcacacactcacaggcaggtgtgtgaacacaggcacatacagacaagcgggtatttgcacacatggacacacatggatgcactcaggcatgtacacacgtgtgcactcatacatgacatgcactctcacacatgcgggtgcacaccttccccgggttctctccccaccccacgtctcaccgagcaagggcttgtctctcccttgtggcttttgctgtgtggctccccgcacctgaggctgcgctggtcaggacaggttgggccatgctgcggaaacagccaggcctgaaccccaacgactcagaacagcacgggcgtttcttgcccctgttgcgtgtctgttggtgggggccctacccggaggcgtggctgagggctgcgccttccccagtgtgccggctgctgggcgaggaaacgagcacggtggagccacacggggcacctgcagctttgctgggcagagactcctcgcgctactgctgctcccacttccttggccagggccagcctgtggccacgcctgaggtcatggcaggtggggatggatgagcctccagaggcgctgggtgggcagcccccgcccctcaacgcctgtcacctcagggcctctcaggtgtggctgcagcatcctctccaggaagtcttcctgttcaccccagccaggtacatgtggtcaaggaccaggtggcggggcagggtgagcacatagcccaggtccctgctgtaaggaccaggtggcgggagcagggtgagtgtacagcccaggtttctgctgtaaggacccggtggcggggacagggtaagcgcacagcccacgtccccgctgtaaggaccaggtggcggggacagggtgagcacacagtccagtccccgctgtaaggaccaggtggcggggacagggtgagcgcacagtccgggtccccgctgtaaggaccaggtggcggggacagggtgagcgcacagtccgggtccccgctgtaaggaccaggtggcggggacagggtgagcgcacagtccgggtccccgctgtaaggaccaggtggcggggacagggtgagcgcacagtccgggtccccgctgtaaggaccaggtggcggggacagggtgagcgcacagtccgggtccccgctgtaaggacctggtggcggggacagggtgagcgcacagcccacgtccccgctgtaaggaccaggtggcggggacagggtgagcgcacagtctgggtccccgctgtaaggaccaggtggcggggacagggtgagcgcacagtccgggtccccgctgtaaggaccaggtggcggggacagggtgagcgtacagcccaggtttccgctgtaaggaccaggtggcggggacagggtgagcacacagtccgggtccccgctgtaaggaccaggtggcggggacagggtgagcgcatagcccaggtccccgctgtaaggaccaggtggtggggatggtggggacagggtgagcacacagtccgggtccccgctgtaaggacccggtggcggggacagggtgagcacacagtccaggtccccgctgtaaggacccggtggcggggacagggtaagcgcacagcccacgtccccgctgtaaggaccaggtggcggggacagggtgagcgcatagcccaggtccccgctgtaaggaccaggtggtggggatggtggggacagggtgagcatgcagcccaggtccctgttgtaagggaaggtcgcgcagctgggctggaattctgggctcagcccctcccttactcacaggccccccttcctggatggtggaggtgcccaggcaccacccttgttgtctgctcatggccttggggtgggtcctaccgagctagggaagcctgggggccgtagggagcccagagtcagcctggaggaggtggcgctttggtgagtttggaaggcaagcaggggtgagctgcagggggccaggaaagggtgactgtgactctgggagcagccgtgccaaggccctgggacaggaggggcttggccagcctcaaggccttactccagcccactgcactctcagattccagctccctggggcaggtgagatggccgagccaggtccttggatgatctctgttcctgttcccctcttcccaggaagcgccgcggagccatcaacagcaagcagctcacctacctggagaaataccggcccaaacagaggctgcggttcaaagacccacacacgcacaagacccggtgctgcgttatgtagctcaggaccttggctgggcctggtcgtcatgtaggtcaggaccttggctggacctggaggccctgcccagccctgctctgcccagcccagcaggggctccaggccttggctggccccacatcgccttttcctccccgacacctccgtgcacttgtgtccgaggagcgaggagcccctcgggccctgggtggcctctgggccctttctcctgtctccgccactccctctggcggcgctggccgtggctctgtctctctgaggtgggtcgggcgccctctgcccgccccctcccacaccagccaggctggtctcctctagcctgtttgttgtggggtgggggtatattttgtaaccactgggcccccagcccctcttttgcgaccccttgtcctgacctgttctcggcaccttaaattattagaccccggggcagtcaggtgctccggacacccgaaggcaataaaacaggagccgtg

SEQ ID NO: 927 - DNA, 9615 bp, Homo sapiens; identical to SEQ ID NO: 926

SEQ ID NO: 928 - DNA, 235505 bp, Homo sapiens
atctgataaaatacacatttattagaactttttcagcagcattatttccagttgtttatctaatcaaagtaattacagtcagcactcaaaatatcagcaacaaatattttgagaactctggaataaaataatcagtagtatatgtttcattcattcatccatccatccatccatccattcattcattgtttaacaaatgtgcaatattagcacagagagtcaggtatgctatttgctatgggaaagtgtatattcctgccatggttcctgttgtgcagactatacccactatttaagaggagagctggaagccaggcacagtggctcacgcccgtaaccccaaccactcaggaggctgaggtgggaggatcacttgagcccaggacttcaagatcagccttggcaatatagcaagactccatctctaaaaaaaaaaaaaaaaaaaaaaccaataagaattaaagaaaagatctggactgtacagtacattctaatataaatgtacacatttagccacagggcctaataaaaagcttaataagaatggtttccctttctattcaggttcaacttaggaaataaatagtgattataatgatattttcatagaaacaaaaacccagttgaggctttacttaactggtattttttttttttgcaccttattttatgaagacacagatttggtttcagaaattcagctactgagctccaactactagggcaggtgaccaccttgaatgtcaggtgaggggagaaattgctccagggtccatcagcagaagagctcatttaattaaccacaaactcaatgcaggacactggcacttaatgatatgggatttcctcatagacatcacaaataaaaatgttgtcttggcagctagtgagagaacacacatgaaacagagagttctggttagacaatgccaacacacagaagggccaaactgaattgcttttcctaccttctgtattatctgaggagtctacagtcaagtccagatgtctatacaacacatagtggcccctatcaacatagccattaatcaaattgacatgtaatattgaacattaattaagtgctaatgtgtaaaaatggacccaagagcggggcctggattcctttcctagataattttataggaaatatgagtggtgcctcttctttagacacggctaaaggtccccagtcaattccttttcttgttggatcatttactataatgatcaccaaccaaatcagcagacatctttattagcaaattcagtaacaggataatctttccaaaatttacaaatatacaatatatttatagtattaccttcagacaacttcagtgcaaagatatacatatagtacattgtgataattatttgtaaaaatatgagacggcataagtaaaaaaagacacacaggatacctccaactataggcaaacagggaaaaatatatttttttcataaagtactgaatgttaacttttttcatctgtttgtaaaaaatatatgtgcaaaagtgtgtttctaattattccctaaatagctggtatagctatacttcagagtcttctttaacaagatttgcggtgtctttaaaagtgtcttctgttgcagaataggttggagttgggtctcttctcgaaggaggcttaggcttagcagggagcgaaggtgatggaggtggtgtcgcagcaacactttccttttgctcgttctccatctaagaatacaatgtaacaggaatcagccatttattcccccaaggtcaccatacacggtttttcataaagaagactatttgtggccactctgctcagaataatctaagtgtgtgtccaatttaaccaagcaaataatttctaagaaaaaatgtctgtgctaagaaaaattgttaaaaattacctgtgcatagattggattttcaaagttggtagtttgtttagattttcgtttgaagagattccattttgtcacctaaatgaaaaggggaaaacaaaaacctctcagtaatggaattattttgtgggtttcttttcctcctgtctcagttttaaaatttcttcttactgaagggtaaagcaatttgggacctgggaccatgtgattcagcccatatggtaaattgttcaattcctcctatggtccctgaacagtaactgaaactctgggctcttttaatcgaatggttttaaacacttctttgacttcaaatttatatattatagaatttgtgccatagtatctacaagcaaatcacctggttacctcagtacagagagaacacataaaacagacatgcacaagatgcatctggagaaaaagagatttctggggctgcctgaaaattgggtggagatggcaaagccaaactgtaactcttattccctaaagtaacattctttggtcaactcaagagtatcccttctcccttcatcattccctcctgtgtcacaataataataacaaaaacatctaacatttattgagtgcttactatgtgtcaggaactattctaagagttttacaagtttctgattttttttaacaaaccccagaggtaggtacacttattatcctatacttgctgagtcacagcaagattatacaactaacttgcaggtagaagggcaggtaatgattactcaggggacccagaggcccataaactggagaacccaaagataatcaccctggaccatggtgcgtggcccacgctttactgaaaagttgcctgtcatgctgactgccagataaaaacctggtgggagacaagggaacagacagcctactctcaacaggagctgagggagcccacaggttttatggggtgtctcttactctgtgacagcaggggaccagcctgtggaggagtggggaacacagggctacagaagtagaagaggtcttcactttaacccacattcaagtgagaacctgctttgtacatagtgcccccaaggggaacatgaagacattcaggtcagagccctgcctctgggcgcttacagttaagtggggcgggccaaagtctcttagatgtcattgcttcaaaatgaaatggctaacttgaagttaagcaattactaacaagaggaaagggacggtgactttcatttttgtctccttgggggatcctatgcatatcaatgtaacttttggaaaatgatagaactgaatctttttttttttttttttgagatgaagtctcactctgtcgcctaggctggagtgcagtgtcacagtctcggcccactacaacctctgcctcccgggttcaagcaatcctcccacctcagcctcctgaatagctgggactacaggcatatgccaccacactcagctaatttttgcatttttagtagagatggggtttcactatgttggccaggttggtcttgaactcctgatgtcatgatccacccacctcggcctcccaaagagctgggattacaggtgtgagccaccgtgcccagcccatgtttttaattgttagtctttcaacatatttatggatgaaagatacatttgtgggactctggcatattcaaatcaacctaggtgatctcacccaagcgcctctactgcttttaaagcatgctggctgttaactcagtgcccaggagggaagaaatacagtgagatccctggacataacatggaagacacattttagagggtctcagcctcactaatgtaaaaaagtaagaggaggaaccaaggtattacaaaagggaagagaaagaaaggactacaattggtgaagatctgctctcctttgaaagagactgtcagtttacattttgtttctgataacagacatgcagatcagaggttacagcctccccaccacagtccccttcctgcaccagctggggaaaatgtctatttagtgaagaagatcactagactagagatggactgagaaaaaatgttgaaaatataaaataaatctggcactagcttggggttgactcaggcttggaggaccaaatatatgacattcaagcatccgtgtgtctgtggaaaattaatcttcaaaatccatttttaatatagcttaaagaaaaaatgtttagtcccttgaaaaatctgaaactgaaaattcctttctagacaatatttatgtatgtctgtgagtgtatgagtgtgtgtgtgtgtgtgtgtgtgtgtgtgtgtgtgacatgagaagaagaaataagggaatttgagaaggtgtacagaagccttgatatagactcttctcagcatcaatttaggtcaaattttattttgatttaaatcagcagaacagaaaccaatgtttaaggtgataatgagactgccaagttaccaagatatcaatgtttatagactatgaaatttgagaaataaagattgtataaaatggtaaaatttccaactactcttagactttcatttctttacattacttcacaaaattggtcatagaatcttagaacagagacattccagatcctagcggttctcaaccaggagtgagtgcacatgtgttggggaggggaggtgatttctggggtcacactgaattaggggagacactactggaatttagtggacagggaccagaaatactgaaattccctgagtgcataggacagttttgtagcacaaagaactgtcccactcaatatgccaatagcgcccccagtgagaaatattattgaggactctagccccagaagtaaaacagtttgtccagattcaaacagctatatctggtatagctgcaaatgcattcattaaaactaatgatatacattaatacagagtttaatatcaaatatatttattgaatttcttcctgcagaccaaatagtgtaccaattgcaaaggacctgcaggcatgtttaagaagctccatctagtggcatttttttctttcaatctccagtattaaacaccatccctgacacatcgaggggaataacgttagttagatgattggttggccaataatgaatagatggatgatgaatggaaaaattagtgccatctagtggtaaagatctgtaatagcaggagagcgaagaacagcttgaaagaataaagatgcatgctgtagagaaatcacggcacacacagacggatctttcatctgtatctttgacaccgtgaaatctttattcatactgagtcaatttctcaacttaaatgtctctggtctgaagatactggatccagaagtctatttgttcttctttgtgacatgtcctcctatgttacaaggaacattattcccaactcgatgttagaatgtagctttatttggtggaaagtttttcaatctatgactttttaaaaaattatatttattaactgtcaacacatcttgagatctttgagccttccagaatctcccttgtttgcttaaggttaataaaaacccagtcatcccaaagtttttccaaatcccacattatttcaggagtcggcaactgttacctgagttccatcagcagctggtgaagttgggtttgtctctggaactatctcagaagggtttatgggacttccataattcttattatccacattttcagatacagtcacctgtggacatgttaaaggcctttacccaattttgaaagaatttagtagtaaataaatttgctgtaaagtttgtaccaactctggctctttttgccatcttgttctcccacagacatcatcaggcaccatttttattgcatgacccagtaggccaggactaaacatcactcccaccgccccaaaatcaagagcagcaaccactaagtcacctcataccttaatcctgggaggcaaatacatccctcactggtcacactctcacttattactagcaatttctactgtattctctataccttcttactcccactgttgaccaaatttttggataatcatactctagttatatactggaagccaaatcctagaagaacagcaagaataattccccaacctcactgatgaactgagaatcctatctttggatcttaataatttctttgaatattaataaatcctatcttcggaaattaagatttcatagtactactaaaaagaggttgaatttttgaaaagatgagaatgatagaattaataatcttctacgcatttttctataacattcatacaattccaaggttcccttttaagaccaaattaccatgaatgcataataaactacaaggtagacaattcactccttttcctatattttcacattcattacttgtttattctgaaacttggatatgcatttgtatacatggcctcattttattttaagtgaagatgtcaaatgaaatgtcgtatctcttttatcatgtgattaaagttttcatatctgtttatcagaggatcagggaaaatgctttcaagatttaaacatttccgatcttaaaatcacaaaatatttgtaaaataaacatttctagtttctgtattaaaatgtgccatatctcgagttcaaaaggagcattaggtgttaacaatgacagttattcattgtcactaaggccatagttgttgtgacaaaggagatacatgttcgcagttgacaagcagtaaaagtggcgctggggctattgatgcagaccttatgtaaagttattcccttcacctatattcctatttcatctcccagctcttcttaaagatgacggactgaatctcaaacatgctttctttactattcctttgcacccgtcatcccagcctctcttcactttcacttagactgaacctgacacccatcaggctcagcaaattacctgggctgtactgctgcaaagcttcacagacagcccccattacttcagtcaagcccaaatttcatcctcatctgttacctatttcggcataattctcataaaaacacacatgctctccctgctgatcaagtctgactaatctcccaaacctcaatcccttctacaaaacaacaactcctttccttcctaggcatggttagtgcagtcagaattcttacacaagagccgggaccgtgccctgtagcctttctgtccaaacaacttgaccttactgttttagcctagccctcatgtctgcgtgcagcggctgccactgctttaatacttttagaggccctaaaaatcacaaactatgctcaactcactctctacagttctcataacttccaaaatctattttctttctcccacctgacgcatatactgtctgttccccagctccttcagctgtactcactctttgttgagtctcccacaattaccattgtttctggcccagacttcaatccagcctcccacattactacggataccacacctgacccccatgactgtatctctctgatccacctgacattcaccccatttccccatatttccttttttcctgttcctcaccctgaacacacttggtttactgatagcagttccaccaggcctaatcgccactcaccagcaaaggcaggctatgctatagtatcttccacatctatcattgaggctaccgctctgccccgctccactacctctcagcaagccgaactcattgccttaagtcaaaccctcactcttgcaaagggactacatgtcagtatttatactgactctatatatgccttccatatcctgcaccaccatgcaagaggtttcctcactacacaagggtcctctatcattaatgcgtctttaataaaaacgcttctcaaagccgctttacttccagaggaagctggagtcattcactgcaagggccatcaaaaaggcatcagatcccatcgctcaggacaatgcttatgctgataaattagctaaaaaagcagctagcgttccaacttctgtccctcacagtcagtttttctccttcacattagtcactcccacctagtcccccgctgaaacttccacctatcaatctcttcccacacaaggcaaatggttcttagaccaaggaaaatatctccttccagcctcacaggcccattctattctgtcatcatttcataacctcttccatgtaggttacaagccactagccagtctcttagaacctctcatttcctttccattgtggaaatctatcctcaaggaaatcacttctcagtgttccatctgctattctactactcctcaggaatttctcaggccccctcccttccctacacctcaagctcggggtttttcccccgcccaggactggcaaattgactttactcacatgccccaagtcaggaaactaaaatacctcttggtctgggtagacactttcacaggataggaagaggcctttcccacagggtctgagaagtccactgcggtcatttcttcccttctgtcagacataattcctcggtttggccttcccacctctatacagtccgacagtggaccggcctttacttgtcaagtcacccaagcagtttctcaggctcttggtattcagtggaaccttcataccccttacggtcctcaatcttcaagaaaggtagaatggactaatggtcttttaaaaacacacctcaccaagctcagccaccaacttaaaaaggactggacaatacttttaccacttgcccttctcagaattcaggcctgtcctcagaatgctacagggtacagccatttaagctcctgtatagacgctcctttttattaagccccagtctcattccagacaccagaccaacttggactgcaccccaaaaaacttgtcatccctactatcttctgtctagtcatactcctattcaccgttctcaactactcataaatgccctgctcttgtttataccaccggtttacactgtttctccaagccgtcacagctgatatctcgtggtgctatccccaaaccgccactcttaactccctcttaaagtaaataaataatctttgctggcagggctatgccgaacctccttgggcactctctaattagatgtcctgggtcctcccaattcttagtcctttaatacctgtttttctccttctcttattccatttactttttcaattcatacaaaaccgtatccaggccatcaccaataattctacacgacaaatgtttcttctaacaaccccacaatatcaccccttaccacaaaatcttccttcagcttaatctctcccactctaggttcccacaccgcccctaatcccacttgagcagccctgagaaacactgcgcattatctctccatgccacccccccaaaaatttttttctttgccccaacacttcaatactattttatgttatttttcttattaatataagaaggcaggaatgtcaggcctctgagcccaagccaagccatcgcatcccctgtgacctgcatgtatacacccagatggcctgaagtaactgaagaatcacaaaagaagtgaaaatggcctgttcctgccttaactgatgacattccaccacaaaagaagtgaaaatggccggtccttgccttaactgatgacattaccttgtgaaattccttttcctggctcatctggctcaaaaactcccccccactgagcaccttgtgacccccactcttgcccaccagagaacaacccccctttgactgtaattttcctttacctacccaaatcttataaaacggccccacccctatctcccttcgctgactctcttttcggactcagcccgcctgcacccaggtgaaataaatagccttgttgctcacacacacaaaaaaagatgactgagcaacaaggctgcaacaaggaaatttagatatctgcccatcaactctagagacctttgtacttttcagaaaagtatggcaacagcaagcataagaggtccctctccctttaatccacctcaaaccacatgcttgggatagcagcaagaaccagagagtgggccccgtccccaaattcctgtatagtgacctgacaattctccactcattcatttcacaagtatttgtagagaagctgtggtgcttcaggcactgtgtttcccaggcccctgaagggactcagacctctcttgctctgacaccactcaaaatgaaaggttcttggccagcagccccggcatggctgccaaacctccaccactgtgcaacagaacaggattctgattgttttcaggtcttatgtccttgggttggtcctgttcctgcagatagggcagctgcagcatggaccactcactatgcttccttccctttggagggaaggttaggaaaatcctaagacatgactcaatagattaagatccagcgacagcagtaactgaaagaaaagactgtatggtttctcacctggattggctgaaccactttgacagcactgtctctggctgagtacattgggttttcaaatattatgggctgcttccccatttccatgacaaagtcttcactctgatggcagagacagaaagagagagagagagagagagagaaacagagagagagattacaccatactaatctggttcacacacaaagaaaggtgccttcctcacacctggaggtacgctaggtgctacgtcataagttacccaaaagagaacttgcaaaaaaaaaaaaaaaaaaaggccagcaaaacacaagacctccatatggcaaattattatgcaaagtaacataacatgcactaatttaccaactcaaggaaatggtaacattcttcttatatccaaattctcttaaataactcacttgggaattgggtctgggccacagagaaaaggataatggtggaagaagaaaagaagaataaggagagaggggaaggaaaaagaatggataatataatattctcagggaaggaaaacaatgaaagatttgagggagagacaaaattctgaaagtggtttcccaatactgattacagaaagccccctcagtgccaagactgtggcagccccctcataaagtatttcatttggtcctcccaggaggtattattttacctgttttacaaatagggacaatgagggtcagagatatcaagctccatgtctattgtcacatacttagtaggtggcagagccgtggtctggaccaacgccaactctaaaatcactgtttatttcatcactatacattggcagaaaaatatatgacactaggaaaaatatagttccctactccttttatacatataaaagtcatcaaataaaaacaaaatatcatgtcctcctcacacaccaccctcaaaaaaaccagaaagctcttcaatattcaagttaaacttcagactgttcatgattccaattcaacagcgtggcttagagcaggggtaaattccaatgttattaccaatgtttttagacacctttcagcaacaaacctaatgtttcctaacttgtgtagtgcagaccttattctgagaggcctaatactgtatttcagtcttctctaggtgaattttgttctttataaaaagtatttattctataaatgacaaccttcaaataatcattttgaaaccatactcaccattgccattgacctgtcaatagcagtctcaggtccaaaaccagacactccaatatccatgttaagatctgcccctgatctgaaggtcaccccattcccattttcagagggcttgacgagactgcttaagctggaaagaagtaaccaaaacagtgtcttgttatttaaaacaacaacaacaaaaacaacaaatacaacctttcacaatagtaccctctcctccacattgccaaatcttcctcaaatgtaatgctcaattcccactctaaatttacactgtcaaatatggtagtaagttcccttagctacctggaaacgttaaagcacattcctgaaccatgagatctaaaagaaaaagagtccagcacatagaaggataaagcctgggccatcacacagctgccttttcactcctctctgacctgaacacctaccagtaggcacaaccatttggactacaaaacacagcttgtcactcaggctttagagaagcacttgactaagaagttgggatttgaagtgactgctttacatcctcactactttttgtttctgtggaatcggtgaactgcgtattgtgcttttttaacttagaaagaaaactaagtccttcacatggcttcatatgaatttcttaggcttcaaacatcaacgttccccataatgaaactgaccttggcagcttgggcagagcaggcaaaagggagccggtccttctatagtggaagaatcctgcaattgccagagctccaattacgacgatcaagaggattgtcaacagcacagctactgcggctatagaagaagatagcagagagcacatcaacacatgggagcccgcaatcctggcagaaactgggggctagaaccactccttcaaagactgggttaagtagaaaagctgtgacagcattcaatgtaggggccatgagtaatttccaagttgctcacattcttaaaacttacttgttcctggagagatgccttttgaaaacgccatttcacaatattttccggtgtagccgctaggacacctgaaaggaaaaagcaaatcattcactagctgttatgttcttaggcttctactgcatttttctgagcacatcctgaagtagagagagctttgactgcataaattacatgttgaacagacaatgtatcctgcatgacttttgttcattctgccaagagaagacaagcagaaagaacagtgctctgattttagaaatgcacttgtaatggagtagctgtggcactgagggggtgagtctggccacgaaaacctattggtgtctaatctatgcaatgcttccttagagagtacaaatggaaaccatggttatgtttctttcttttatatgctttcattaaatgctttttaaagacatccatttatcttgctccatgttagagttttcgcaacacagtcatcttctttccgaatccatcccagtctttctgctcatcacgagtgccttgtactaaagcagccctgcagacagctcttctcccacagccctgttgtaatcaacaataccaggtgagtaggaaaatgctgctgccaattctctaactccttgctccccaaagtgtggtccaagaccctgtggcctacctagagcttgttagaaatgcagaatctctgtgcgtgagaatgggcacttgaaccagatctccacgggattcttatgcacattctagttaaagaagcactgcctcagttctctgtagactccctcaagggaaggcaagctggttaaaatgtaagaattagtgaactggtgaggttcctgtatttgttttcctggctactttaaggtctcaaatttccccagaagaggcaaggcctatagctgggacctcaacattcagacttacttgcatttggggaggtcagtctcatcaaaatagcaatttcctccgtgcatgcacctgcatggggggggcaggttgataggcagttcgatggctgcaggaagggaaagccatgcaggtgttagtcagctgtactcagcagagtgcccacaccatgcaaaccggcccaggttaggggtgggaggaggggcaggccagccaattagtctccctgtcaaagcttaccttccccctaagtccagtgagtttccttaaggtcttggagagtaacatacatttagtggaaagaaagggggcagtttatagaatttttcccaaaaaacaatggagaggtactagactctggagcacatatattaatagttacaagaacctagtggtaaaataatctcttaaaatattcacattctcatttgaagttttcagaattctcctccgtgaacccagttaaaatcaagagtttaatgtaggcccaccttgaaacttcaactaaagacaccaaagcatcagtaattgatcagtccacaggcagtcacatagctacagatatagagatatttgataggcagttagctagagagctcctgagttttcaagtcctcccaaactgcccttactccaagtccctgctcccagctaggcctgtacatactcccaggatgtgcctgatggggaattagtgcttcagtgtcttttatattgaagatgcttaataagtataggttacatgtgtatattatttaaagagtctagataccctcctggctcagtccttcaatctgagtctccactcaatgttcactgtatcagacaggtcttccctgaacactatctaaaggacaatccccactcaccccatcctcatccctcttcctctgccttcattttctccatagtaccacctgaactaccatgtatttattgacttctctatttattgtcctcttagaatgtaaactcaatacacacagggggttttgtctgttttgttcacctctgttacctccagcacttagaacagtgcctggcacatagctggcactcaagaaatctcactggactaattgcttaattattataccaaaccgaggccctatatggaatgactgccatcattcgtgtgcttacttcggttaaagttctttaaaacaagaatcttaataaaatccacttggcaaaaagtttaaatgagaaaagtagtagatgaggtgacaaccaggaccacactgctcccacgatgtgaaattgcagtaagtggcaaaacaatctatccacagcatggaacaaatctcaaagcctgaaattgtcattttgttccaaatatggctcgaaatattggattcctaccaatatttccccagtagcgttgggatgagtgcaagagtaggggaagaggggtgacaagaaacagttttttctccctggattcattccctaaacctgccaactcctcagcctgtttggaatgagtcaaagggtggttcctggtctaactgcctgctccccctggtggtagaaggtggttaagcgttttcctttccccatcagctaaaactgggggaaggccccaaggatgtgagccataaaatgggccgctagtgaattgcaggacgactttttcacaggcttttccagcaccggatgctagttagggacactagttattcgcccccatccggcttattaactccttaaaagagtcattgaaaaaaagtcttgccaagaatagatcacccacagcgtttgggactagaattaaaccacagcttcctcatgctggtcttcgtctcctgataatataaagcacttttcaaaaggtagccctttttcagttgtcaaaactggacatggttctctaccctgaggagctacaattaaggttgagtggattctggggcaatgggaatccagcttgaggtagaggtcttataaaaactcactcttcaaaatgtctttacaaaacaacacagcaatagatttagggacactggatctatatttctgcagatcttagcaaataattctcagcagtcactggaacacagttctgtttgccccctaagtcccactcaactctgttcatacctcccacatcccttaaccctccttccagccatccccactctgctgcaaaggacccagcatacagggattcttctgactcctgaaggcagcagaggagtgctcccaggcccccatagctgcttgggcagtgctcctacctgcatcacactcagtggtgctcccctctataaagctggagccttggggacaggcacagctgtatcctccaggtctcagaaggcagaggtggctgcagatctgtttgcaaaggttgggcactggaaagcgggtgagaacagcagttaggtcctgacagaatgaataacctgaatacccagcaactggaagtggctctgccaggtgacagcagagcctaggcatcctctcaatacctctcgtccacgtgtcagctggccactcaccctcatttacactatcatctctgccaccacactgcagtgggatagtccctctctgggccctccagccaatttctgtaccactcacattttctattggcatcacttatcttctctgctgccctgagaggtttggaaggtgggtatctggttcactgcctaacctcaaaatctactcagtgctaaacaacttgagatggttcaaaagaccagtgagatccacatattataccaagatttgtcactacccaaaactggacagatcataacatatggtctatccaaagtatactggatgtgatttccaccccaaccctccaaggagacatttcttctgggtttcagttaccttaattgcaagaaaagggaatttagagcaatggttcctcataatcacctgggagctattcaaaactattgatgccaggccaggcgcggtggctcacacctgtaatcccagcactttgggaggccgctttgggcggatcacgaggtcaggagatcgagaccatcctggctaacacagtgaaacctcgtctctactaaaaatacaaaaaaaaaattagctgggcgtggtggcgggcacctgtagtcccaggtactcaggaggctgaggcaggagaatggtgtgaacccaggaggcggagcttgcagtgagccgagattgcaccactgcactccagccagggcgacagagcaagattccgtctcaaaaacaaaaaacaaacaaacaaaaaaacctattgatgcccattcacagagattcagatttgaattggtctggggtagagttcaagtattaccattaaaagctccctaggtaagtctagagccttattaattctaccttagcatgtattatgatttatccaagggttgtactggagtggataatctttacattccttctcagactaacattctgtgatcctgattgtctgtcattcaagatgtaaccacagacaaagcatagctataaattagtaacacatcttccaaaagcctccatcaatatctgtctcattaccatttcgtcggccctccagagtggagattttcaaacttgaatgtgctatccatcacctggggaatcttgctaaaatgcagattctgattcagaaggtctggggtgggcctgagagactgcatttctagccagctcccataaggatcccaagactcctggcccatggcccacactctgagtagcaagggactggagcagcggttctcaaaatgtggtcactgaaccagcagcatcaacgtcacaggagaactagaaatgcaaattcttaggccacctcaggcatattgcatcagaagtgcaacagatggggcccacgaatctatatttaacaagctctccagataattctgaggcatgctcaactttcagaactcttggttcaaacaggctgggctggggctgtactccccatccccacccccacccccacccccactccaccagcactttccaaaggagccgccttccctgagcatcagctgccggagggagatgcttttccttcaggggcagcctccagactttcctctgccttctcctcagggtccagaggcggtagggaggggagatagcctttccaggtgtactgtgccttcctctcctacctttaaaattgccaagtgtgagagccgcaagggcacttaggacacaaaagctattctattggtagggtctggagtattctggagtgttttggtgatatacttccaaaacaaggaagccatgccctagaaaaggcatttgccacccctgtcatctcatgggagtctcagctttgagttgcaatttttcaaggctgatcaaggtctcaaaatatcagcagactcaagacaaccccagactccacccatgactcacatatggggacaggaagggagtaacttgtcaaaggccacatatccatagcattcaacctgggactttggcatactgaacactgggccaatacagcaagatgctgagttttgggttggatagaattgaacctaaaaattatttcatttctgagattaaaactcacccatttgttatgtgacttaggcacacaagttactaaatctgtctcggcctcagtttctttatttgagatgagaataaaatgtctttataaggtttgggaggtctttataaggtaattgaagtaatagatggctgaattaacactgaagagagaatttgacataagaacttagtaaaaggctatttcctttcctcacttccctttgcctttcatcttgctccacacactgctgaaggataaattagcgcacaggtaacctgaggaagcagggcccagaagtgggaaagtgagacagaggggagcgggtaggaatgcacatgactggccattttaaactaagacctacatatctcaggttgacctgactagcctagccttgcaatgggaaggataagatttctgatgcctatgaaacccattttgtgacttgttaacccaactcacatttagcaggggactgatgtctgctggattctgtggcctagaagtacatatccatcactccaaacaatgatgagggctaatatttttacttacctgctgatggtttgcataatttcatttgaccaccaattttatctttctttggtgaaaatggttaaaacgttcctctcccccagcaaacgtacatacacatatacccctttcatgcaccaagagattagcttgttgttatctactgccatcttccagcaatatagccattattttgaaataagatttccaagtaatgaggagcatcttataccaaagttggtgattacctgacttattgtatctgagttgatgaaagattcgaacttgagtgagccaagggttcactaccagcgttttctctttctttccttgcccaaatttattttgtttccatacttctcccttttccttagatatccagtataactggtcttcaaagatgtccaggctgtaagggttcattgctgcttacccacaggggaaaaacaaaacagaaggttattgaaaagaaaatacccactacaccctaccgccacttctagatctgatgtcattctgcttgaattattccctcatacaatgccttgaagctctgggaatattcaggctgactttagctacatgggactgtgaaagtgtgctgcattaggaggtcaagaagatagaaattaaaccacattgatgtataccacccgacaccaatcacagggccctagctcactttcaagttactgattttactgcatttttggaaaacaatttaaatggcaagattttatgttttcttttgaacataagacatctatctgaccaaataggaaaaatgtgatatgtgctgggtcattgcaattctgcagagtctgaacaacaacaacaaaaaatgttcatctcctagatatttacagttgtgcatactgggcaatctagtaaagtgaaaatgaatgtgtccagaagcggttagacatgaattaacattggtacacatgaaaccacctctactggggcaacctaacaggaaactcagttatttcaatatcttctgctgagaagcatttttttttaaagttgtgtaaaaaggacgaaaaggatttaattattgctaatgaactcatctgcatttaattcagcaggtgggagttggtgggggtggaggggtggtatctaaaaaactatataagccatttcctaagagcagggctccttcttgagaaaacaggcaaagacattagaaatatgttaattattaatttaatatattactttctaactaatttctaaccttcctttgcaatgactctcctatcagtcccatcatattttatggtttcaataacgtcctccttgaagtcactccagtagattcggtcattgttcaaataatcgatagaaaggccagttggccaaccaaggtcctcgaaaaccaggatgttgcggtcctctccattcatccaggcagactcgattttaggttcctttccccagtcagtccagaacataagcctataacagaagatttcttcactgtagcatctcacctggtaagacttctccactacagcagagcacagggcattacctacagggaaaccaactgtttatctcagggacctgggtgctcagtgacaccagttttatattttacagaagatggggagcaaaaataggggcgcaagagcacatatgatttatccttcttgaaaactgcacctccttaatagaaattggccgaaggatggatattcagaccctttaaaatgcattatgaaagctgtattatgaaagctgttcactcttcaagaaatattattgaaggcctactgtgtaagaggcactgttctgtgtttgggatctatcagagaacaaaacatacaaagatttctatcttcatggagctactctgttgcccaggctggaatgcagcgacataatcatagctcactacactcctgggctcaagcgatcctctcatctcagcctcctgagtagctaggactacaggcatgtgccaccatgcctggctagttttttgtgtttttagtagagacgtggtttgaccagtgctgcccaggctggtcttgaactcctggactcaagcaatccccccacttcagcctcccaaagtgttgggattacaggagtgagccaccacacccagcaactctttttaaatatgtcttttgcatccaattaataattaattgtagagcaagggtctatgtaagcaaagatgatctcacattgaattacctagaccagggattgcatgatttcaaatacctggagaggaacaggtatgtaagatgaatgaggagagatcccggttgtaaatatcaagtgatgcggagagcaagaccctgtgtaagagctcctgtcagtgcccaggaaggcagacctacccagtgtaatccgctcctctgatttccaaagcaagaaatacaggttttctttcttttcttaaattttaaatgtcagcactatgttaaaaaaaaaaaaatcttaaagctctgtgttgtcccagccaaatatgtcctatgggccatatttggcccaccagccgctgctttgcagcctgtagtctaaaccagtcatcaggcataggccaagttttaaattctactgacgaatgtgtggattttagacaaactgggctctggaaaaaatgcagccaggggcctttaaagtctcaacaactggtaaataccaccttgtttggttttcattaaaaaggacacacatgtgaaagaagctagtcacaaagaaccacatactgtaggattccatttgtaggaaatgtccagaataggcaaatctatagagacagagagcagattagcaggtactgagggcaggaaaatggtggctcagaggaacagggtttctttgtagggtgatgaaaatgctttaaaaccgattatgatgatggatacacaactctgcatataccaaaagccagtgaattgtacactttaaatgggtaagttgtatcataccatacataccatatgtgaattatataagctgttttcttaaagataataagccaggcatggtggtgtgcaagtagaaggctgaggcaggggactgcttgagcccaggagttcaaggctgcagtgagctatgatcatgccactgcactccagtctgggtgacagagcaagaccctgtctatataagtaaattaattaattcaatttaatttaaattaaaaagtattaaatactcaaaactaaaaaaaacaaaacgtagggaatggaatggaaaaaacacacaaaaggtacacagaatgatttttgtttcctccatgacttcgtttatgctattgcctgagcttctgaacagccggcctggctcctttgcctatcagtacccaagacatccatctaggttctatgtcagtcccactttctctgggaagtggcccttctcactctcacccacattgacctcacatgtcacatactttatcactggttatactaccagtggatcccaaccttcaacattcagttcagtgctactttctccatagagcttccctgaacccttgtaaggtaggagaactatcacagtgtttttcagcagtgtcctcatgacaattctccctttgtatcttatattatagtcaacagttgctgtctgaaggagcatggtgttattttacccatctatgtaaataagggatagaaacctatgactaatttatagatcctttgtacaattcaaatgagtttatatatgtaggacacttagcagagtagctggcacacagcaagaatagaataaatgttggcacttctcattgctgttgctggtattatcagtagttatcatcttcatcatcctttggacccactggcagatcttataccgcagaagctgtaagaaggttcaacacatcatatatgcttatgcttataaaacttatggatgatgagcctttcaaatggatcatgaaatgaggaggttgtaggtcgggtctgcaggccttaggcagtgaaaccctttctcactcctttcttacttcctatccctcacaggactacactgagccattccagagagaaaggaattacaaagactaaaataagaatttctggccaggtgtggtggctcacacctgtaatcccagcacactgggagggcgaggcagatggatcacctgaggtcaggagttcaagaccaggctgcccaacatggtgaaaccctgtctctactgaaaatacaaaaattagcccagtgtggtggtgggtgcctataatcccagctgccaggaggctgaggcaggagaatcacttgaatcttggagacagaggttgcagtgagccgagatcatgccactgcactccagcctgggcaacagagcaacactccatctccaaaaaaattaaaaaaaaaaaagaatttctatgaaaaaaacagtggagggatatcagagtatgataataatatcagatgaatttaaacattagttacagaggaaaaaattaaacggcacactggaaacagtcacatcattcacaccatagaacacactgcatctctttgctcctaatatattgtgtagataagatataagcagcaatgactaatgctgaggacaagtcctcactacaggttaatctcatcagtcaagtatttttcatatttcattgctgagtttctgagggtatgatttaacatatgaaatataacagaattaaagtaataacagctcatagggttctacctacaaatactggcatatctacagagggctagactggtcctgcccaagtaggaaaattatttggggtcattcaaaaaacttttttaaagtgtcactattctgaagctaagctaatatgtaaataccaagtcatttcagcttagtgattattcaaataaatgtcttgaaatgtagagaaaaataacaaaacttgttctcatttacactgagatgatttatagataaattgcaaattggaatatttatacaaatggataatatatatttatacatgtgtcattttaaatatttatatattttggatataaatgtttaatttttaaatgaaatatgaccaaatccctagctggatttcaatgaatgagttactttaaaacatccaaatgaaaggaaaaacaattctgttgaaaccttcacttaaaacagttatatccacaaagaactttagagttcagagctctgatttggcaaggaatccatgtaactagaaagattctcagatgtgttctaaaggaatttccccatcagaaatggttggttctatatgatctcaagggcatgttataattcttgaaacagtcatagacgctactcccaaaaacttgaaggacaatttcagttaaactaggaaaaaaaaattataagaaacatggaatttgatgagaatccagggagaaatatctagatgttgaagacttctccaagtacttaccctagtttgggattcacagcaatagcagctggttggtccaggtcagtggaaatcagccactttctgtaccttccatcaagtttagccacctcaatgcgtttattcttgacatctgaccagtaaatatgcctgaattcagagggacaaagttaaacaactgcaaagcctagagtaatcattactgggtaagaggtttgaagatgagagcatttcgtttggctggtgagacagctgctcagatacctatcatcagaccatagtccccctctcttgggggaactacagccaaggggacatgtttggcaggttacacttggaagagtaaggaattgaggggactcctgcccaacagccaaagcacctgaatcacgcaggatccacaatggaattaactcaattccaaagactaaacaggaaagtcaaatttccaatctgttttaactacaagcctgctaaatacacaagatgtggattgctcgtccccaagataactaccatagacacagcagtcagactggcctctgactggcattattatgagacatgggcttctaggtagaagtcataaggcacggtggggctggtgccttaactctgactgcccatgagtctgtttcctcctcaggaaagagccccgttagaatcaataggaacctggtgtcagctcaaagatgagtggaaacagccttttaaaataacaaactcggcaagactgtcctgccttatttccacttctgaggctgcaggtctcagtctcttacaagcagaaaaagttccaccactttcttaattctcttattcattaaggctgagaaagaggtaaaacttcaaacaagaagacagatctgccattccctggttggttttcagaagagagtgttaatgtctggagttttgagttcctgactctagcaacagtactctaaggccctgtttcttgactgaaaatgctaaaatgagtctcctgttagcctgcaggcacagcgggacccaattagcttcttcaaagatgctcttccaggaacaccagccacattttttaaaaggtgaaaaagaatttacactgaaaataactatccattctccaggagagtagtgtctcctgaaccttccccctcaaacatgtttgcattattggttcattttcaaggaatcattttcccaccaatgtaagtcagtgcaaacctcttccttgaagaatgagcttactaacttctccacatccatttgtacctcacacacctacctgatgataaccctacttaagttctacttaaaaaccatccaaaatgtgtggctctggtccctgggccactagaaggtctagaagaacagaagagactgacacctctattaactcaattccaaagacttctttagtcaaatttccaatctgttttaactagaagcctgctaaaaacacaagatgtggattgttcgtccccaagataactaccatagaaaaaaagtttcatctcaactgctttgctgggagaattgtgaggctgtcccatttcttcacaaaatgagcagtgctgccatactgaaagttaattttggaatccagaactctgttggcaagaatgctattcacttatagtaaatataatattcactattatatcctagatataatatctatatccagatattgacctgggtgctttcccaatttttttcatggcccacaaagaatacaggatatgataatgtctccatgacatgctggggtaagtggaggtagttgctggggcttcagcaagcccaaccactgcccagctgcacccatggctgagtgtactcatatccaggcccagactcactcatggcccatggagtgcagtagagaactctaaccaggaaaacagaacaggtaaggggggaatgtatggcaaatttaccttccaacccagtccactgctattccatctggctgcattacgtatttcagtttcaggtcaacttcctgcacaagattattgcggccggattcaaagttggggatgtaggcacgtttgatagcaccaaacctagagccctcccctcgcacagtgtaatacacaacacctacagaggaagacacacaggtcagtttcatgtcaagagcatcaagtaaaggaagaacaggggtctaatcaggtgaagtactgttcgtttattgacatctctacctccctcctcactgttgttataatatgaataattcaatgacatcagtataatcaaactttaaaacctatcaaacttgagctatgagctacaaatgcttcaactgagaacttagtgagatttagtcatctctatttaaaagtgattcatttaaacgtatttcaacaaagtgcttatttactcttattaggatcaagttctagtttccaaaacagaatgtatagagataaaccagggcaggctgttgagaatttgaaagcatactcaagatcagaggcaataaagaagccatgtcaacgagaagtcctattttatatacagacagaaggatggtggacagcaggcatgttaaaagcataggaagactgtgactgtagagggatgcactggacacctgctgctttcctaggtatgcaccattcttgaaaagtgtattgtattgcatgaatatgtgtgaaaatacaccaataataaatcctacattggtatagttattgatagttttcaaagcctttcatatctactatctcattcaatcttccaaacaactctcagaggtaagcagacagaacaagattactactttgattttgtagaaaaaaaattgagattcagagaatcgttacaattatttaggatcacaaagctagtagataagggagactggcataaaagataagtttacaggcacagaagacaagttttctgactcctaccctactgtcatctcccccaacaccagatagagccatgagagattcaacaataagcattattcatctttttccttcattcaactaaattttttgatcacctaccacatagagtgtactagatgttgggtcagctgctaggcatttagagataaattagattcagtctttgtccccaaaaagcagatgtctagaggatagaaagatattatgtggtcaactagctatataacttagagtaacatgtgccataaaatgacatagattcatggtgagcaatcatagaactctgccagaaggagtgatagaagttgtcacagaggtggtgacattaaactgggtctttgaggtctgagtagaaattttcaaggtgtacaatggtaggaaggaacaagatctgcagtatcaaggacaaggaaatttcaaaatacaagaagatgtgagatggtccagaaaggataaaccccagtgatcggaggagttttagaaagaaatcaggaaagcttggctgggattcaaggccacgctaaggcatcaggagcatgctggattggaagagtttcctcctccactaatgcaacaaaattcactcattaaacaataaattccttaaaagtcaacaccttaaaattctataaagtcacttaatatcaatgaaagatgccaaagtttatactcactgaggcctatgtccttgggatcccaatcataatcaacagcttggatatattcctcatcttgaagatactctgagaacctctcagatgagagattatattttcgaattcggacattgtcaggcagtagcaacaaaggagagctacctgtaaacaaacaaagggctactttatctgtttgaattatactttcctatataaagtaggatataaaatgcacagtatgtacctgtcccctttttaaagaacatgagtttttataggaatctgactatctctgttaatcaataaagctgactctccaactgggttacaaaatccgtgacttgacattctccacttcaagtggaaagctaatatgtctcttagggacattatcagttctttattctttgtactcagtggtagtatggaacaaagctagactgagaaccctacgtacagtcctcattttcactgaattgtttttatttactgacatcaaaacagactagactgcagacattctatctcacagaagaaatacttttatagtcttactaaaagtttaccagaaaagtctcattccttactgtttcctgacagattttatgattctttttagcaggtaatcagctctatgacccaatttagctcctagctaatgacaaaataaacctagcttgtccttgatttaatttttttaacctaaagcagctacttaatggtgactcatcccaagatgcactgtctagaatttgttaagtttaatttacttgcataatgtcaactgaatccaatttaagtaacttttaaaagttcattttatatatttcctctatcttgacattatgttttatatgaatattccaatttgtttcagtcatgtccttagttaaaggatttaaacatttaaaaaattgctgcttaattaccagaccaactgttcaaatgctttcactctagttttcattcactgtcaacagtgttttgagggtaaaatatgtaagtatgctagtcaaatgtatgctttaaaagctcaatttgtatgaagaaattgaacagccattttggccatttactcttaatttacaaaataaagtgctattttcttatcaagttccttaaactctagtacaaacttcaaattcaaaataaagacccatgcctcttaactaggatatgatgatttagatcaggcctctggaatttggagtataatacatctgacttacattctttctctgttttattaggcccgattgtcagacactggcatcaacctaaaacgtaaaactcatgattgaagttatgactgtgccagactcctttctgcctgtgatcagtagtccatgaacaatacaaaagggatatgtccttgatttgccccaattcacgagccctcttggactactgggcctcaaatcttattctcagtggagtgggagctagagggccttgttaccttccttttattgatgaccatcccataggcaagcttttgttattgtttgagccttaagaaagatgacatcttgtccactttttgaagtttttatcaaggtagacaagaggctaaatccattataataagtaacacctggctcttgttttaattgctacatatttgttgggggatgtagctattgttttaagctggcaggggaggagagagaaggagcgactaaagaggtgttggaagagaagcagctggcgagtttaaaaaaaaagaaagaaaagaaaaactatgagaagctgaagtttctttcatcgtatagtgtacttagcagtatttatttccccaaaagtcaattaatcccaacatgaacccatcataccctcagctgcacatcgttttccagggcggtcactcatagacgtgaagccatcagcacagacacactcataacttcctttggtatttctgcagtgctggggacaagtcccaaattgttcacattcattgatatctgtaggcaaaataaaaccaaatacgcaacatctgttcccatccattccttagagatcttgcttctgtttaaacccatattcaccagcaatgaggaccgagaagggtacagatgaaaataagcaatgatacaaacatttgtgaaacactaagtttcagatactgtttcacatgcttttcaaatattttcctcgtttagtcttgccaaaagactttaagaggtatggacgattaagcccacagtcccaaagctgataagcaatggagacaggatttaaactctatgactctgcaatagcagagcacattttccctttcagaaggcatatgttgtgttgtattgttcggtgtctcttcacttctgctaaccagcttcaggaacaggagtcattgatttagtttttcaattgagttcttaagcttcaagtccaaaaggaactcttacaatcttctgactatgacatatcatgaattagaaacagtaaattcaaatactaaaaggcacctaaaatcatgctcatcactcaccatcttgataagctaccttctgactccataccttacaactcatctatgtctggcgtaagtaggtgtataataaatacgtgttggttgtttgacttacaatgaagaaagtaagcctagtttgttttttaaattaactttgatttcacacactggtgcaataagcagccatcatcaccaaggccttcatcattcatatcaattccacagactctactgagcacacagtatctgacaagcactcaggtaggcactggtcagatagcatgcatgcaggtgggggaaagcaattcttgagtagtttaatgacctagaaccatgaaaccatgagtatggtaccattaagggaattaaatagtgatttatttaacaaaggggagtgggtggagaaccttagatgtaaagttcacctaaacaggaattggaaaaaatatactctacctagacaggaggttctgtcaaaaacattggtttcgaacccagctgtacaggagcagataaatcctccttcatttaattgggtacaattttgctcgcatatattttcagcacatgttctttcttttcctttatctgaaaaacaaaatcccagcattacaaaccagatcagccacaaataacagtcaagtggtgtatcaaaagaagcacctactcgtaaccaactataggacatcttgagataacccctttccataagccttggagaggacagagggcactgggggagtcaggattcctatttctgatcgtgatctgaataccatttagataaatgcatataatgctaaaactttgaggcaattttcacattatatgcagcactcctaggcttatcctcagagcatccaattctggactgcacaactatgaagcctgacactctacagctattaccacctgctctactatctttaatcctattgcaaatagatagatcaatagatagatagagagatagatgatagatcgatagatagataacagatagaaataaataaataaataaataaataaataaataaataaataaaagacatggatacagataggttagaacaaagttacaaataggaggaaattataaaattttaagaagactataatttccctaacattgaccaattgattatatacacacacacacacacacacacacacacacacacacaaatatatacatgtatatcaagtgttgaccagggtgcagtaaaatacatagagttctaaatcatacaactgctcttagagccataaattagtacacaaggaaagaaattttgtactatgtatgtatgcaccaaggactttaaaaatattcatactcttttacccagttattccatgttaatgaattttcccttgagaaggaatatgcagtataatttacgtttaaggattataaaaatatttacaataagaacatttgtttgtaaacaacttgaatgtatgttcagtgatagggaataaattatgttatagtataaaaaaactaagacattaatgatgcaccattactttatgtaacactaaaattgaatatgtctggaacttacgctgacatgttattaattgtaagatatatatcttggtttcaaagatgttaaaatataaaaaaatacatcttagaagcaataagttatgattatctacatgatgaattgctatgtgattattaaaatttatagtttcaaatgatactttgacatgggaaatacctataataaattgaaaaaaagactgaaaaactccatttagtatagaatatttcttaatttttcaaaatactaagaaatatttcttacatatacatatgcaaaaaaaagatagcaaaagtacaccaaactttaaaggttagttctcttttagtgatgggattcaaatgatttttacttttgattgttattgaactttcacagtaaaaaaaaaacaaaaaaaacacagtttatttttgtagagcccatataaatgatccctgttattctgatccagatgttccaagacagacttttaacagctcacactttaccctaacacttcattgttcatcattgccccaagatcttgtctctaccaatatctatccaagccatctggctttcatccttgtcattcttatcagtttgcttcttttatcctccatctatccccaaacctaggtcttacagaaaaactggcgaagatgaacatagatagtgagtgataatgggggaaagagaggcagtggttatctccattaaggatttaagcttcatctacctctcaaataaaaagtctcctggtcataggcttctgagtattttagccaaagagactgtggtatctcctgatttaattctttcaaatcaaaatagatttatatctatctgttttccatagtatgcaatgaggtgaacttaatcactctcagagtcctttagggtaaatgatcatatcactatatgtggtctgagtacattaagaacactgggtttcaaaaagaaaaataaccaaaataaagtacaatgaaattcaatggaatgctgcccttggagtgcagacttcaaagctgtatgcatgaaagtcttataataaagatcctagcctttattataggagctcttaacaactgtacattgttaaaacatctatttagattttctatttttttcatgagccattttcagagttttgtgtctttctaagaatttattcacttcacgtaagttgtttgatttattgccataaaatttgtcatagtatttccttactgtcctttgaatttctgtgagattagcagtgatatcccctctacattgctaaatgaatctgacctatgtttattaacttggatatcattgagccagtcacataacctccatgggtctcacatgcatcactagactttgtaatttcctcctagctctgaaatctataaagggattaggggtcccaggagtcaagaatttctggaccaagtgatccactaaatgagtcacccttttgtgaagcaagagtccttaacaagagcagaaaccacacgacactgtaggattcttcctaaaatgtgagggctttcttatcattgttttcatttgaaaatgatcaccattttaacccgtataactgatttccccaaacccaaacatatggcactctatttataaaagaaataccctactttccattttatgaagaaggaataagaactaccagagaaacagcaagtcaatctatctttatgatcacataaataatatttgcaacctgaggttaatttctttcctttatacctgaatggtgctagaaaaaatgctaatgtattttcattcccaaaaatttgccaagacagtagactttaggtgctcttaccacaaaaataatttttttaaagataactatgtgagataacggatatgttaatttgcttgattataacacatcactatatataagtacatcaaaatgtcatgttgtataccttcaattttaaaaaatcgaacaatgtgtcttaaacacttcagtgatgcttttggagaagaagaagatgaaggaggaggaggagaaggaagaagaagaaggagaagaggaggaaggagaaaaaagacaaaggcaaataaattaacagcacccaagaactagtatattaaaaaagaattctatgcctcaaattattagtccagagaaataagactgaattccatgtcacatattcacttaatatctgaaaagagaagctgcttccatacccgaattgtttgtgctacttatttccttaaaaaaaaaaaaacctgctactaattaaatgccatttgaaaagaaagtactgtagtctattttaagccacctatcagtctctgggagtcagaacccaaacctgccattcagttttgcaaattctatcatgttcaggcttttaaaatattttatcaagtcacttcattctgtcaataactccaagtcccacagaaaacgtatgtgaaataaatggcaagccaactcaatatggctggttattcatacctcttcgtaactcacgcaggagaaaaattgatagaaaatcctttggatgcctcaggaaaaagtcaattagagcccaagaagttgaaagcacatggagctcactaggatgactaagtcacaggctcctagagtttggagaagggcctcctttttcctgtgaggaaaccaaagactggagaggtcagtatgtgcccaaagtggcacagctagtggcagggatccagaggccagccctcctaacctggacttacatgactgctccaattctgcctctgacattctgtgtgaccacaaggaagttacttaagctctctgagctttattacatagacaataacagcaactcaatggggctaacttgagtaacacattaaataatgtatgtgaaagcactttatgagtcataaatggactacaaaggtgtgacttagtaacatgtcattttaacatttccatcaaaatattgagctagaattgttccttggttatgttcatcatccttttcctacacaaagtgctccctctactttcttttttgtttgattgtttgtttgtttgtttgttttgagacaaggtcttgctttattgcccaggctggagtacagtggcacaatcacagctcactgcagcccctacctgcactcaagccatccttccacctcatcctcttgagtatctgggactagaggtgcacaccactacacccagcaaatttttgtgtattttgttaagacggagtttcgccatgctgcccaggctgttcctgaactcctgggctcaagagatttgtctgcctcggcctcccaaagtgttgggattacaggcatgagccactgcatccagccactccctcaactttaaaaataaaaataaatgtcccttcccaggtcccctgtggcgttcccttcttgatcaaacaccctcagaaggattttcaggtaccaaggatactgcatttggcttaagatttttttcatgtatatactttaagttccagggtacatgtgcacaacgtgcaggtttgttacatatgtatgcatgtgccatgttggcttgctgcacccattaactcatcatttacattaggtatttctcctaatgctatccctcccccatcctcccaccataatgtgcagactaataaacaaaatatgtagccttaaagtgctaagaggcacccagtggactgggaagaggacttgctctgcagtgaaacagaccagagttcaaatcctgagtcaacctcttaatgacagtaagacctggccaattcgtttaacctctaagttcgttgctcatttgtacataagaaagagataataacatctaactcataagattgctaccaggcatgtagaatgtttgacacaatgtctggtctaggataagcactcagtcacagctagctatgggcttgactggaattcaagcaaaaagtacattaaggagaaaatgtggtcagtgtctacattatgttattgcatgttttaattaggtaaacctgagttactacaatgaactataaaaacaagtgtttacttactgcaacccagttcatcggaccagtcaccacagtcatcggcatcatcacacacattgtcatgtggaatgcaatgcccattgccacacttatattcatattctgtacaaggtttaggggtcggttttctacctgcaatgtaaaaacaagttaaaatcaaaactttttcttttatgaagcaagatacttccttctttgacagagacagtttgtgcttaccaaataaacaagtgcttccctacatttcccagtctcccttgcagctgggttaggaccatgtgaccagttctagccaacgtactgtcagttggaggtgccatgtgtcactactgggctgaagcaatgaaaagcacacgtgcctcctccgtgtctcctgtgctgctgcagcaaccttggaagccatgtgttccaggcagcacagctgcaagatgcaggagggctgtgaaaccagcgttggcctttatgagtgctcaataaggcttcattatgttacacccctgagatttcaggatatgctggttgcaacagctagtattaattactccgaataacatagagtgatgagggaagtagagtactgccataataaaaacataaaatatttggcattggattaacagtcaggaggcaagcaacaaggacactgatagtggaggcaggaaaggtggagatcatgttatgcaaagtcaaagcatttgataaagctatcacctcggaaaaactggaaggcagatcacatgcttactgaacctgtcaatcatggagcgaggttagaagatagaatgttagtaatgtgcattgattgccattcctgagtttggcaagatagtataagaaagagagaacctaagggaagaactggttaccttacaagcagaaataaaataaagcccagaaatttgctgtgtgagaaaagccacctgtatctacatcccaaacagtaaaagtctgaagtttaaaaggctgtgagacacgaaggcccaataaaacctcctcattggataaaatgactgcccatctatttttctacatggattggatgtaagtgacaataagttcagacagaactctatgaaggaaagaaagcaaagaaaaaagcagatttgagaactatgtctccaaaagagcactaggtcaggttactaacttttagaacaggctagaagcaaacagatcaaatgcctggtatgtttctgagagaaagatataaccaaataaaccaaaatactatgactgtttgagacttggaaaaaaaaacaaaaaacaactcctgggctcccgaccttctataagcaagaagtggggtgagaaagctgccgtgctggccctaatggtagcatatttccctttccctcttcatttgcagaggaaaatagacaagaaaaaactctcaaagggtagagtcagaaacagtgagagacattttaacacaggagctcctcccagagcagaggcatgagctaatcaataaataccctccactccccaaagaagggacctttacaatgtctgcccagagtggccatgtaatttactctcctttccaagccagtgtgcttttgaaagtgaaggtggtgctattcataattccactggggcagcagacatgaatcaggactgtcctgtgctaacatgtgtcatcccagcccagtgggacttcagaattgctatacattggtgatggccatgagtctccaattctttctttccaatgggagtgtttatttctattgtgttgcccctgttccgccaatacctatcaggcacagaaggcactgattgtttattagtttatgggtctcccaaccaagaggaaccacatctggaactgattgagtggctactgcccattacccagaggtcctggatttcagtttcggaatggactatgagctatgtcccttgggaaggggttaagggtgttctgtgtgtgagaagaaaatcataaaggagtatttagtgacacaagggtaaattgtatgagaatgcatattcttgcattttccagtctcccttacagttagagcagggccacgtgactggttctgaccaatggactatgagcaagaggatgtctgtcatttccaggctcaggaagttaagaagctgtgtgcctccaccatgttgatcttctcctgccttggcaaccttgaatgtgtccctgatggcataattatgggatggaggagggttgcttgactgtcattaaactttacatgagcaagaaatgaacctttgccattttaagccattgaaatgttgcaggttgcttcctgtggtgactggtagtggtctcccagactaaaaccctgttccttgaaaagaatagaagtttatggattcttttttccactctgggatttgaccatgtgctacaaatgtcttgctccattttttaaaaaatggcatttttagcaggggaaatggaaagagattttggggaagggggaaatctgctcaaattctttaaaaatattttatttctgggctttcatgcttttgcgctatgcctcaaataaacatattaatgctataatgtattaatgctatctctgccagtaataatgataacaggaatacgaacttgaaggttgtggtagtgtcaaagtcctccctgacagtctcctctgggatgggggctggaagtaagcattctgtggcaaagcgttctaagaccacatcaatacaagaaatagaaagtggagaaatcaggcatttatcttaattttcccagataatgtctttttggggaaaaaaataattggagtcggggaaatgattttcctcactgacattttctaggcaaattaaattgcccagaaaattggtcaactttccccttcaatggatagattttaaaacattttgaaagtgcagaaaaagtacagctatttcaatgcctcgattgttaaatgcagccagtttggaacttctatcttaaactaatctatcacttttctcttctgggaaatgaactttcattttcaacaaggatattagataagctctgttaacaccagtgctgccttgcttcacatgatctctgcagctgggcacctgcctagattagcaattagcaactcctgaaggctgaaggatgatcaaatctcatatttgaaaaaataaactattaatttgcgaggtgtggctcaatcagtatttagtgtttgttctcagtttcttatgagaaaagaggaggggaaggcttattaaatgttcaaacaaagactgaaaaattaatggatttgccagcatcatgctcaaatgagacaggaagaaacaggcagggttacatgtaagcaatgcatgtgtttgcatggtcttgtaaacaattatgtcagcagagatctgcagtcatgggcacaactctatagaacaaactgaaatcccagaggcacattttccaaactgcagaccacttggggtccttcctttttccttctcccttttgacttttgcttacagtgctcctctgtctcatcagttccatctccacagtcatccacaccattgcacacctcatgactataaatgcagcgattgttgtcacaccggaaacggtttggtgaattacagggaacatccactgaaaggaaagatagaaaaatgaaattacaagttaacagtagaatctaagtgtcaatatctaaaatactccagtgtcagcaccaggcttgcttcattcatgcactcatttactcatttgattaatcaatcagcagatacaccttacatgtatagtacacaccaaggcactgtgctaggcagtagatatgatgggaaacaagaaagacacagtccttgtcctcatggaactttcattctagtagagaaacaggcttttcaaattaaccattcaattacaactatgaaacatctactggggtgatctgacttaagttagggagaggaaggcttggaagaaacttcccatagattctgagtcagagaggaggatggcaggtctctggacctgaataaaggcctcggtggctggagcatggatcgtggagcacaatggtggctgtgaggctggacagactggcagtacatggactcttatcctaacagccaggaagccatttgtttgatcctcctgatggcagttgtcatagagtctctaccgcatgagtcttttattgaagctttaaattgtgttggattttccttcctgaattccctcacctcttacatttaaaatcgatatctcacaatcaaaccctgacacacttgctgtccagagtgagacctctagctgctgcctgtacagatgtgaggaactcaagggtagtccccaggtcccctacttgtttggtacagggaacatggttcactatgcgtgtaccacaaatgcagtgaactcaacatacatgtggtcttcacatgtggtctgtctttcacatggaggatttgggctgtctgattttccttccgccttggtatcacacacagggatcaagaggagagacttataataagattggttgaggggaaagggtcagatctaagggctgattcttggaagtattgttaatagaactattgcaataattatttgctgtgaaaggcaagttcaatattataaaacagtattggaaaccttttaatgtagctgtgtctctgactctccaaagtttatttttactagctatgggcattttaccttatggagagaagagatttcctaaggacttctttgaaagttaaacatgtctaagatgtgtctcaagattcatgaagttcaaagcaaaacaaggctagttcctaacaagtaaagaaaaatgttgggatgcaactgtgaaatataatgaacactaattaaagttttctgaggagaaacaaaatactaagatatatcatcttcacaagtcaaatctctgggctaaaaatgagtagtgatgaagctgggaaaggggatggaagatgcaacgtgaacttccaacaggagtgcttctccaggtcttgtctcctaggttaagggcttttacttacacaaaatcctgacactttagtttgcatcagaatcatttgaggggcctgttaatgtatagattgctgggcccttaattttcccacaaaattaaggccactttggggaaagagctcaaaaagcagggtctttgagttaatgcctttccttcctctacttcttttggtcttgatttttaatttctatttggatagggtgcatcccatgaatttgcatttctaacatattcccaagtggcactgacattcctagtccaggtaagacacttttgagaactattaccctagagttcctccaatgactcaaagcatgtagcaaaatgactgcaacaaactctatttacgttcacttcattaaaatcagtagttctcaaccaggggactaaactaaaaggctaagaagccttttaaaaatacgtatgtgcaggcttcattcttggagattctgctccatcaggtctaagcctagggtgaggccagggcatgtgattttgaaatacccctcctcctctgctactgacatgtacctgaattgagactcacaaacaagcagggtttaaaatatatatatatatatatatatatatatgcatcattcagcaagagggaattagatggccttgaattaccatgttaaaaggaagtgactgtaaagattaagaaagtcttagcattttctaaaggtgctccaggaagctctaggggtttggagagggtacttcaggggcacccaaagtaggatacagcaggagaggtacagcctcctccctacccttcctcagacttcaaccacaacagacctgcctttatttatgcatactaggttttcaagcaacatttcccttaaagacattgttttctaaggccataatacatttaaaaacatggaggttttcccaactttctcaggttacagagagaactgaagctggaagacccagtgaaataacaccaacgctgatcctgtgtccattcctaaacaattgtacaactgctctccaggctcacatgctacacgtaagaaacaatgagatttgacagacaacaccactcccattcactccgtttctctccctcttacagcacaggtgaagttcttcatctgaaccatcgccacagtcatcatcgccatcacatttccaatatggcgggatacaaacatggtttttgcattcgaacatagtagcctggcagtatgcaccatcaggaaagcgtgtggctgccatgggggaaaaaaacatattcaaattattatacaaattgactactttggggaagcttcctgctatttctcctttggctcttgccattatagcctgctcttctttattcatcaagatgtatagtggccttgacctgtctgaaagttgaacggactatgtcttaagggcagttgtcagagcccagtcagtttccaatggcatgaatcatccatggcatggacagcactggacttaatctctacaggcaaatgtcaagactggttttacccacatacatttataaagtctctttggcaaccacatcatcaacgataaccatcatggatggttatcatggatgatggttattgttgatggatcagcaataatgatgtataaacagtttgcattgattcaagtgatccataaagactcaaatctgagtaatcatgttggctttccagtttttgtagggaaaagaaagatcagacagttactgtgtctatgtagaaaaggaagacataagaaactccattttgatctctctcagtcttctcagtctctcatcccacctgaggagaaatacctacaggtgtggaggggctggcccccttcaagttttaatcatttttatactccatcgtgtgactgagaaaaattttaatgctataaattcaatatgttcgaatacccaacccaagttctttatactaatgtattcgttgcttgaatatttttttacctgaaatgttttttatctaattaatgatttgtatagtagctgataatatataaatactttgttagcacagattacttaatatattctccatttaaaatagcaaggaagtacacttgaacggccattgtgaaatgtatgattatgatgacttagaactcaggtgaactgatcattatcagtgcatgctgaacagacaatacttatggccttttaatctaagaagcggcagcggactgatgtctaaactatcatatccatgctctcaggtaagcagtactacatatgtgtctagggacttacgacaatcagcttcatcagacgcatccaaacagtcagcggatccatcgcatttcagttcactgtgtacacaatgtccacttgtacactgaaaatattcaggatggcaggtcctcatctctgaagagaaaagattgtcattccgagaaggccttgtcattttcagacagatattaggtacctggagtatagtggttactccatcacattcctatctacaccctgtgactggctcacagcaaacccacaacttgtggttagcaaattaatacattctcaaaactcacactttccccactcaacatacagagatggaagtacctagctccctaatattaaataatctccagctcttaagcttttcctcagaaatcggaattccccaatcttcaatgttttctaattttcctaagacccaacaccaaatcagtaaagagctataaaaattactttgggtttaggattactctgtcaatgatctgatctctacacaagagagtcataggagcacatgcatattccttagggtgactttccgtggaatagtagcaagatcaatgtctttgtttacaaggctaacgcagattaaaatctgctcctaagaagtgttgatattaaaattaaatgtttaaaattccttgctattttcctcaattatgactaatctagactgctatgagttaagaataatgcatagaaaatacagagcagaagatactgtgttatgctaaggtttacatattacacatatacaaaaataattttcctctaaaagccttataaacactaatttgaagcccctacactgtcacagtacaaaattctatggtaagcttctcaaatgacagttaccacagtcccgttcatctgagttgtccccacagtcgttgtaatggtcacagatccatcgcgagggaatgcactgctgattgacacatcgaaactcgctctctgtgcactcccggggagctggaaaggaaaggcacctggccatgagtgtgcaccaggaatcacatacaggagacatcttgtgagctgaccatagtgccctgggtgcccagcaccctcctgtgtcccaagccccagaggtgtgcttgggcaaatcattcaccctccaaaactagacctttcaccttaattttgagtctgtaaagaatggcctttattaagaagtttgtccaaaggtgatctgatctctctttctctcttgctctctctctctgtttttttttttttttttttttttgaaacaggatctttcaacattgcccaggctgactttgaactcctggtctaaagtaatcctccctgctcaggctcctgcgtagctgggactgcaggtgtgttccaccatgcccagcttgattttatcttaattttttctatttcgtgaaactctagataacctcttataggattcaacattgacttttattaataaaagacaaaatgccaattggattacccttttgtataagtttttagctaactgatatttgcaggtgtagtcagcttcctaaatctctcattgcttatcgcaagtggtgatcacttttttcttccaaaaggtaaacaaagttagaatgtgtttcattagtcaattagaaattgacgcatatcatgggtcagtgatatacactctgggcagggcttcattaagcttgttttcagaacacacattgagtgtgttctgaccatctaatttgatatgatctcagcctcttggcttcctttcctcaacctccctatccaatgccttgtagtcaataccttcgactgggagagagaaactaaaacctgtcctgttaattaactgttagccctcctaaaatagtcaactattctaggaagggtaataatgcaaacacaagttctctctcctctcctatgaaggccattttggggaaagagcttaagaagcagtgtctctgggttagcacccttcctccctctacttctctggtcctggttttctatttctattctatttatcttattacatttttcctttatcataagtcacctcaacttcttttggaaaaaaaagttggatgtaaataaattcaacacataaaagatattcttcagtaaataccttcctccaaaagcttgatttgaaacatctcagaaggagatgcttatgtctttagtggaagagaaagtagaaatgtactgaccagcagaaagaaagagatcagacagcttgatatcatcctacccattgaggatcaatgacatagacagttgaattatggacaaaaagcaaacatcacagctctggtggtatataaggaccataggactgtgaacactcaccacagttttcctcatctgagttatctccacagtcattttgcccatcacactgccaacgaagagggatgcagtggtgatttttacagcggaaatcccccacaggatggcatgtcctctcctctgcaaagcagtcattgcaaagacttcataaaccattggcagagaaatgcacaaagtagtattggcttccttgtgagacagtctgagaattgtattagctcactcttgaagctcccaaagagaggaatgccagcaacattcatggtcaacattccctcttttagctaccctgagcctatcctaccacttgaaactcgatccattcccattggtagaaaccatgcaaagaatgaaatggtatctggtttgtaatttgcaacaaaggcctggtatgggaggctaaaatgatgccataataaataaatattttgatcatattatcttcagtcaattggactcagtgttcttaaaagaatttagtatcttccttacttctcttccaactaaacccaacacacatactccagatgctttggtttcaagttagactatgactaatcttgacaaattccattaatttatctggctttcccatgttaccagagagactacagatgtccaatagataacagggaaaatcagagagacattcagaatatgaaaatccccaaataagaaatatcctaatttggaaatatcctttttagagatagatacgaagtcttttctctaacccctttccaccaatttcaaccaatttataaaattagagaaacaatttaaacttgtcaagtatgaataaggattctacatttggaagaaattacacaagtttctaacatcttaataacgtcttcctcaatgacagcatgacttaaagtgctacaaattaaatacccctggtaaccctgcaaaatgctacaaaaatgtaacatgttattagaagaatcaaccatttttttacagaggtaaacaaagaaaagatgacatgggaaatacactctcatctctcatctaataaatggcacttgacatgtgcactttcttgtccctccctccactcccctgtggcccctcctaccacagccttgctcatcactgttgtccctgcagtcatctacaccattgcacacggcccactttgggatgcagcggtaatttgttttgcagctgaattctgtgaagttgtcacagagatgggcagagctcactgaaaagggaggaggcatcaaagtcagaactgaaggtacaagaaagcacctttccattgtcacattgaggttgtggtactgaggaataacaatgaccatgttaccaagcaaaccgcctctggcgatatgtgtctgttttagatgtgatctgtttaccatgagcagaaaaatagtcctaagttttctcaatatgtcagcaccactcatttgttttacagtataactttgtgggtggggttggggaaggacagggtttgaagtaaaaaacctgggttgaagtgttaggtctgacactaaacagtaatgtaaccatccacttaatgtgaacctcagtttcctcatctgtaaaatggaattggttcacacccaccttccctacctcataacatttctctgtggctcaagtgagaaagcagtagatatataaaatataagttcttggtatcatattctggttggttagacattctatgtatcaaaaggaggtattagccacttcagaaacagagtctggttccacctgcaagccacacagctatactctgccttgcagtgccagagtttgcagggagtgccaagggggagcatcccatcagctgaaaaagaaagctccatgtcctctctcagtccccatggaagtttcctcgtgtctccctgctctggtcatgccttggtcctcccacaggaacttactgcattcttcaatgggctcatccgagtggtctccacaatcattatccacatcacacttccaggcctgcgggatgcagcggccattagcacaccgaaactggcccggccggcaggtcctgctggcacagtgggaactgtcttcatctgagttatcctcacagtcgttaaatgtgtcacactgccaggattctgggatgcaacgtttgttggcgcactgccattcattggagtcacagtggtgattctctgagagcagggacatttggttatcagcttggaaggcatcaagaatgaaagctcctaattgacatcagtgaatcctggatagcaggatcatgatttctttttagaggacttatttcctaatgtacttatcagtcagtactactacatggagcacttcttcttttgactattactgtctcccaaattcttaaatatctctttattgcatacagacttaagagataagaactgaacaccctgacctgttaagcataccttcctctgtccctattctcctactggaaaatagtcttcaaactttgtgtttgttactgttattgatgtgttgtttttagtttgggggaattttattttgtgcctatttgattatttatttattttcttgagaccaagtgagtgcagtggcacgatctcggctcactgcagcctcaacctccaggatcaagctatttttctactgcagcctcccaagtagctgggattacaggcacatgccaccatgccaggctaattttttgtattttttgtagagacaggcttttgccatgttgcctaggctggtgttggactcctgggctcaagcgatcgacctgcctcagcctcccaaactgttgggattacaggcatgagccactgtgctcagtcttttttttttttttttgccttttaaatggaaacataaataaatatgacaactgagagtccctgttaaaaatgggggtggaaacctctcgtttcctcctcaatgttagctctcaaaggggattcaatgcccagcacatggtgaagagccaccagtagagacaacttattgtctacttcaaccatttgccttgtaaaaaccttaagatttctaaaaaaaaaaaaaaaaaaacttcataaaaatagaaaaaggatggagcctgagtttccttctaggactttgaactggtttttagttcatgatattcaggaaatacccacagaatcatgatcgtatacaatcaacatagaagtcggaaaaagaggcataaagcgactcaacacaccacaaagaagacggtcttcatcagacccatcagggcaattttggtgagcattgcataaagtctgcgggctggtgcagttgccgtcactgcactggaactgtcccagtcggcagaagcgctgcgggcaaagggccagttcatcagagccatctgagcagtctttctgtccatcacatttccaccagataggaatgcacctgcacagagaacatacagcacttctttagcaaagcaccaggggcaacagttatctggagagaagaagtcaacactgaattccaagaaatgacatgcatgagctctctcgtggccctagaagaggatcaattaaatctcagttacaatggtgtattttcagagaaaacataacttggcaagatagaacaggtttcttaagatccaaatacaaactgaaaatgtgctcttaatatgatgaataaatttcctccacaaaaaaaaaacaataaacaaataaagagtgggtgttttgagctgtgttctaggagcagtgattggttgagattgtctgccagggtgatataaaagtattgtttgggaagttggagggcaataaaaactgttgagggtctttctcacgataaatgtatgctagattcttaatctcagatatcttatttaatcactacaatcgtctacctctgcatcttagatgctatgatctgcattaatgcctctctccatgccactctctaactcaggtcccctagttatcaatgggcctgtggacattgttaagaaaataatctgtggccatgtttcatagcaaacacaaatgatcaaaaatggatttgaatgtgtaaccctggatcccctagcataggcagctaaggagctaggccggcatagacatggaaaagacagtgaaattctattacttctagggacaatttttcagtatgtacttatatacactctggctccaatacttaagacaattagaaatgagaaatatatggtttgcttcctttctatgaaagtttgcatatataggcataacagtttggttagcaagctccttctattcatggaaaatattatctgaagttggaggctgagagtcttgctgtgttccacatgaaccaagttaattaaccaaaatcttgtctcactagaaaactcccatcccttggagccttgaaggtcaatgtctgtccacgggctagagaggcactgaggagaggggaaagagagccttacttttcattgttagcgcacaggaactgggtgctggagcacatgggcatgcagtaggtgctgccactcagctgaagggtgcggaagtcatctggacactcgcaagtgaacccttttcctcctggcttgatgaggcagagatgagaacagccaccattgttggtaccacagggattgctcactagtggaaaaggaagaaaatatgtgttcatttgctgaaagagagtatcaagcacagattagctgattacacatcttgactttaaactcatcacctcttagtaaaaaaaaaactatcctagatttatgattttcccaaaagttcctaaataaaacagatgatagagttatacaagcaacaaccctgtgctttaagaaagctcatttatatgctaccagaagtgagctatacccactggtgtttctgactagaaaagatgtgtttctccaagtcctgggaaagcaggcagtaaacttagcttatgttcatttgcctagacctaggttaaagttttaatttccaacagatgctatattcattccctcattctaagtatacaggtaacaagtttggccaaaaataatgtggatgaataaactgagcagcatctttactaattttcctggtcaccactttgaggtgaatatttgcttgaacttctaataaaaatgatatgaagaatattaacttccagaaagaaatactaaatttctttattttgctaattctcatttttccttaattccaagtttatcatatgttttagcaagacatcacaacaaagcagacccacaaaaaccagtctatccccaaaatatatttcagacctttatctttatttcagactctaaatcataaagttgctttaattgcataaaaggaatataagttcacaatcaaataaaaacaagttctcttacttaaaaaacactaaaacgcactgctcttgacattatcttctagaagataagaataatatctaatttatacacaatacaatatcatatgcatttatttagtatttagtatttagggctgaaatgccatatttttaattcctttaaaatacttcagtcttcccatagaaatagatgaagtaaatatggcaacatgataactgttaaatcttatcaaaaacaaaggaaaaaaaaaaagatgatcttgaagaattgagcgagttttaagaagatgaagagttctaggtagtctttcccaggggaagggggataaactctaaagatatttgcctactgtcaactttcagcatatgctttgaagaaaacactaacaagtgcaacaaactttttgtaaatcacgaagttcatgcttaaagacaatcatgacatgcacataacccaaggcaaccttgccaaacccctcaatcacctactcaccaatgggctgcctatatggatggtacacatggatgtcaaatggtctgtgtgttgtgttcaccagtgtctgtctatttgatccatcatatttgtttcccttttccactgtccttgtattccaatctgtccaataaatagtgtcttcaaaaatggtaatagcgaaagggtgaggcagtgccccatcatacaccgtgtgtcgatggtggccctccaaatcagagtacctgcagcagtaagcagaaacagttatgtgataaaggtaattcctctcctctaatgtcttgcaggataaaagaattcacaaatcaataaaattctacctcctagagataatataagttcagatcctcaaaactcctagtctttaattaaaacaaaaattaaacttaaaggatgaattcaaattgaacaaaagatgtagaagtgaaaaagcaatacttaacaaaataggaatagtgtcaggagtttaaataatcactaattcctaaccacagctgctttcctgcggatgaagctgttatagctgttgtaggtttatggcctcttatagtgatgttcctcattaagcacccttttgatatcctggggtgaacaccattcttgtttcttccaacaccattggaagaaatcagaagatagcaatattatactggaattctaccttctcattaacattccggaggggacgttattctaggagatagttgcattctcagtataacctgaggggaacacaacttacaggcctgcagggttaactttgcaaacaccagcaggacatttattattaatcgtgccatggcaccattagcgaatacttttacagatgaataaacctccagagaaggttctccgatttcaagatgttacaaaggatccacagccaaattcccaagtcctctcagttccaagggctttcattactgtgggtctatatcagaaatcatttctaaaatagtgaaaatttaatattttaaaaatttggaacagatcctaaaactcaaacaggagatagaacaagctagcaactaagaaacctgataatgttagccatgcaatgttaaaaatatttcccaaaatataatttatggtaacttataaaagtcataggaaaacttgaagatgtgcttggcctttgttgataaggatgcaggtaaatgaccagaaattagtcaccatctgatttatttatttatttatttatttatttatttatttatttatctagagatagtctgactctgttgcccaagctggagtacagttgcacaatgttggctcactgcaacctcctcctcctgggttcaagtgatcctcccacctcagtcttctgagtagctgggacaggcaggtgccagcacatccagctaatttttgtaatttttgtagagacagggtttcgtcatgttgcccaagctggtcttgaactcctgagttcatgcaatctgccctgctcagcctcccaaagagctgggactataagtgtgagccactgcacctagccaccatctgtttttctaaaaaaatcatagaccagaaagtagtcctgagaccttcccttccagttcatctgtaatctctgtagagagatctcagatatctctatgagtactttttgtcaagagtagaactacacagctgggtgcagtggctcacgcctgtaatcccaacacttagggaggcagaggcaggcagatcacctgaggtcgggagttcgagaccagcctgaccaacatggagaaaccctgtctctactaaaaatacaaaattagccaggtgtggtggtgcacgcctgtaataccagctcctcaggaggctgagacaggggaattgcttgaacccaggaggcagaggttgtggtgagccgagatcacgccatcgcacttcagcctgggcaacaagagcgaatttccatctcaaaaaaaaaaagtaagagtagaactacaggcacagctccagtgatgtgttggtgcatcccaagatgtacaaggaatcaattgcatgctctataaaaatctattgctttatgcatctatgaaatatatttctgaacacaggcattgctacctctccaagaggtaaccaatttaacatggctcatgaatattaaagtttcctttattcccagatcacagtgcctcatattatgatttgacttttagactaaaatctactgcctaaattttataatccatctacgtaaataatctatattagattttatcaaaaagtgaacagaatattgtgtaactagaaaattccttttttcatctctaatgctcctggaaacactgtctaaatgtatgctgagtgacacctactaagctttcaagaccaagaataatctataggacccaaagaacaacaaatgtcagttagaaagttgttgaagcttctttgaacatcttgatgcttctactaattcaatataggattatatggaaagctaactcagctctttgatgtgccttttaagagaggatacacacactgtgggaagggctaagggtattaccatcagcatatcacatcaaaatggtataagtaaactagaaataatattgtactgcttctaattaaagttagtctctaccctaagagtgagttaatatctgctacggtaaattctgcaatgagaatgctaaaggctaccttagtgtagcaaatgaaccagttcaacaagagaaagtacttggattgattaattatgcctgccatgagcacaggaagaaagagcactggcgtgtgtgccaggtattccttctttttcagtggcatgtccccagggagcatggtgttagagaacttcaaactttactacactgactttggcagcaaaataaatataacagaagaaaggaatttctaaaaataaaataaaaaaatttgaaatagttctactgaatgaatggcatttccatgcttctgagtgcaacaggctgttcctggatcgttatccataaatgcttatgcagaagacaatactatggtccaactaggccataactagcaaaattcaatatgggtattgttgtttaatttttgattaataatgtgtatcatctttttacaatgagtattttttattgaacagtatatttaacacacttaaaaattatcctattaccagaaagatgtaaatgccttatcatattggattaatgttaacagactctactgccacctaaaacactgcactgcacttaaccataaatgtgccaaagtattttagggaaagttttccagatccttttattcttttccttttctcaaatactaaaatttattaatcatatatttcataggggagagcaaattaaagagataaaaaaaattaagatgagttgcacactgagctgactaccatggggagagattattagccccattttctagataaaaaaacaataagaagtgaaaacatcaggtcataaaccctgatccatatgatttaaaagttcaccctctttctactgcaccataccatagagctcagcagttttagttagaagtgtgacttcccccgaatgacttccaacagacaggccagttagacaatagaggggactaatagactggaatcacaagctctgatgtttgaaataaacagttacacaattgttttatgcttttctatgtacgtactctatgtaacccaggtgggcatctgcccagtagagtagatcattggtgtaatcaatggtgatgccattaggccactctaacttggtggagattatcacagacttgttggttccatccatgcctactctcccaatgtatgcgcggtgaccccagtctgcccagtagaggtacctgtcagggcaaacacaaagggtcagtccctgatgccaaaagaagtcagtagccaaaatacacaccttttctccatttagagaaatggagtctgcattctgtagagcagactgcattctgaattcttttctgcattcagaaaagaaagagagctaacagcaaataatctaaaaaagaaaaaggaaggggacaatgtacagaaaatgctcacaaataaacatagttaactggatttcagtggctttgacttcgagagtccagtaaagaaatcggttttctgaaaccacagttttctttgcatgcagccaaaatacaggacttgaaaagtgcaaaagtgtgtcagggaaaagaaaacagaagagctgatgatgatgatttgaagaagccatgcttctactcattacactaaacaatttaccaagtaggaaaagcagaagacaaaccccagcaagacattggccttgagatagttacatgaacagccttctcggtaacagaggcagaagaaggaggtgaaagaaaagcccaggattgcagggagacaatacccatattgagggtgaagggcaagtcctctgggattatcaaagcagaaggtgttgttggcatccacacagtgctgggccagcatgcggcggtgtccaccattgaggtcagagacaaagaggccatccaggcgggcatccaaccagtagagctttctaaaatggagagccaggagttaaccaatacagtcactttgtgaaatggtacatatttagccacccagtttcctacccaagctacctgagaatcacagacagttgttagaagtcacctttcttcaggcaaatgagggcaggggaaaacaggaagtttgtcttcctgcagtgaggcaacagagggtgcaagactgtgtgcaataattcccactttaaggtggtgtcatgtagaaaatacgggggacacacttcattcgacgggtctggttttactttcctcatgcagcataaggcaccctctccaggcagtgcaaaggcttagcagaacagggaagcagaggtgagtatcatgaattacagtttaaatggtggagtcaaggaaacacacttgtctaagtgtgtcattgaaactgcacagagaaactctgaattatgacattcttaagataaagattatgacatccttaggataaagagacatccctgcctctgtcagacaggctgtcaaaatgagtttctcaacctgagacacatttcacttaatcaaacctaagaagctttagaaacatattaggatctgttagaaactgctacctcaaggacatttctgttataaatgtatttttattcaataaaatttatttttcttataaggtaagtgttcttaacccaaggtctttacccagaatcagggaagccagctttggtgatctgtgtactttctaaaggggcccagggctttcaccagagtcttatagcatccataaccttccaaagggttaaatgcacctatagtgagaaggtcatttaggatttgataatcaattccaaccggaaggagaatgaaggagaatgatttcccttccaaaagacctgaatgcctctttgcaacaagtacgcgcttaaccattcatgctggatatctgaatagttaggacagtagcatcgcttcaggcttcagcaagaaagaatgagtatccatatatgtacaagtcttgccagttaattcacttgggtaaatgagtaaatcctgatgaatgagatggctacaatcttggattccatcatggtagacactaagaacagtgagaataatagtagctaattattgaacacttgttaaatgccaggcctcagaccagggactttttaaaacattatattatttcagatcacaacaggcttagaaggagttgctattattattcttgtcgtattagtattcctgttgctattaccattcaagtcctggcagactggctaccccatagggcactctactctgttgagcttactgctttcccattaatttctctttattccacagtcaaaagacatcctgtgaacagattcttctcaagaaaacatggagaagatattccgtctccactactggaaaaattaagataactgagagccaacagtatcttccaatgtgcgtaatggtggtttaaaaagttatatcaaatgcaagggctttggaaaccaaacaccctaatgctgacagcagaaatatttattaatattggagaaaaaagttgtttctaatttcagtgtagctagtatcttagaactgccccctaccaatgtaaatgtaactgggctccattctgcctttgtgttttcaggaacactgagcctggttgtgcaccctcctggactttcaagaaaagtttaccctaccctcacccagactttcttgcccatcttcctcacatgtatttaattctcttctgataaagaacacaccgagatagagaggaaatagctgaaatccaagagaaacgtcattctagcagtttctgagagagagggctgaatgacaatgtcttacagttcaaatattattttttctgcagtggaacaaaggatggtgacaagaacagtaccatgctcagttctgttcctggaaatcattaatcactatactttttgacatgtaggatacgtaaaacaggaattgatacatacaataggaatgcttagtcaacgtttcatttattatccagcaagcactcagcacctatgtcaggccagctactggtcagggagaactgggaagccaactgtccccacccattttaggatctttacccttaagggagtcaaatataaggatgtggggaagagccctctggaggtctgggctgactgcaacaagaatctttacagcatacatctttacagtgcctgcagattgatgtctattgaccacaaagccaattagtttatgctgccaagaatccgatagatttgatattcaatagagatgttaagaagtgtggttcatctggtagtttagttaaaatatcactggcctgccttaaagactgtcagtttccataagggcaatctcaaaacaagagtctcatgttagccattctccagttttcacgcccagcccatgctgggaatgactagtattggttgttttttttgttttgtttgttttgttttttttgagaaagggtctcactctgttactcaggctggagtgccatgcatgttctcagtccctgcaacctgcatctcctgggcttaagggatcctcctacctcagcctcatgagtagctgggactacagacgaacaccacctttcctggctaatttttttcattttccttagagacagatttcgccatgttgcccaggctggtcttgaacttctgggctcaagcgatcctctcacctcagcctcccaaagttctgagattacaggcgtgagccactgcccccggccaatgacaagtattgtaagcaaggctatgtacttcaggagagcaagggccatgtctgccttgttcccctcaaaacccctgctgcttgtcatcacgctgggcatgtaggagggactcaggaagtaacgactgaatgcaccaatgaatgcatgaatcgtcccttcatatcatctccagttaagtgaatggccagcaacagtgaactctcttcccttgcaattcctctttccataaaaatgatactataaatttttaaaataattagatattctgttctgaatctatcatttgaatatcagatacaaagcagaaaataaacctgcagaaacattaaatgtatctgcatattaacccaagttgaaaaattaatttcctatcaagatgaaaacatggttagaattttttaatttttaacttttaaaaagctcatcagtgttttcttacctggaaacccagtctacagccagactttctgcagctggtagtctgtggtttatgattgtctccttgtttgtcttattcagaaacattctctcaatgacttgcctctgtgtatcaatccaatacaatctcttctctactcggtcaaaatctaatgccacaacattgtccagtccttccaagatgagggagtaaaaatagccatctatagttaaatttctcaaatagtaacggttgctaaaaatgagatagggttcgatgttactgttttgccggcaggtctttccatctggttctcggaggtagcctggggcacacttacagatgtaggagcctattacattctcacacttctggctacagacaaaaggcatctctgtgcattcatcaatatcaacacaagtccgcttgtcagacatgagcttgtaaccaggacgacaggaacaatagaaactggttaaggtgtctgtgcagttgtgatcgcagccactgattgaagggtcatggcattcattaatgcctgtaggtaaaaagcagttcttagagatcctaaaatatcaacgaccaactcactataatggttcaaagtcaacatttctactaaacagtgccaattcttaatgaatcatgctaagacagacaacaaagacttccaaagactgtggattattgaaaagtcactatttttcaacttcctcaccaacttactccttcatcagtggtttcaacaactaatacaggagaaatgagaaagaagaggagaagaaaagagcctggccagtgtgctggtcaaacaggactcaggaaaaattttctaaatgctctgatttgtagcatgttccagtgtgactgttcacaccatggtcaagctcaggcttccagtgtgacatcactgaacatggaaccacaaagagatacacacatttgcctctcacgagatggcatgagctcaacactaggtgcaacacaacactacatgtccctctggctggtcctgtaacacatgggcaacctcacccaaaaatgatctacagagggaggacagcaagttcttattagttctctactcatcaaggagcaatagattaaaacttcatgcattgcaaaatccattatccaaatatcaggccaagctcttccactagttcactgtgcacccccaaacaattcgtttcccatctatgggctacagtcttattatctgcaaagagaacagggtacagaagatcactagtactccttccagttgtaagagtgaatgtttcataggtttggatgagacctactgagatcacttcgtcttcaagctaaaaattttaatttgaattatgtactattgaggatttaattcttatagttgaggtaaggcaaaattaattaaaatgcaatgggaatctatatgaattaggagtaaacataagaaagttccctatgatttttgtataaatgtataatatagcacatgtttttcttaatttattaaatggtttttgaaactttggtagaaatttatagaagtttttcttacaatagagcaaaagccagtttttggatgatttttaaatttttttctttttttttcttcaacttttaagttcaggggtacatgtgcgggatgtgcaagtttgttataataggtaaacacgtgccatggtggtttgctgcacagattttttaatattatgcatagataatctcttctccacatttccacagcagtttctgtctagcatttaattttaatgttatttcatataaatcttatctttcatataaggataaaaactacattacatacttctgggtcaattaggcaaatgctttcaatgagtactgacaatgaacaagtggaataaagaaaacaaaataaatgaaaggatatggtctctaaattgttattacagagacaatatcaacatacatgaaacaatggttacaaggattaaacaccacaaacaggacgaactgccaatattatggagttcaagatggtgctaagcaaacaatgcccatgctgtggattctcaactgctttacttgtggtggttggggtgagagagatattaaactctcccattcaattacctgaggacaaaaatgaagaacaggccaacgagttctagcagagggatgcttcaggcaaaaagtcattacaagaattcaaagagaatcaacctggttcccttcattcttgagtaccttatttggcaataatgttaaatgatggcctgaatatttgcccatcttctgttctctctaatgactatctaagcaaagaattggtccaaaaaaatgtgtgtccccatcttatataccaagaaactttggtaaccttttgctatatcaggaatagtgattttatggtaactttgtagttagaggacaggttggaaagtctaagtcgtgaagggttgagaatccatattcagtctcccctgtttccttttcccaaatcctctgttgtactcaccacagcctttctcatcgctgttgtccaaacagtcatctaggtggttgcagagtttcatcatctcgatgcagcgcccattgtcacacttgaactcgtgaggtggacacgtgggttctggggtgtggcacaggtgcatcagctcatcagatccgtctccacagtcattatcctcatcacagacgaaggttttactaatgcagcgcccgttctgacaggtaaactgattctgttggcaagtctggtataagcagcccctctcgtcgctatagtcaccacagtcattgtgccggtcacacctgtatcatgagatccagtaccactttcagagaggttggcaataaacctcaactattacccacttggggttttgcttccttctttatctacctaaatgccaggtcaaccatttcgacaagatcaccagtgtccttgatcccctttcccccatcatcttcgtctaccccactaatcgccaattctagaagaatccaatatttggcattccacacaacttcctcaggggctggctgctaccattagaaatgctaccattaaatgctaccatttaatagctatagataattagtaggtctatagctattaaaaataattgcattcattttttccttagttgataaactaattaaatacaacttttgtaattttggtatacatcagatctatgagacagcttatgaacagtggcactatctatgttcaacagataatgagatagccagtaggcactggcaatgtactgggtaatcacatgataaaagtgcccatacccaaatggaaactcatagggtgagtgctatatattataaataagattattgggtgtgtcctctaagaacacatatcttcccactggaataacgtttacattgtcagtcctgttccttccatctttcattacactcctgccatctatcatgagatgtgagtcttcatggtgatgtgaataaaggcaagctagtaggttagcatggcatactggcaaaggaagaaggcatgctgtagtactagaagctatctcgggacctaacatacacaggcatcattataacaatataatttcctgaagttctgtgagccaaactggcctttcttctccatattactccaagatcccataaaagttatgatgtctaaagggggtctcacatatgcatcaaggaatctttgataagagtgaacaaagctaatggttttgaacaatttatcatagaaagcataggagcggcacatagagcattacaaaatgtgaaggcaacaacggtgaatgtggtcagttttacaactgacctataaccaggcctgctaaccagcactgccatccataaacccagggccttgtcaacatgatttacagcaaaatgtgtgcatgtaattgtgaagaaagctgtggtcaaggcagactggctcagcttcatttggtctcccgggagctatttaactcatttccaaatggtttgaaaacaccaatgttttcctttgtctaatttagatccaatgcaggaggaaaaacaagtcatcaagcaaatcaccaagctttcagacactattgcaagtcagtattccagctcatcaccaaattgtcacccctcagtcttatcatccatgtttttcagcagcatcagtagtgagccaagaaaaaaagaaggtcaataggaaaaatgatctcctgtcccactgtaccaaatggggagcacactttctgccaagcaagcaaggagatgcacactaacagcacacctagtagaggctactccagacacagattttggacttacttagaagctgatagctcaggttttcaaacaaacagtatttttttttctcttctactatagcccttttcaaggaaattcagaaagctcaaggaaaaaaagaaagagagagagaaagggagggaaagtgaaggaaggaacaatggacgaacaaagaaagggagagaggaaatgttactgtgctgtgagatcatagtaatgataaaggaagaacccagaaagctcagaatgggaggaataaaggagataacttggagtctgatcaaaatcaacacctgctaccattcttgtgcctagagtctaagcctaggtattcagaatatatttacatctaagactaatgctattagctatttaccaaattcagaaaaactatagaagtgcaacacaatagaactcttgagcagtagggagaaaatatagacaaagatttatccactttaggtgcaaaaaataaaaatctacactttacattcatattacttaaatacaaacaaagcatattctactgcagcttcactacaaaagaagacagctccacctcttgaatgtctttgcattgtcagttcacaaactaccacctctcagcaatgtccactcatcagaggatgaatcacccacagagtgtattttcctgatagcatttatctactttttaaattactgctgagtccctgctccttcacctcctccttcttcctcaggaccaccacaataaacacacaatcgtacaccacactggactccaacggtacattagcgcctgttgatgagctgcctgcccctccagtcaatggcccctgtgactctgcttctctgatcttgtgcctacttagtatatctttcccactgtcttccttcgcatgctgtaaggtggccattcctgatgctctcaatgtgcctgtgtgtgtcccttaacagtccttggcacaagcaatatctcttcacggctccagttgtgcccaaatacctaagacatactttcacctcaggaagtcctactatgtcaaactcaccttccaccttgagcaagcgcctttctggactcccctacttttgctaatgctcgtactattttcctagtcaatcaggattgaaacttacaaattgttcttctccatttccttccataatccaagtatttgttaagtgggatgatgagaagttgggatgttaagaatgtatataaactgtttgaagaggcccatttggagaaagaggtaagaagtcaaacaatggaacattgcaggagaggtcccccaaaccagcaggctgtgagccgaatctgtttgatccacacagtgttttaagaattttaaaatttgtttccagcatttaaaatcagagtatttcaaatgaaaatccagatttccaacttctgtcaaaaagagagcatcagaaagtctggccttccagcccttctgcatgatattgatcaatgtctgcatccttagttggagacattgtctcagttcactccacctgcctctacttgactctgagcctaagagccaagctctatttatcatcatgcttgtgctgttatttttcttgtagtagagagaagagagtgaaacagttcttgtaataccaatgcctctactccaagtggaaaactaagcgggtcaccagcttcaagaaagaattcttatctcaagccctatccattcatctccctggccctctgtgcaaggccagattctgtctttcacaggccctaggcatttttgccttcttgggttccttcctccataaaaatattaaaaattatatttaattttaaattgttaatatggtattatgtattaataattcaagtaacttcttttcattttaatgcaatcatattggtataaagccagatatattaatattatatattaaaatactttctttgatgtaaaagttttttttccctttgatttggaaaggaatccaaacattttcataagccactaaaagcatcatgggccctgggcactgtggccacggggtgcctgataggtaagtgagcccagcccccatggacatttgaggcatgctgggtaacttctgaatcctcaattcacctgaatatctttgggatacacagtccgtaaccacaggtgaattcattttcagagcaagttctcctggtgcaattctgattctcatcgtagccgtcagtacaatccacatcgccatcacagacccaagactggggaatgcacctcctgtccggaggtctgtcatttacacagagaaactcggaatccgagcagttttgattctctgaaaccaaagcacgcaagaatcagaaagcatgagagctcagtgcagcagttaattctctttgctttaatgttacttaccattctaagtatgaaaggaaatgggaggaaaacacgtagacaaattacactgctattataataatagatcataataaaaatacctccaaagattccattttaattgctttggaccctggctttttcaaagaaatcaatacaataaaatgtctcatttatttttccataaaatacattagaatggtcatactttttcccttagggcttcagaaaaccactaccattttgttaactggataccgaatgccttatattttggtaactttttttagtttacaaagtataatcacacaagcacaatgtgaaataggtatttttacaccatttgtatagatgagaaaactgaagctcaaagatggttaactggatgtctcaaagtcatagaactaggtgaagagctggggcttcaaacctaggtctttctcctccaaatttagtgcttttccaactacattatagctaccaccccaagcaatattggggtggagaggaaaggcatatgctaacagagttgtcagaaaccatgatgctatgaggaaagaggtgagatgctgacatcaaatcattagtgtccacaaaataaaagaacaggggttttatccagactcattgcaggtgaataggaaacaaaagaaagaagatgatgttggtaaagacaggtgagagaaatgcatacaccacaatccatgtatgtgtagctgaaaaccacccatgtcagtggatagggtggatagggtaaatgtggagttgtgacccaccaccaaagtcacaacacaggagggtgccatcagatgcaagcagcagggagccattgagtctattgccctaccatagaaagacattattctaacaccgattagattaattcttgaactagctaagatttccataccctgttggtaatgaaaatgatgttccattatctactcaagaggcataacacccctccctccatgccgctttaaggtgacaaaggaaaccagagacagttcattgttatactgtgaaggttgctattaagagtggccaaccactgggtgcagtggctcatgcttgtaatcccagcactttgggaggccaaggcaagaggactgcttgagcccagtagtttgagattagcctagccaatatagtgagacttcgtctctacaaaaaaaaaagtataaaaaatcagccaggcatggtggtgggcgtatggtcccaactacttgggaggctgaagtgggaggatcgcttgagcctggaaggtggaggctgcactgagccatgataccgccactgcactccagcctgggcaacagagtaagaccttgtcaaaaaaaaaaaaaaagaaagaaagaaaagaaaaaagaaaaggagacaaccaagtatttgtgggttttttttttcccctagaaatgtaggacattatgtccattagccaaatgtaagagaaagaaagtaaacataaagtcatttttcatcactctgaagcatttaagtggatgatatcaaacactcccagcatggagaaacaaaggtaacattctatcagtgtccattcaattacagagaaatctgcaatcatactctccaaacacagaaaaacaactctactgtgtttccctggaatgtgactctgcagaggaattaattggcttcacttacgacactggtgccttttatcctcgtcactcatatccccacagtcattatcaccgtcacagatccattcgcttgggatgcacctcccaccatcacacttgaactcatcagctaggcatgttcgctcagagtgacctgaaaagatcaatagcattctcagtgaaaaaaagtggtttacagtccaggaatctggagacaagctggttgtagcatgggttgtctagaaaacctgaaacagagcattatttaattatatacatctagggtagtcctccaataagactagtaccagcgaccaacagtttgaggtaaaagtagtcaactgacagtgcaaagccctaattatctttggtgactaaaatgagatacaatattcccttatgtgtatggtagagaaagaacacttcttttcccaggaaagatatgaattacctactatttcacatgtttctattttaaaatctacttttcatccaaaaccattttgttttgtgcaaagtctcccctcgcctgcactccccatgcccgcttccttgctccctttccttctttccataacacttagcaccacctttcaacatactagacaatttactgattggttgcctgtctcccctctttagaatattagctccatgtgggtagggattgttgtcttattcactgacacagcccaaaagttcctagaacaccactgttcaataaatactgaattaaaataagtcactcttctacttcaaattagccatcactgattcagatgctctaaccctaaccccacatgttcctatttaactaatgaaggtgtcataggctcccaaacccaggggaccctggaattagcctaaggcaagagaaagtatagttgcaactgataaagacacagcctatatcataacagtaacaagaaacaggctctttcagaagctgctatgaaaagtgtgtacattgatccagacttttttttttttttttttttttggagacagagtctcactctgtggccaggctggagtgcagtggtgcgatctcggctcactgcaacctccgcctcccaggttcaagtgattctcctgcctgagtagctgggattacaggcgtgtgccaccgcgcccggctaattcttgtgtttttagtagagacaggtttcaccatgttggccaggatggtctcgatctcttgaccttgtgatccgcctgccttggcctcccaaagcgctaggattacaggcgtgagccaccgcgcctggcctgatccagattttttgaagagacatatctcctttgatacagcagcaccatttctggacatctagaccataaggatctttccacatgtgcacaaaggatgttcaccctgacactgtttttcatagtgaaaaaatggaaacaacctaaatgtccaaccactaggaaaaggataaaaatacatggaccattcgcattttaaaatattctttggcagtgtacaggaatgaggctggtctgtatttgctgacatgatgttaagcttaaaaaataaaagctaattgcagaaaatatgtatagtaagactccatctgtttttttaaaatctatatatcaagatatataaaagtaaagtaagatatataaaagataaaagtaagtcaaattcacactcaaccttttaatagtgattacctttgaggagtgaggggattggagaaggatgaaaaaatgtaaattttacttttttgtacatcgtattatttctttaaaatatatttctgaatattattactttactacaatgaggatatattcatatatagattatgtgcttatttttatttaaatatatcaggtcattggtactcactgctattactatggcttttgttaccatagagaagtttaaaaactcatattaattattcatatatttgaaccaataattcatacatttgaaacaatctctaagactattctactcatccagcagttattagttatttcctttacaggtcctcaaaactctatgtgccctttgctttctataaaactttcagtgttggggaaaaagaacttagtgaagcactccaaataccactcttcaacacagaatttaaacctgagagaaaactggaattgaaaatagtttgacttcagctataaaactatactaatgatcctaagaaaatatcctgaaaataaaatgttttaaatacgatgttaatatttactgcaatgatatatactatagaggaataaaataaaagcaacctaatgcttaataatagaggcagttaatttgatgatactataaccactcaatggaatattatagtcattaaaaggcagtatgaagacaaggacgagcaaactttttaactagatagtaaatattttaggcttacaggccctatggtctctgttgcacctacaggacgtggccatagtagagggacagcagccatatgtggctgcatttgagtaaaatgctatctataaagacaggcaactggccacagccatagttttctgactcctatatagcaatatgatttattgacaggttttttaaagcaatgtagaagattgtatttttatatttttacaattatgtaaaaaatgtgcatggatatagattagaatttgtgaaggcaaatagcagcctccaaatgtaaacagggcataactgtccccaggaatacaaccaaaggctcctgcaacttcttgggcctcttgtgctcataaactggcacagagagagaacaggaagaggatgcatgctcctaatatactccttccccatgtatatgactccaatcacttttaggtcctctgacagctttctgggccagcactcaaccaaattcagaaacttcaattgagagccaactaaaattaagttctaccagctaagcactgtattaggtgcatcaccaatataatttcattttatcagcatcaatcagcagcttccgtatcctgatcagctccccacacagtgctctccactaacaggtcttaatgaatatccgctgagcggtgtcagcattccagatgaaagctgggacaggaagtccaagcattcagcagccatgaccctggtctgtatttgaagcagttggaagagactgaagttgtctagctgcatcgtgatgtttttcatgcttgcttactctcttaccacaagaggcaggttcatcagaggcatcaaaacaatctgtttcttgatcacaataccaatgttgaggaatacagcgcccagatgcgcattggaactcactgctgctgcacgtgtgagtggctgcaggagggaaagaagataaaacccatgagcaaaacacaagcatgttcccatcagtcttaacaatctgcctctatctctgagctagataatagttaccaaaaaaggaagactgagcctggaaaatggatgcttgtgtaagctttctgtggggaggaagaagtatgggagacagaaggaagtcaatcctgccccaattccccaatttgtttttctagattccagaaatcaaaaaaaaaaaattgtatttgttagaaataccaaagaactatctttgtgataaatgaaatcacaaattataagtcttggttttattttttctactataatgtaagattaaataaattccattgcaatgataattaaaagcaaaacaataatgtgatcatatctaagctcgctccacacacaaccttttagctatgttagataataactctagaaagttggcaaagttatcttcgtattcatccttggaataccagacttttagttgagtaagtgggaaactctgcctatgtttgaacattgactcttttctccagtaattttaggtagctctggttatatgcattttccaaattgttatgtgggtgcacatctaattaaagtcttgtaattcttctggtctataaggccgttttgctttggcccctgatatctgatgatttgccaggggagaactgacaatggaagcagaggtccctgaaaagtcagcaataattcctatctgtctagccctatctggtggctgcaacctgaattctgcttccttgtgctgctgttattacaacagattcctcttcctgtgctgtaccctaatttggtgacaaataattatgatgccctttgatttccttgggaggggccagtgacaagagtttaactacatatacacagaacagggaagtccaatcactaaatccttaaattatgtatctatttacactaatagtctcaaagttatcaaacttaagaaaggccttttaatttgagctataaatacaggaaattgtttgaatgaaccaaattgctaaatacgaaatagagatttctgaaattccaacgtatctaggggatataaagatactttcagttactggtcaggcacggtggctcatacttgtaatcccagcactttgggaggctgagatgggtggatcgcttgagcccaagagttccagaccagcctgggtaacacagagaaaccccatatctacaaaaaatacaaaaattagctgggcatggtgtcacatgcacgtaatcccagctactcaggaggctgagatgggaggatggcttgagcacaggaggcagaggctgcggtgagctgtgatcacaccactacactacagcccaggtgacagagtgagactgtctgaaaaaaaaataattttcagttactgatggccactataataatattaagagtaaattataagggcttaacgggcaaattctgcctaagtacatgaaggcaaaaggctttcaacactgggagaaatggctctccaatagtagcagatctctggaagaaatattcagggtctgggaattctagccagggaacagagagaaagagtttctcatacccctgcaatcacatatgaaagcaactgcctaccacctctacttagaaggtcaatgtgaaatgacaattgaaatcagcccgaatacccacgcttcatatctttgtattagctcacaacatgcatctctggaacgatagaaagaaagcagttttatcttactcactgcaataagtagggttttcatcactgttatctccacagtcattgtctccgtcacacaaataaacgcgaggaatacaaatatttgaattatgacattttgtgtatccagactggcaagtgcgatcagcttgaaaaagacaaccagataaatattaggaatatatccaccaaatatgtattatgaacagtatccgtgctaacacatctattgtggaactcaaaccactggaagggcggcattttcaaagccatcagaaaggcaggatccatgatacttatgttacctatagattctgtagtaaaaaaacatatttccagctgatactggggagaagggagaggagacactggtttgtaacttaaatcatctgttttcattaattaatagcatcaacaagagttccaactcttggtaaaataaactatggcatttccacacaatggagtaatatgtagctattaaaggaataaagaagatttctatatactgataagtaatgacagtataatcttcaggatatattgttaatagtaagaaagcaagattcaaaacagtaggctaacttttgtgtaagaaaaaggacgatataagtgtatgtgtgtgtgtgtagcaagagagagatgcttatattaaaaacaataacaacaaagaaaagataaactaacaaaaattgtcatctctctggatagactgagaagagcacagaggaagcagaaaggagaggaagaaatgaaggacttctataaatgcacctcgtcatgtagttttaactttggaactatgtatgctattttgtacaaataaaatcaataaaataaaataaaatttggaaacagcaatagataaagctaactatatatcaggttgatagcataaccctgcagaaaaaaaaattccaaatatctttaaagtcatacctttgactgcatatctctagtgggacataatctaaaaagcaagaagaatctcgcacttagtagacttattgttaatagtattctttgagtggttataataatgttgaaattattataggcattttgaaattactatataataaaacaactaaatgtcaagagaaactatgattttaagcataagaagagatgtcattataaaatctaaaatgtaaacaacctgtaatcttaaatttcaatgggaaatatcaataaaaattttttctggccgggtgcagtggctcacgcctgtaatcccagcactttgggaggccaaggtgggcggatcatgaggtcaggagatcgagaccatcctggctaacatggtgaaacctcgtctctactaaaaaatacaaaaaattagccaggcatggtggcgggtgcctgtagtcccagctacccgggaggctgaggcaggagaatggcgtgaacccgggaggcagagcttgcagtgagctgagatcgcgtcactgcactccagcctgggcgatagagcaagactccatctcaaaaaaataaaaaaattttttttccttaaaaactgtatttcctagctctgaccattgaaaaggactagaagcaatgaaagctaagtaggaatgagcaactcaaccctgtgataatttctaagtaccacaaagggaatgaggtctccttggataagtggctaattccaggactgggacaggaaatataagacaagcttgagctataagaagatggattggggtcatgccaaagaacagaaaattcaagttaaggactcccattggcctaagtttggacaactgggcaccaagaaaaaacagttgacagcactgtattaaaactcatcaaatacatgaagatcaaagagttcaatataatactaaactaaactaaactaaacaaaaagttaattctcctttgtcaccaactcattactctgaaaattgacaagcaaaaggtatttatcctgtagattctaattaccaacaaaagctggtaagggaaatgtcttctttatcaaacttcagctaataaatgcggcaggaacactagaattctaaagagcccattcataactcttaaagaaataatgggtttacggaacaaccaccgatggatgctaaaaccactgggtgaaaggatgatgggagcttcataagagatgattcaggctgacaccagaatccacttaaagtggggcaacaaaacatcatgtgcctcataaggtgatgcaacaggaaaggcacagctccacctctgaaatactcttacccaaagaattgcacctgttatgatcaaaactctaggtctacataccagttcataggaaataagagggataagataaattaaatggatcaattatgcaattagtcaagtccagaatgtgagatattctacaggacaaatcacctaatctttctaatgaatcaatgacattaaaaagtgggaagtgttgtggcataaaagagattgaagaattataacaatcaaaatcagttgtagatctcatctgaaccctaacttgaacagagaacagtaaaaatacattttggggataagtgacaaaatttgaacatggactaggtactcagggatatttagtaagcacttttgattttgccaggcattataatggcatggtagttattttccaaaatgttatcagtgaagtgcatgactaggagtcactttaaaatactagaaaaaaggagagaaaaatgaaacaagattggtatttgttgatacttgctaccgcgcctagccaaaaatttacgttttagataaatacttagggtttttatttttggaaagccttttttttatataataatttcatctcctgtgatccaagacttcagacccaaaatcacaataagcacttaagataaacttacggcaatttttctcatctgaagtgttattatcatggcagttgtctacaccattgcagataaactcacgaggtatgcaccttctgttattgcacataaactccgtggtggcattgcagtccctgaacaggcaccctgcctcatcactgccatcaccacagtcattgtagtaatcacagcggtaagagtattggacacatcgcccattggcacaggtgaaggctgtcggtgagcaggtgtgaagtgctaagaacaggaaaaacatgagaacaaaccctcttgattaaaacattatcctaatttttaaaaagatacaattaaataaaagagacactttgaatttaccttccaaggcaaaaaacgctgcaaaatggactgcatgcaaagtgagataacacttttaattagttagattaagcaaaatatgttgtatacatttttaaaattgttttaggcacaaatcaagtaatttaagcacaaatcaaagtcattctgtttctctataatctcaatttatctcaatcacaaaaagcatgcaattatagtttatttcaggaaaataaaaactcctagcccctatcacagtctgctaggaaaaggtaaccaacctcagaactccctgagaaagtccactgtgttttattcactctattcagatggaagctgaggattggaagttattttcataaaatttttgaaataatgacctttgtgctacgaaaattggtaaaatgatacgtttccttagtcccaagctaagctagacttagcttgcaccatgcctcatgctaagggatttttacatattgtttctcttactcctcgcaagaaccctagtagtagctccattttacagatgagatgtctgaggcttgagatattaagtaactttcccaggtctatacagattacaaatgcgatcaccaggatgatgattgtgcttgtgctcttaaccactacagaggtgatttaacagaaacagtctggattatcagaggaaacatttttcagctctaccaggatgcctaggcacacatttcaaacacattcacacatagcaggattccataccaaacacttgacatcaagatgccattagctcctaccaaaagcgccaagagtccaactcaccacagacactttccatctcatcactgccatccccacagtcgttgtcattatcacacttccactcttccgagatgcagcgcccattggagcaggtgaaggaagatgcaccacatcgttcaccattgtccacaatgcagtgcttcctgttgttggccaaataccagttgccctcatgtggacactggcactcggcaccatttggacctgaagaaagataatcccagaagaagtaaaagatggatgcagccaccgttcacattgacccctccacaatagcacttgcaacagcttctacattaaatgctccctaagaagcgccatggaagttctgcccattaaccttttaactatattctgagtcacttttccatcaagaagagcaatcaccaatttctaataaatgtgccgattccttctaaacaacaggaaatatcaacgactcttctcagcaaaatttgcaaagcaacaacatcaaaaggcacatcttcccgtgaatttgttgttctttataaaatgcacaatgaagcacatatgatcccacccgcaaatatcaccagaaatatttcaaactataaataatacctcttaagcagaaaatgtaaatccttttataaggaaggccagctcattgacagaattcttagtcaagacatgaagtagggcagccaaggccttcatctttctttctaactccatcaagcttgtatttaaaatgccttcataggctgagtgctgtggctcacgcctgtaatcccagcattttgggaggccgaggtgggcaatctcttgaggccaagagtttgaaactagcctggccaacatggtgaagccccgtctctactaaaaatacaaaaattagctggacacgtcgtgtgcctgtagtcccagctactagggaggctgaagcaggagaatggcatgaacccaggaggtggaggttgcagtgagctgagatcccgccactgcactccagcctgggcgacagagtgagactccgtctcaaaaataaaataaaagaaaatgctttcataaaagggctccatatagattagaaaagaagcctgccaagtcttcctctcaaaatatagccccaggtctgtttcataaattaccctgacatcaaggagaatttgaattttttctcctgtgagaacttcagctttccttaccaattggtattgtgatcattattctccatgttctaattttcatggtcagtgccttacctggtgcacagatatggctgcagcccccattaaactgttcacaaggattgttacactgttgtttctggttcttcacaacagtgttgattcccctgggctgggagagcaaatttgtggtcattgcaatctgacctgacccgtcatatttgttagctcggtaaattctttgtgtgtacaagtcagtccagtaaatatactggccatagagagtcaagccaaaagcatgaacggctgcattgacaatgacttcacgatccacgcccgtcagagtgctgcgttcaatcctctgcctaaaatgaagcaaaaaaaaatttagaagttgaaatctcaagtgagttaagttttcaactggcagcccaatgcatgcgcctcatcattgtttacacaagctgcaaactttcttttcaaatggggcatatggcagctggaaatgtttcttctggtgatgggaggtcttgtttgcttatcaaacaatagcctatataaaatcattgacttccaaatatgaatagtaatcctacaaaaggaatcaggttgatattagaaacaggaaaacatgaaataatccatgtaatgcatggaactcagtgttaagcacatagcagactctcaataaaacaataacttttccatcccacttccttagtgactttttcaatttgatgtttattgagtaccttgaggtgtttacctagaataatccaagcttagactcaaagcatcactgctttgtttcaaataggagaataaagaaaagatcaggaggttaggtcttggcatcaaaagactaaaattccaaagaaatatgcaagaaaaattaagattcccgatatgtagacaccagccataataaacaaaatcatttcatcccttcaactattccattaggatgactggaatgtgagacatatggggggtacttggagaagttacatacaaaattagagttgacaaaaggaaaatattaagaaatgcgctgaggagaagcttgccagagaagaaagggtctatttgaaaagatgacaaaaagtcaaagactgaagaaaagaattttctttttttttttttaagaaaagaattttctaaaagacattgaatgctaaagcccagaaaaaaacataatatcaattggcatttaaaagtcattcagattttatagcagttacctagggcctgcagaatgtaagttgagtaatttcatttgtaattctaaattgagaaaatacatttataattatagctgaaattatagatatatttagcaatgcatctttagatgtcttttagttcataattattcaatgcatgatatagataaattttcacagtatgttcaccaagttccaatataaacatagttcctaaaactgtgattctatattctggcaatgtctatctggcatgctatattttcatcacatgatgcaaatccctcttctttggaaatggaagaaaaacctcttcttaacacccacatgagtaaccagagacacctacagactagcatccacccagtagagaaggtcctcttcatagtccagagtcagcccactgggcatgaccagactgctgttcacaatgggtacgcggaagtttcctcccaatgtggctctctcgattttggcatgtgtatcccagtcagcccagtacaggtacctagtcatacaaaaggagtcaataattaattcacagggaacctcatagtcctttaaaaaaaaaaaaaaggacaatattctttaattgcaaattgccagtaacatggcaaaagaaacttcatttctacttacacaacttgtccaaaggagatctagtaagtcagggtgttgacttcctagtatgttgccaacctttctgccatcaaagggagctatgcgctgcaccctccttcccacgtaaaatcactcaatatgctttcatttttgaatctgtagccatagttttataagcccataacacattggctatctatgaacataatttcaggccccattttttccagaaataagcagacagaaatataacaaggaagatgatggcatacccttggcagggatctaacacaattgctcttggttttggaacgcgggctatcacagtgcggttagacccatcttcagccatggaattaatcatctggttgaggtagtcactgtaataaattcttctagtaatccagtcaaaggcaatgccatcagcagtccctatacctggacacatacaggcagacacacacacaagcacacacaaagacattagagtctcatatgcattagaaacactcagtcatccatgtgtgttgaccccattgtgtctacttgcaggacaagcagcacctggagtgcacttacctgaagcaatgacagttggagtatggatccctgaagacagggtggcataggaaatctgtccaactccagaggctaaattttgtgtgaagtagattctatcacttacactgtcatagtctagagacatgacagttctttccacatttattgtttggaaaggtgggctatggttttcagggtccaagtgtaagcttctcaaggaattagacaaggcaaagatgaggaaattttctgttgaaatggcacaattcttgccatcactttgcagggtcccaaaggcacagtcacattttggggtgtgcaatccaggcagagcaaagcagagatgagagcacccaccattgttttccaagcaagggttgttgttgacctctgctggtgaccggggctggacttgcttgtcaaagatggtcacatctcttagccagttgatattgtctcttatcactgtgggtggctctgtgttctctggttccttgctggcttggaagatctttttcaaattcctatctacccatatgatagaattttcaaaaacagtgatgccataaggagttgggtaacgactgccataacgaatcacttcagagttctctccattgatacgaatccttgcaattatatctaaagaatcatcaacccaataaacgtagccatcacttcggtccactgccaagccccgtggtgtgacaatgccctctgacacaagcactgttcgattggtacagtcaaggaaagaacgctcaatctttggtctctgcccatagtcagcccagaagaggtatctgttcttgggatctacaacaatatgcctaggcatgtccactgtgactttaagaagaacacggcggtaagtagtattgatccgcagaacttctatcagtgtttcagaaacaaaggcattggtgaaataaagatttcctatgggaaaaatgaaagtgcatgctgatcaatggagaaccaagaagaaaaaaagggagaactttacaaattcagaacaaaatatataaggttgaagtctgggtcactatatgttgtcttttccaagatgatagtgtcccagtctaggcttagaaaaataagttcttactcctaggaattatagagattgtgtcttcaaatttagagagaaagtgcctatcttcagcttctaaagtagattagaattcatagcaacatcataacccactttctactgaaaggtatattttccagaatgtccctccttttctatctgaagctctaaatgcttaatacctacttgaaacactctaaatatacattttcatagcacaacttccatcccaatgtgataaaagtagcaaagagggagcaccagcagcatctcaggttgttattaatgttatcaaatggtctttgaacttaaggttaacatgaagtttttccttagtctttctaactaatgtaggtgttttcatcccatggaccttctaaaagtgaccaaaagtccatttccctttgggccttatgtacatgctagaataaaaagataactttatgaagatagtataataagtagagaatgaccacaaattattgatttcatgtagttgaaagtctgttgttgaactatcaatgctactaccaagacacacatattttgttcctatatctgattcaaaccacctctagagaaatcaggccaatgtgaaatatgttactgatacattttttcattacctaactctacttgctatgtatgcatttgctcatttccaatcctttaatccagggttggcaaactttttctgtaaagggccacataataaatattttaggctttgcagagcatatggtttcacaagtactcaacactgccactgtaacatgaaagcagccatagacaatacacaaataaatgggcatagctgtgttacaataaaactttatttacaaaaacaggcaacaggctgcatttgacgcacgggccatagtttgctgactactgctttatctataccctcagaaatagtaatttctattcaggaacgggagttaggaacccaattaaagctttatttaaccatacttccatatttactttttgcaataaactcttattatagtacttagattttcataatacatgcttatatttcctttttttaaatttttttttaattcgagacagagtctcagtctgtcacccaggcttgatggcagtggcttaatctcggcccactgcaacctccacctcccggcttcaagagattctcctgcctcaggctcctgagtagctgggattacaggcgtacgccaccatgcctggttaatttttgtgtttttagtagagatggggtttcaccatgttggtcaggctggtctcaaactcttgacctcaggtgatccgcctgcctcagcctcctaaagtgctgggattacaggcatgagccactgcgccctgcctacatgctaatatttctaagtgatgcctactcaccaagcttgattcaatgatactgattttatgtagaattggattatattccaaaacatataataccactaattatgagtggtatttttactcagatgagtgataaaaatgaggggttattcaagcttatgtgcatgaataaatacaactaagttaatataatactggaccaggcatttaaaaaaattactaataaaatatctcatgatctaagggatttttatatatgaataaaaggaagcaattaagaatttggcaactaaaattgctcagcttcaaagcaaatgaatgctgttccatagtttatatttttatatctctttctcttgaaaatttagaaaatttctaatgcagaaatcaggtgcaaatctaagtgtaaaaaaaacaaatccacataatttaatattttagccacttttgtctccagattatgttaataacagaagaaaatgataaggattaatttgttataaatctgtaaactgaaacaccgtatcatttatcaaatagacacgtagcttaatctagattcaatgtatcttaaatggtcttaataattgtctagaaaaacaaacctgtagcacatggagttaggctaaactttctagcataaaataagatgacagagatgcaaacatattaaaatcaccatatagcttacatacctgctacccaatccactgcaataccccggactccattttctcctattccatgtgtcacaatgttcatcagagaagatccatctggtttaattctacggatcgcattatcagatgccactgagctgctaaaatcacaccaataaataaagccagaggacacatccacatccacatgcagtgcgtttcgtcctggaagttaagaaaagatcattaaaaaatgctgtcactgaaattagaacttttaaatgtctgcccttcctctcaaaccctcattcccaaccccctgctctgagcatctccccattacaaaatgaaacccttttttcccagttgcagtgagcagacccacatcttggtttctactctttcccacaataaggagctctggctcccgggagaaatgttgattataggtttaggcagggaaggtacgaagtgagtgtgaaacatcttattgtaccaagaaacaaggcatacacagaaatatacaggtcgccacttgaagaggttctccctggccaaaatggatccactaaaacatcaaaagaaggattacagtaattgactgtaacacactgaatttaaaaaataaaaatttgagcccataataataataaattatttaaaaagtaaaccggggagacacgaagagctttcctttatagaagaatattatctaacaaatgtaaagggaatgctaaaataagaaaatcaccattttgcaatcctcgattaaataatcatttcaaacaaggatcatccatggctgccaaaaccaatgggtaaaaggtgcttgggagccaagacattcacagggcctaagtgtgattgcatagattccaccaaaattaagaaggaaaaaaaatacagctttaaaaagcagcagtgtagcagtgaccaccttaaccaagtgatcaaactcaaatgccactaagagcagggcaagctgacattatgttcttcctaataagattctgtatcaactaacacagcataacctataaagtattattgctaaatgtatttaaccttgatctaatcaagcaattagacctaacttccatttcatgagaactgcagggtaaaaaatgaaagacagactaaatattcagacaaatcctcagtgtgggattctcaaagacaacaggtctgcctctttaaaacatcaatgtcatagcaaaaagctagaggcaactactccaaactggaagaaactaatgagatattcccagtgcagtgcatgaatcttgattagatcttggatggaacaaaacagctatatataaaatattgtgaggccaactggagaaatatgattatgaatatttcataatgccctttgaaactgtatgctaacatatgtaggggtaaagtggcatggtattaaaatttatttttaaaaggttcataaaaaatgaatgtgaatgcatatgcatgtacacacacacacatacaaattgagagctcaaatgtgaagaaatgttaacaactgttaaatcttggtaaagggtataaggatatttcctaaatctttcaacgtttctgtgtttgaacatttttttaatgaaaagctgggagaaaaaaactattgaatttgtcatatctgtacaagatgataacttagatccataactttttagatatggaaaaacaaagatgagtcatgggtccacgtgaacatgaccatcaggcaggaggacgtgtgggactggaagctctctgattcccttctccaggtgcatttctgtattttctgaccatctctacaaccccttcattgacttcatccttttttccttcctttctaccctctatttctctctttagcctgtgacattctcctagcgatgttagaaaactcttagttcctcttgtgctaaggtatacctaaaaaccttggctcatctaggaagcaagtgatcgtttcatacattcacagtatgtaagcacaaagtgctgcaaaaatatgattactaaagagggactgacactgtgaactcttttgcttcaattcaccaaatatatattaataaatcatatttgtggactatttcattaccatattaaatagtagtataccttctaccataaatctccattaataatcagaaatagggcacagttctttggaacaccaactctgtagtacttcttgcaaacccatcctacattctatattgctctgggcctgtggttcttagcgtgatccatgggccagcaccgtcagcatgccctgggagcttattaggagtgcagattctctggccctaccctagactacaaaatcagaaaaatctggggacgaggtctggagctgtgttggcgtgagccctccaggtgattctgagacacactaaagtttgaaaaacactttaggctgtgccagttgatttaaagggaaaggaaagcttcattatgcactgaatccacacatgaagaaatgttttcatggcaccagggatttcaacctggtgccagatgaagtcaaatcttacttatattggagttggcataccttggcctgccaccggcaccatggtttctgaatgatctgacaattccaagctaaagcctctgattgcagacagcattgaaacaacaatgaaagagttatatggagagcaggaccgattatcaggattgagtttaaatccagtggcacaggcgcaggaaaacaatcctcctggtacaggcaggcaaatctgctgacaggcattcatgttgttgctacagccatttgaggattcggcggcatctaaatgaaaacaaaatccatttgtaacttttgatcctagctactcgccaccccatctcaaatttctttaattgggtcaccaaataatttattctaaaaattaataaccaacatatagtagctgagttagcaatctaaaaacaacatcggagagactagagcttatacaataacacctaaaggtatgaaaccagtaacccaactattgtataatagttagagaatggggcttcacttgttttcttctacaaatcatgcgaggattagggaggtcagtatataaatctgctcataatttgcctatgaactggcacttaaaataatatgttcagttacatgatcaataatgtgattttttttaaatatatgaaataagatttaaagaatagtcctggaattaatggcattcccagtgacttggaagaaactggagactattattcaaagtgaagtaactcaggaatggaaaaccaaacatcgcatgttctcactggtatgtgggagctaagctatgaggacacaaaggcctaagaatgatacaatggactttggggacttgggggaagggtgggaggggggcgagggataaaagactacaaatagggtgcagtgtatattgctcaggtgatgggtgcaccaaaatctcacaaatcaccactaaagaacttactcatgtaaccaaacaccacctgtaccccaaaaacctatggaaaaataaaaaaaaaagaatattctttatagtaataaaaaattaatttctattgcatgtgtttctttcacatgcagttaaaaaaatacctagtgacaaacttaggttataggacaggaaacaaattgtttgatcatctttggctgaagacgaaagctataaaatacatcaaaaaataatacctgtatcataccactaatttaaaggggtaaatcagaaattagattatctttgaaaaaaatgttgaaataggcaacatccaaaagcattctttttaagactaaaaattccatcccattagcactttcccagcaggcatccaactcatatgccctgagcaccttttatgtgccaagcactattctaatcaccgagtattgagcagcaaacaagacagacaaaatgcctgcccgtacagaggttatattctaataagtaacacaaacaatagaaaacagggagttctatgaagtaaaagcaaagtaaggaattgaaagtaatgggaagagaaagggaataaacttactctgaagtcaatctggcctttcagatgccaaattagcccttggcacttaaccatgtttaagacttcattatcattttttaaatatttcaggtaacttcaatttgtatgcacgtgtatgtacgtgaaactgtgtgtgggtgtgtgcttacaaatgtgagttatgtgtgaatatgcattatacacccatgaatgtatttcagtgacaaatacttactgcgtctgtgataaacttgaagacccctcagatttggaacattatctctcaagactattttgttggccccagtggccttatcaactctttcaatgacctcatactgttcatcagtataataaaggaaagaatcatggactgcaattccccaggggtgggaaagctggtgtaccaggatcattcgatctgttccatccacgtttcctctttcaatctaaaggattggaattttcattagtttcatggattcatagtgaaaattttgaacatttaaacactaatattctcctaattataatgtctcacatttatacagccctctatcccttacagagatttttcacttctattttctgatttgatcatcacaacgacaccaagcagcaggtcaggaaaatgtcactgtgcccctttcattgataatgaagacggagctcacatgagtcagtcaaccttttcaggtggcacggtgaagaaaagggagctaaaccactagtccctgcatgtgatattctggtcaaggatatactcaaacatctaagcgtgggccattgcacaggagctgactcaccctgagtttaacaccttcactgacaatttctgtaatggagattggaaatatgcccccaaacaaccacagaggacagcaagacaggacagggccaaaaatggtgccattaaatttgaacagataacaagctttaatcaaaatagctttggtacactggaaaagaactacaagaataaagtccctaagggaaaatgacaagtagtcagcttcttctggaagaaaaatgaaatgtagatgtagctggtttaatttcactccaaaaacctgcctcaagtgcctgctctgtgccaggatctgggctgggtattggcgagagacacagtgtggctttactgccatggctgaaaagggagcccagcagttacaagagtggttatgctgatgaaactgatcaaagttctagaatttagaatataagaaacatgagcctggaggagagagtggagagagtggaggccaggaccagattagctgagcaacctcacagaagtgttgggagctactcctcagggcaaggctccaagctgagccgtgatccaacttgctgactgtggctttatgaagaaaacatgtctccaacatgaaagcaggcttcaccactgaaggccatgcctagtcaaggccagagagaggttgctcagaatggtggaggtggcagaaaagatctgggcatgagtgacaggctgaggatggattgcagcatttggtgatgattaaaccaggagagtgaaggagaaataagggaactacactaggagaaaggttggagagtcacaccactaacaagcacgtagatttagaagctgtgccctgtcagatgtgtgtacagaaaccataccatgtaacaagagcttcctcgtcattgcacacatgcacccaactctgcaaagtgttttcacacacatcatcacttctttttaatctccaaagcttaccaccattataggtccatattcggagtgaagttagtacttgttgaacaaacaatgaactgaaagccaaacctactgcacaatattatgaaaagcatcaatgtcaaggatctgaagtaactactgttaaatagcaaggaagggactagcatatattcagttcagcacccaaagcaatgcttcatcaataattattattgagcattgtctatgtgcttagccccagctcagtgaaggtgaaatcctatttcaatgagtgaacgagactttatagtttctgcttcttattgtagaatataatgaacccaaccttggagttgaaaatcaccactaaagaaagtttcgcatgtgcattaatcatgttaaaatattagagaagaatgtgtagctacgaggggatgctgagttcagaaccttgctacgtaaataaatagatacatacatacatacacacacacataggtagatacatagaatatacctatatcctatacagatatataaattctatattctatatataatagatatatattctgtattctataaatatatattctatattctataatatatattctatatctatatagatcatatatagaatctatatagatcatatatagaatctatatagattctatataccatatagtatagatacatactctatattttttatatatatattctctccatatatataggtatatgtatattctctataattggagaacccagagtactttcaaagaaaaacactgaaatcactaaaccatgaaagaaatggctctgaaatgacaagtaagaaatgacaaatggaattaatttatcttgaagaaaaaaaaacgttggtggggaaattaataaacattaccctatagggaactatgcacatactataaagaactggacttcagctaggggcgaggtacgtgcaagggagagaagttattgggagaaggggcaatgaaacactggtacaagttaccaagtaagattgttcaagaaccactgcctgacagctcagaacactcagcatcagctacaccagctcagcataaagaccaaaagactgaaagggtgctcataccactcctcttccagtgactgcccagtagagtttctgctcttcgatgtcaagagtgacacactccaggtgttcgaggttcccagtaaagagagttttcacagatgtgccatccatgttagcactggcgatcttggcaggaaccccactgtcagttccttggtctgaccagtacagcttcctacaaccatgaaaaacaccagcatgtaacaaaacagaaggtggatttgagtcagtgacataaatgacaatgtgtattacttgtcctcaagatgctcacaatacaatgggcaaaggctgaaaatcaatatctcgttgcatacaacgtggaggggtacttcaccagtgttctaccaatgtcggtatatttcctagctataactggagtagaggccacttaaaatggtgtctggaataagaagctagggtatcccactggcagctgaacttttagcatggtcaggtgtgtgggaagcttatgacaaggaagaaacctacatcaataatccctccatcttcagtacatagtgaaggccaaagctaatataaaaagctgccaagtacactccctgatcacttaccaggcctcatttaattattccccaaatcaccatctaccacaagaccggctacttaattacctaacctgatttctgtgatgaaaaatgcaaagaattttgaaaactgacacagaaaataggagaaataatgagtaacacttttctgtgagagtggaatctcattatcatgctgttatggggtaaggaagacttcttttttctttctatttcacagcgatcaggtacacatgaaccataattaccacacagcattgccaaatccatgatatatgaaaatgtattaaaatatattaagggctgttttccatttccactgaagatgtaagttctagacttgaacccaacttttaattccttttgattgcacctccttctatatcttcaacagacaattctcctacattcttttctgaaaagtccttaaaccccttcatttaaatagtctttattcacctacctcttccaccaccaaatcaatatacccgtcctttgaatttcatcttcaactctaaacttctccgcctctaagttctcaaactctgaaatgctctgcttcgaccaaaacctctcatttcttccttgctttaacttttcctattaaacttgttctttgcccttaagccctgcctgagctcccaaccctccagttcttctacacctggacatcatatgtaaccatttcaacaatattcttatttattcttttgggttcccattgtgtctaagctaatctccaaccctgggtttctgcccttttttttctttctcctctcccatttcagggtaccaagagtttcctggacatagcacaaaactttcgtgaattctgaattcactaaaaatctaagttccctaatctaagctgaggattctcatccctagcagactttatatcatgttccgcatattgactatttcaagtcattctacttcataaatttcgaattccttccccataactttcactctcaatcaattatttcttcatccttgatctttcatctgctgctaaagaatacactcaggtttctctattctgaaagacattttcctgttacattttgacctacaagtttatctttctctaactttccaatacaaaattcttaaaagagtattcacatttcctcatcctccttccattcttttaacttctactatctctattcaacatcctctcttgaatatcatcagagaccctgtaactgcctcagctctttattagtgatcatccacaaagatatttttctgcaacaactggttcaataacatttatcacaactttatcaagactttctcttcactgagaatccaagatattagatcctcaagtctctgtcttgtttctcctcctatgtcctctgacaaaattctaagctcttctaattgtctcccaacccaactgggttgctcttagtcacttgaacaaaccctcaattttctgtccctttgctcttgaccttccatccttcatatcgcctgatatatcttaaaagctagctctgcccagtgaaattctaggtatgctttaagatccagtccaaatgatatctcttccaccaagctgaaatgtcacctctttatagcactatcatcccaatttttttagcctctcttgtggctcttaatcttatatgaatctgggttattgttatttatacacaggccttatcctccttactaagccataaatccttaaggttgcaaattaggtctttaatctttgtatccaccctctgaactccccaccatggccccatgaaagagactgcctccacttgccaaaattaatgtcttcctcttctctctgggtaaataggtggactgcatgtccttccgtgcagttagctgtggccatgtgacccaattctagcttaaggagtgtgagcagaagtggcgtgcactacttgtaggcctggctcataaaaacctcccagcaaatttctgaacgttctttcctttactgctcgaaagatcttgatactcagaatgacctaggaagcctcctactgaagatggcagagcatccatcagcctgggtcctgaatgactacgtagagtagagcttcctcccatcttctgcccaaaccccactgcccatataaaagacaaaaaaatttctattttctttgagccattacatatttaggagtttatttgcttcaacagttagctatcttaactaacacaccacccaacaaaggtacacaatgcagaaatgtctgataaacgaaaaacaaataatgagtgagcctgagtttcaaaagtagaatttcgaacctaagacagtccttcttctagaaagaataactgaaaactagtacaagccagcaggcacagaatagaatgtttgcttcttgtgccctttaaaaattggatttggtttccatgtcatccttatttgaaacagagcgctaatacaaattacttcttcagtgcccttctaggcctaagaatctgataactttcaaacattaagccaaaatccacttggaatgatgctacaatctctttaaaaaaaaaatcagtgttcatattttacaatttgttattctggtttataatatggtatagtagatcaacagaatgaaatagccaatcaaacagaccggaggactccagcctacatccattaagaccattttctcctaactggtctccctggccctggcctctctccacatcaatcctgaccaatttttctaaaacacaaatttggttctttcactcccttcctcaggattccttgctaggaagagaaaaccaaataccacatgttctgacttataagtgggagctaaacattgagcacacatggacatacacatgggaacaacagacactgtggactactagagaggggaggaagggaggagggcatgggttgaaaaactaactattgggtactatgctcactatctgggtacaatatacccatgtaacaaacctgcacatgtgccccctataactaaaataaaagttgaaattttttaaaaaaaatccctacttgctccttatcactcaaaagaataaagttcaacttcttagcatgatattaaaggccctccttgatttgtccccaaatgaccttatctgttgtatctcccatgtggtcaacagctccctactctaagcctctggttccggctctccccacaatcctgctaagtgccgccatacttctgtgccttcatggatcccttggcctcaagagtcactgcctggttgcaacccattctccacctactagaaggcttctcatcctgcaagctctattgcaaatgttacataatcccttagagctttccgtgtcctttcaaagtcagaatatattgtcaattcttataatgctattttaaaattcctaaaattcttgcttgtttggaattaattttaaatccagtgttgttcatttgaagaccataggacaaaatacaaacaatatcctgcacattaaatataggtcagagctatttctctttctcactgagatctattatttttcaaatgttgacatatgaaatcagaagatgtcctaaatttgaaatcttccattttgtcagaccctgacattaacaagaacaatgctgcatggaagacacgtgccatttatgaatactcacccacgagcaggatcaacagttatgccaattggaaagccaactccaagagctgtcccatcattggcaatcaatgtttttctgtatctgatatctccgtggagtgtcaaaacctatagcataaaatcacttattagaactgactttcataaggggaaccaaaggaaactgagatgaaggagaacttatgtacaaaacaaattccaaagcacgattagggatggatgagagaggatttgcatgagattcagataatctatattgcacttcagggaaatgaggaaattagctcaatagaaaatgagagtaagagcagcaaaatcacctcccaagttcctacttccaactcacctaaaatttcaggagggaacatttttatggataaaaggaagattcagttgggaaaacatacagagccactgcctaaagaaactgcaaaaatccttcaggagagctaagagaaatctctggaagacaaatgagaaccccacagctttcctgcaccccaccaaggcactcggtggccagttactgccaacacagttgatcaaaatagtccaaatttactcagaggtacagtgaattctgttccaagtcaacaaactaaactgaaacacatgagctgaaatctctgccctgccaggtcctgactgtacaatctgaggcaaataaattcacctctttgaactttatcagtcaaatatggaaggtctgcgtagaccttacgggactaagagataatacaggtaaagcagcacaccacccagcacaactatgttcaataaacttctattgtttaattggtccatctgttggtcacttactatatatgaggtattagagcaagcattattgtattcgatcctcataaacaattctgtgaggtagatcccattatttttctcaatacagatggagaaaaagaggcctacagaggtttagtggctttcccaaggctgtctgtgattattactgttataatcacagtgttaacagggccctgatacagcacatagaaatatagtttattggactagaaagaagtttcttacagcaatgaagctattttaatacgtacctaagacagtctaacagacaattagtaagaaattagaaaatgtctgttgatttttgcattaaggtttttctataaaattgcttttcaatacaaatagattatttgtgtttctctgtctctcatacatgcgtgtgcacgtgtgtgcacgcattcacacgcacacatacacacacacacacatatatccttctttccctcattcttttctctaaatttttttctctgcctattgtctggtatctttcactcttgcttggactaaggtagcttttcttttctcggtttgcctctttctgctacaatctctctccttttcctaagactaaggatctctttggttcacagttccttttcttgctttctggaatatatagagctctctctcacacggccattctgtaggcttcactacaaaattcagctataaaatttcttttagtggatgggaacacagctacccctagtggataatagtttcttcaatgtttctcttattttcaagttggagttaaacacgaactactcttaggcaggaaggaatattatacaggtaaacagaaagtgaatacgattcctattttcttaattaatccaacaatcacctggaagacttacttacaatttaaatgacctaaggggaaacaccagttaaaccattaaaagggcagtttgcccttggatcattattctcacaggtctttcatggattttctaaaaatattgatcatttgagggaaacagcgctctgtatttacaggatacctcagtgttatgaagtacttttacttcctcagccataaactccactgtacagatgagaaaacaggctcagagaagttaagtaatttgtccaaggtcgaatagctcatgagtggagaaaatgcagtgttgtccccagtcataaaatgcatttccatgtttcagggtctttattcaactgtttttctctcctgggacaccttttccctacgtcttcatttggcagaaataaaaacagtcatccccctcatccatgggggacaaattccaagatcaccaatggatgcctgaaacctcagatagtactgaatgctatatatactatattttttcctacatatacacacctatgacaaagtttaatttataaattagacatggtaagagattaaccataatctgaaaatagaacaattataaaaatatactgtaataacaattatgtgaatgtggtctctctctctctcctcccttttaaatatcttattgtgctgtactcacatattctcaggccactgcaggtaactgaaacctcggaaagtgaaaccctccgataagcaaggatgtattagtcatctttcaagactcagctcacaagtaaccatgaatgggaaatctgcatgctctctcccctcacttatacctctgcctccaatcactagcactttatattcaccggccttatcacacttatgacactggagcacaggtatttgtttatgtatccatctcacagatatgtgagctacttaaagacagaaaaaaaatgtttattcatcttaggatatccaggatcaactgatccatagaaagcatttcctagtgctcattaaatgaatgaataaaatgagcaagcaacccagactcaaagccaggtctttggactccaaatcaaaatatctttcctctgtaccacactgcatcagggcataattagaaacttttggttcatgtggttaaagtggccttaccaatccatacacacatgcacgctcagttattctccaactggccactactgcattgtacctaacactaatgggaaagacacgttccctgcttttggaaaactatcagtttaaaagaagagaaccccatttactaatcaagagacaaagagataaaataagagcatattaattgccatttggaattaagacagctttgcactgggtggactttagagagatgtgagtttggtagtaagggtcttaggcagtagatgttgcctgtttaatgggaggatgatagtcttagttgaaatcatgaaaaatattttctgccactgtcaaagagggttaaaccagtctggattgccggagttgtagtttataaaagtgcaaagagagaatactgctcaggaattagagcagtgaagctgaccatttaagacatcttcttagcttctgtgggccttggtttctgatgtaaaaaaataaaaataaaaaaaagagtttgaaccagaggagcctccaaggggcccttcatgttaacacctgataattctacctggcttgagatacttgtgcacactgcaaatttccctctcatcacaaatggctaccagaactgcctgccctcaggaatgttgtgaggattaaattagatgctagtgaaagatctttgtaaactcaagcgctgttccagtgagagctcttttctctgcctgggacaccttttccctatttcttcatttggcagaaataaaaacagtcatctgcactcatccatgggggatacattccaagatcaccaagggatgcatgaaacctcagatagtaccgaactctacataggctgtgttcttagtctacagagagtgctttttagtatagataggtgctctaaattagccagcaggctgctgtgcgccttgctcatcttcagtatctttctgaatgctccagagaaaaaccgtcttgccagctggtgcccacctaaagcagtggattgtcagggctctgctaactatccccctccaaaaacttctccttgttttgggaagtttcactttcaaaattattgtgaattaataatcccttccatgttttacccttctctcagagtggagcaaaccaacactagtcaagttacctctgacttacttcatgtgatttcatacctgtgcctcatctagaatttcttctgggaattagagtaaaaagaacacttatcttgaagaagagagtatcaaaggaattagaatcaagtttctactttctgttttgctgttagaaaaactgtactggagccatagaaagatttccatctaagaacagaggcaaactataaatttggttgagaactgaaatagcattgaagattagatgaggaaacatagtaaaattctctgcttaccataatcttccctttatgttgaattccttatgcaacttttatttatcttcttatatattattttgtaaattacctaaaacacttttatagcaacaaggtagtattgataattaggaggaaacaaaatagagcaatagaaagctcaaataatttatttttgccagccaggcgtggtggctcatgcctataatcccaacactttgggaggtcaaggcgggtggatcacttgaggtcaggtgttcaagaccagcctggccaacatggtgaaaccccgtctctactaaaaatacaaaaaattaactaggcttggtggtgcacgcctgtaatcccagctactcgggtggctgagacaggagaattgcttgaacccaggagccagaggttgcagtgagccaaggtcttgccactgcactccagcctgggcgacagagtgagactttgtctaaaaaaaaaataaataaataaataaaaataaatttaaaaaaaattttaaggtggttttcctctttcacttcagagactttgatagttaacactaatatcttttccctttttctttttgcttaaaaatgattccaaaatccacgtgagatctattcctgagactagagtttacatcaatctaaatccaatgtttgtgtaagtagtattatggaatcattacctcgattgactgagttctaggattggtagaataaaggtttcttgaaatccaatctaaggccaggttcatagaaggccccaccatagatatagaagcaaatactgtcctgttggtgccatctgtcttcactctgtgaatttcaccctggaaagaaagacaaggggaggtgagcagttccaaggccatggctcctacaaaagaaccctttcttcactgtggctactgccagctgctgtatttcttgaacagtccttacactcagaggaaaggcaaacaaaggttcagcaccactgggtaggcttcaaacgatttttcagtgtgtcacaggaatacacaaggcttaccattcaggctatctccagtactggctacagagatagttcttaactaccacaagcatacaagtcatgagaaaaacccaagtcacagatgtggatcagaagaccaggagtatattttgtatataggtgacaaacatgaaacacaaagatttttcttctcttcctcctttatagtcttcttgctctttccctattcttacaggttttttccctgaaggctgaagaaaatgacctctgaggaagagaactggagaagtgttcattcttaccctagaggcaaatattctaaaggattctaaaggaaggccccagcaccacatcaaatgctttcactaaattcccttagggagctactacttttatcttgagttttgatcatttttatattcgtcgaatattttctactagcttaagactcctctaggggcaagcattgtgactgctgcttcttggcatgtattctgtggttagaagcaggtaattcagtgcagggcaaatcataggcacttctggaaaatacttgctgaatgagtaaataatacacaatagcttaaatttgtttcttattctgaagctaaagagtgttatgatttttgctccaggccaagctcacatatatacccctcattgaatcaaaaaacttagggataaatttatttccacattgtttcccttttactcacatgacaaaagtttgcttataagaaaacatcagtgcaggcaggctcttcaagaataaattatatactttgaatgttattcaaaacttactggattttcaacccaatagatgtattgctcagcatcatcaaattcaacatctaaaccattctgtatccctgctatggggaccatagcatcattgctcttcacctcaggattaagggagattccaaaaattatatgttgccttacagttattaagaaaggttgatcatctgtgaaaatagaagaatatcagtcaaaatcatatcccactattcccagacatttagagtaatggaaggcaatagcctgttaccatcatatgggctaaaatgacattgcagcattgcagcaataaatataatgtacttcatcagacaagcatgggcctttcccagggtttcagtgggctgctggaccacaagacctccaaccccacatacaacgctgtctggactttttcaaggcaggttggtatttatcttactcttcattaagtccttacttacactaataaaccacccatgtttgctaaacctcacagacaggaagttcttccacttctacacacagacaaacctcactcacactgatctcagggaaaggagagttgagttttgaaaaaaaaaaagtgaaaaaaatcattgagactattcttgtgaaaggcagcttactagttttaagaatgttccaaaaataaaacaacactacaaagtgttgcctagtatttattgagactttaataaataaatccaatgtataatcctatcagttgttacttgactagtgtctctcttccctataagattttaactcccaaaggtcaatgactgtgtctgatttgctcattattgtgtcccagggcctggtactcagagcctggcataaaatagttgcccaataaatgtttgataactaaatggatgaccatatgactgcattaatggatgaatgtataagtgaataagtaaacagtatcttccaaagttctcaaaactgtctacacattgtaatttaaacattcccataatatcttaaactatcagttcacttatctccttaatagataataaaagttcctttttcaaaaataatttaatctttatcctgatccccatcaagagtggggttttaaaattcctctctgagaaaaggaaaacttttgaatctaagttttgggttaagatatatgtataagatatatcacatattaagacaaagtatgaaatgattaatcattacacaactttcataagctaaaaatgatgttttcattatttttataatccgggaagctttccatcttcagcaggatgacttggtcattttttctttacttattttcacatctcattagctttttcttgttcctatcatttctattactgagaaataacccagtctttattaacctaggacaaatttaaatttagtctaatgtaaatttcgcaactattaatgctttacatttttcaagtactacaatgtagagtcttccacaacaagcctgcaaagttgttttcagctggagcaaatgagatttgcaggagctctgtgacttctgcaggaaacagtaataggagatggaccctggctcattcacttccaggcccttcttctctcagctgctccacattgcctctcttctgaacaactgcaattgcaataaaaatcgcttctcattgattgagaatatgcgccatactgcatgcatcaggtaagtatttcccttaatttatctccctcaagtttcctaatcttgtttgttagataggtcctccctcaatttgcaaataagacacaaagaaatcaagcaatttaaacgaggtcacacaaccaggactcctggactccaaaatctacgtttttcatcactacactgcaaataccgcaggccaggtactatttcttgagtatcaaattaccactcatttcatttggtttaactgcaacagtaaaaaaaaaaaaaaaaatgctagattatgagtttcagctgtaccaagaaattatattgagatgatatttaattatttattgattatctgttattaatgttcactggctcagtagaaactatctctgtcccagttttatgggggactttaaatttttactcacttacgtaagatctgatcctgcccttttgaatgggtcatctccctttgcttaattggaataattctcaaccaaagcattgtttagggcctaaaaactttgcatatctcatccattatgcatgggccttcttgactcttccatggtgctcttcccttaagcaccacccgcttctactgcttcctggggatcatgtctcaagccctttatctgataactgctgatgtactgagaacgtttaccaccaatgaacatttgcaagcaatggaccagagaacaggatctcctgcaatgctgcgctggctgaaactgtgagcatcatggtgggggatgatgccaggggagtaatagaaaggaactggccagtaagacaacaggtggcgcagggagatgcctgaaaagtgctatatgggaaagcaaaaagaagtgacttcacaacactgcacacatttctacggagcaaacgggtaaaaatcagaggactggggaagtaacaaaaatggatattggagagcttgtcattcactcaacatttactgagtgccaccatgtaccacgaagtgccacaggcaataagcatacatctacagaccaggtagaggctttatcctcaaggaacgcagcatctagagggcaagaccaagtatatgagcccttacaattatgacaatggcatgaaggggtaggcacagaatcatctagggttggatggaaaggaattcaggaggtggtgacggttaagtaggtcagtgtgtctctgtcttttgaagttaaagatcatctcttcatttctattttccatgtcataatcccattaatgttagtgtcagcagagtcatgaagacactatagtcaggaatgagaactcagtgttgtaattgaacgacaatatatatgacccccaaacctaggtcctccttaagtcataccctgcacaagctgatcagcactgcagccttccctggagcaaggacaaggagtgttctcttatcttgcacaaaatcactgaagcaagtgccttgtgcccctgagaccgagtcagaagtctatttgtatttggagtaattttaggggtgctgaggtgatgtttggcttgagttttgtttgttcatttggttttggcattgtggggaatatattttctaaagaatttaaaaagtctcatacagagaaagcactcattataacataaaattagaaataagtagaaccatctcataattcccctatccaactgtaaccactattggcacttgtgtgtttttgcttccagaaacttgtgtgttttttaatgcatgtttttacaaggccaatattgtgcaatatctgcttcttttacttaacagcatcacagaagcacttctacatatattccagcctcttagtaaacactagttgaaaagctattcaacaatcaaatcaagtaaaatgtttccacctataaatgttaacaagttttctaaacttcttgttggggaaaaaaaaatgtggaaaccttttttcatttaacatatattggcaatcagttactcagctggtgctctgaaacctactgggaaatacttaaaaagttccacttcggtaaagtcaacccatgagaaaaccactagtggaattatttgtgaaacaacaaaaggcactatttaaaattaacacttatcaatcatcatcagagagtaatattgattacaccaacccccaatgtgcaattcaacagtctttgtgtgctgaaagaatgctttgtatccgaaatgtctacagcccagtttaatcttctcctgaaagactctaggaacacactaaattaaacaatgtcaacgaggattaggtacataataagtctctgaggaaaaatggcaagtgccagtccctctgtgagaattaccaataattaaaatctttcatcatgaaagtatcattgcacaatattacatgctgatggaatttgattttcagtaagcctacatctgcataatatctaaacactaaaagtttcctgaattcagtatatattttccattctagattaggactaaatttccttctagattaggactctattatctcttaatttaggaatatgtgatcattaaacatttaagttgaacttgtctacagcaattttcatcagtatcaaaatatattcattcagttctcttcactgagaaacgaaagggaacttgggtttagagtaacttcttagatttttaagcaataaggaattatatttttaagtgtattatatacaagtacacactccagaagaaatctcttttgtgaactggatgcaacttttccttcttttcttactcccttaagtacttggtataatcctccacacactcttcaatcgacccaataaaatatctctaggatgagataaatattaaattgctcagtcacttgtaatatctcataccaacacaattctccttcttaaagtatcagatggtaatagtaacagtactgaaattggagtcagaagacccaggctagaacactcattaactattggttataagaataaaaatgagacaatggagccaggtgcagtggtccacgtctgtaatcccagcactttgggaggctaaggcaagtggatggcctgagggcagaacttggagaccagcctgggcaacatggcaaaacccggtctctacaaaaaatacaaaaattagccgggtgtggtggcgtgcacctatagtctcatctactcaggaggctgaggtgggagaatcacaggggcccggaaagtggaggctacagtgagctatgattacgccattgcactacagtctgggcatcagagcaagaccctgtctcagaaagaaaaaaaaaagaaagaaagaaaaaagaaaaaaaaaagagggagaaagagacaatggacataaaaaatgaagctgtacacaaacgttgagaatgtttacttcttaggtgaagaatttggaacttcccattatcatggcttgtcagagaagtctaactgtacccaggtgagagaaaatatgaggttacagattgttcaattacatgcacagataacattagttccatatacagaaactgtattacaaccaaggcacacagtgacatcaccccatacaacacacatcattctgcagacacctgaggaatcaaaggacacagcacatgttcagtcgcaattggttttagagtttccactgcttggcacaaactatgaccagctccatcttcagagctcacataaggagcatactatacctctcaagcaattcaggagatcaggagacagactccatcctgaaggacaaacacaggagtaaaaatgaggcccctgtgaggaaagcaggcagagatggctgcagcgggaaaaggcacatggattcacggctgcatgagaaagagaagaaagcaccagtaagtggaaaacctccacattaaaatcaaaacagagtcatgctcttagtgtccttccagaggccccagtacaggggggcttaagtacgttgttacctctgttgttttcttttgttttgttttcactgaactactcacactttcaacttccctagcatcaggctttcaacttagaattcataagagacacgagagaggagaatgactcaaggttacagatcaatccagtctataactggattacgaacaaacagccactgagtaatctggaacttgtaatagaaatatgatgccaaataatctgtctccttacctgacctaaaagagatctttttgcattaaaaaaaaaaaaagttgtgtgtttgatgtgtgaccttgtagtttacctagagttttccagattttggttagataataatcttttatttttctactgatgatatctctgtgtgtctctgcaccttgaaaatcaggattctgtgtggtccccacacacaggatgtttcctagatcctatacatttttattacacataccatgttattaatagattattaatccattcattcaccagaaaaatggtaggtattcactgtaaaccaaacaccattctaagcactggggacgctataaaagtggagtatatattcgagcaaaaagaaacaactaaactcagagagagagagagaggtttcagaacatgagggtaaagagcaaaagaattatgagggggtggctattttaggtagagcggtcaatgagggcctctctgagaaagtgacatttgggtagaatcctaaatagcacgcgaagcaactcatgcagagatctggaagagagatgttccaggtagagggaagagctagcgcagaagctgagaggcaggagtcgcctgctgtgcttttggaccataatgaaatccaatgtggcaacagcgagtgggagaagagagcagggaaatagcagcagccacatgctgaagggtgtgagaaacaattggagagttttgaggagagaggattaagtgaagattaagtgacttatctccctctcccaccagaaagaacagtacggatgccaagtctttcacctagacacccataccatgcactttaggacaactcgtgctggctacagcagagcacctagaaggcagtggtgccataataaactagtcctaaaagtaagctgctttcaatcagagtggtagcggtaagaggatcgaaggcactatctggtctgtactccatttgtcagctgaggaaacggagactcatgtgagggtcaaagaggtagcagccaaatgctgaaatgatataattcagatgtgctgttattatatcctaggtttgaaatttccatggtaaataaaagtaatggcaatgtcaggactagggaaagtatatagtggggtggtttgtaaagagaaaaggaaaatgtattgtccaaacaaatgggtctgtaacagtgtgcatttagcattcccagggtcagtgtttttcaagctactcccaggcaggatgtttctctgtatcactcacaatttggttgtttcgaaggatgaaccgcaacaatcccaaggggccattgaatattatacattacaactgactggttccctccatgccacttgttggctcgcataacccgacgagtagcacggtcagtccagtacacagagtcttcaaagagagttagggcataggggtgccgtataatctgtgaggcagaagagaacagtgagacctcatccaaaaatcaaagccaaggtgcactgagtcaaagaggatatctgctcaagaagacggtttcctttaacatgtcattatttaataaaaacacaaggaagtcattgtgcaaaagagcggcaaaaaatacacaattcgtcctatatcccactaaaccattcaagagcctttcacatacacgtgccatttactctttatgtttgccttggtaattacactgggcatctattttacaaatgaaaacaaaactgaagcacaaaaagcaaggtgatgtatccggatcacctactagttaaaagttagatggaactagagagcttagagactcctcatctcccactcccacgccccagccttcactccaccatcagcacacttgtgccggctatttccacggtcttgtgctgccactcactgattcacatcaatctgttatagtttagatgcatctttccttcaagtcacagcaactatacaatagcaattttttctcttttttaaattgtttttaattttttattttttattttactttaagttctgggatacatgtgcagaacgtgcaggtttgttacataggtatacatgtgccatggtggtttgctgcacccatcaacccatcatctaggttttaaccctcacatgcattagatatttgtcctaatgctctccctccccttgcccccacccactgacaggccccggtgtgtgatgttcccctccctgtgtccatgtgttctcattgttcaactctcacttatgagtgacaacatgaagtgtttggttttctgttcttgtgttagtttgctgaaaatgatggtttccagcttcatccatatccctgcaaaggacatgaactcattcttttttatggctgcatagtagtccatgatgtatatgtctatcattaatgggcatttgtgttagttccaagtctttgctattgtaaatagtgctgcaataacatatgagtgcatgtgtctttatagtagaatgatttatattcctttgggtatatacccagtaatgggattgctgggtcaaatggtatttctggttctagatccctgaggaattgccacactatcttccacaatggttgaactaatttacactcccaccaacagtgtaaaagcattcctatttttaatgggggtcaataacagctctttgataaaatatctattttctttattttcccatttaacttgtgaaaataaattcaacagaatttatagaataaaaaatgttatgtgaagaacaagactgagaaatataaatctagttaatttttgttttttttttttttgaaaacagggtctcactttgtcacccaggctggagtgcagtggcacaatcacagctcactacagccttgacctccctgggttcaggcaatcctcccacctcagcctcccaagtagttgggactataggcaaacacccccatgcccagctaatttttgtatttttttgtagaaatggggttttgccatgttacccaggctggtcttgaactcctgggctcaagcgatccaccaacctcagcctcccaaagtgctaggattacagatgtgagacaatgtgcctggccaagttaagttataaatttttgcttgaaaaaaattttttttttttttgagatggagtctcactctgtcacctaggctggagtgcagtgaggcaatctcagctcactgcaacctctgcttcccgggttcaagcaattttcctgtctcagcttcccgaatagctgagactataggtgtgtgctaccacactggctaatttttgtgtttttagtagagatgaggtttcaccatgttggccaggctggtctcaaactcctgacctcagatgatccacccacctcggcctcccaaagtgctgggatcacaggcgtgagccaccgcgcccggccacctgacacaatttttaaaggtatagaagcaacagattcacatctgcagctcaactaaatcacacgagctataaaaatccttcctggatatggcacaagctgaccatgaactggaatgaaaatattcattttccagttagtcatatgggatagactgcctctcactgttgctggtatttcctggattgatctgacaatgtctatgacacaaaaattaatttcttagcttttctgatactcgtctgatttctacctatccacgactgtagttttaatttggttttcctcaccaccaacttaccaaatcactggctatcacctgtctccgatggtgtccattataatcacaaaagtccatgtaatcaagataggagtccatgaagtagagcagtctgttggggtagtcaatagttaagccgcagggccagaagatcttgtcctggacaatgacagtgcgcatgctgccgtccatgctggctcgctcgatgcgagggtggtggccccagtcagaccagaacagtagatgctcactgggaaaggaaatgagttaccaattggaggggacgtatttaaatattaaaaataactgtcattttaaataatacaacatcctgtttatgccctgcttaaaataaatcatctctggttcagaatatattcacagagtttattgtttcctctaagtgtcacaaagtaaaactgtcataacacaatcacaacccatctgggtatttttataatgttcataaaacatgtaatacataatgtcataatgtagtacattatgacattgaaatgtctcaatgccaattcatgtttgtttataatccacaaatagttgatctagaaaaatccatctgtccttgtttgtctaccctgtcatgtttttagataaggaaatcaatttattcttcatcaggaattcatcataaatttcagtggtgtgtaatactttacaatatctaggaattcaacatcacattgaacataacttgcctaatttaccatcctgcagaaaagaatctaagttataaaatataagtaaattcagggaaagaaatcctcaaagatttccaaacacatgggagaatttctctatcttcccttcaggatcagcaggcaaaaactgccttccttatatgacttaaaagggagctctaataaacaacataaaactgaagcagaaaaatccagcttttttgttgtataatcatgagttatcaaagttacatcaaactggcccctctatggactattactgcatgcagtaattagaaacttaatttttaattatatgacatttcaaaaattgtattgccaagctaataaatcaatgtgctcttaaaataaagtaaacaatcaattgctcttatgtactttatgaagaggatgattcagatgaaggagagatagcaacacccagttggacacctaccatgtttaaacaagggatcattttaaattttgcatatcagcaacatgcatatcagctacatcatgttactgttgtttttccctcatcataaccatgtcaaggcaacataattttaaaaaaaagtcttacttcattctgggatctaatgctagtcctcttggatttgttaggtttttactaatcagcacagtcctgtggctcccatcaattttggagacttcaattgtttccagagcatagtctgtccagtaaagattacgacctacccaatctattgcaatagtttcagtcaagatgatgctactgtcaaatacctaaagacaaaagtgaataaagagtgaattctagagcaaataaatgaatgcaaacatggatattatataaaaatctagattaaaccatctaacttgtcctataattacttgtggggattagaaaattttgtctcctcatgtagctaaccaccaaatcaacagcagggttttctgagaaaagtatacaagattttgtcacactgaacattctaagatgacttcattgtttggttagtgcatagtttcgttttggtttcaaaagtttttgcaattaagaaaaagctctatccatttgcttagttggcaacattacaaaatgttatagtgtttgcatgcaacgaataatatctctattaattaaggaccaagaattacaaaataaagttgtaagaggcagaggaaatgtaactatcaggagccaagaaactgaaattctgggagatggattgagaaatatcactaaattaaagctaagaaaagcaaccccttaactttcctgcactttcctctgctctcatccacaagaaaagactgcaaaaggaaccgtaaagacattgtgaggtctctgcatcacctgacctggaattcagaatcacacatctgcattcagaggccaccctcctatctaaaacagccataaattcgtagttatgaacacgcaagtctcttgggtatgatgtggcccagaaggtaccatgagagctacccagatgaggtagggccttctctcactggtgaataacagcaaacagacccaagacagaggaactagccaggccaaaggtcaacagaaatgtacttaccactcttctgtccgttccattttgaaacgcactccaggttttaccctgagttgcatcagaccaaaagatacgaccactaattgaatcaaaatcaacagctacaatgtaagaaccattctcgaccaatgaatagatattgtggacctgggaggtgacactgtcggcaataattttgttctgacttgccacaagtaacagcagactctcagatgctgttcaagaaaaaaatgcaaaaatgtcaatgatactgggagaaaacacaaaacaactctttaaaacttttgattcaatacttttggtaacagaaagaaggtgtaattccaaactatagtaagttggtggggaggggaggaagccccatatgaatgattttaatcacttcattcttaaccttaatagttagctggttttcatgagtacttaaaatagactctttcttgggttatatttaactgtgtttctaaatactagtctagagtaaactatgcttacattcttccttttactgtatttatttttgtactttggttatcttccttactatttaataggttgtaggcttctggacagcaggaatcatgtcttaaatatttctgttttctgaggccctcagctatggtagagagttctaattctcccaacaccccctctcttctttttctttttagtaataaagcatgccaagttttagcttggcacagactctccagccagagacatttctctccctccactgaagtttggagtgaccacatgactaagttctgaccaataggatgtgagtagaaattacgaatcaaatctcaggtcacattctaaaaaggaagctgcttgccctccactttctctttccccttcctactttctaagagaagctaaaacctggagcattggaacccttgatgtaagccacatgatgaggataacagagcagaccccatgccctggactctctgacatccagactcctactacatgtaaaagaaagaaactttctgtttttgttttagcttcctctatttggtcactttgaaagtggtcaaatcaatatcctaatacatagtaaaaagcactttcttatagcagaaattgaattaatactggttgaattcaattaagcattatataaagatgcttaaatatagtatagaactcattttaaattatataaaagccatttggtattattttaaatactttaaaaatcattgacttgtatatgttttaacctctattttccaaaatacaccaggattttaatgtgtattaccccatttaatcctcacaaaaaattgaggtttaaagagattgcataatctttccaggattcaagtcgatctaactcctaatcaacattgtcaaatacctacatgtgccatttgattttaagctctgggatgtgctgataaactggctcgggttagttcagcaattacctgtaactttgcaagtcctcccatcactttctaacatgtagcctgtatcacacgagcaccggaaagaacctctcatattgtaacagtgctggctacaagagcctagaatatcacattcatctatgtcttcacaggtcttagaatcattggcaagtaagaatcccaatggacataggcatttagccccaaagggctcttgaacacactcgtgagtacaaccaccattgaaatctgagcagctgttcccatctagaaaaaagaaagagaataatgaaaaaagaaaatcaagaatctttgcttctttgattcactcttatgcaatatttattatgcagtctcatgccaccttcaatatgatgcccagacaagagctaagtgcagcatgcacttgggtgagttccacaggctgttcagggtttgctctaatttgtctgaggatttaccatccttcatatccattggagtatgatcaccttcttcactacaacccaatagtataactccatttaatgcaatgagaacccttgggaaaatattgttgacatcaaggaagaaaagtgtcattgatagagcatgcaaagacacttaaaattgtttctcgttttcttcctctgaaattctactatctatacagaaatggaagatagacaaacatttaagagaaaagaccagaaaatctatgaagtgaacaaatcaaaggggaaaggtcattgaaatattagagtacacagatccggtaacatatcgtcatgccttactttcagggccaaaatgaaaatgcctaaagccaccctaagacagttcacatgcctggggatgcaaatgccttctatttccatgtgtactctaacatatttgtaagagtcataacacagaacatgcgttagaaagggaagtaagttaatataatcaggacattttcagaacaaacacaacacatatgaaatcataagaatctgaaatacttcacaatcatacctggctggggttcatctgagagtgagcattgattaaagaggaaagaaagaaatgacagtaattaggattacatgccaatcacagcactttaatcacagcaacacaaatccctggacttcatttttttgtgataagttctgattgaaattagaaaatattaaagttagaaaaattaatgagcacattaccaacagaaccaaatttaatttgacaatctaatggcctcaatttagtctcattttttgaaacaaagacataaaaagaagtaaaaacacataaccaagtacaaaggatttaatcagaaaattatccaatggtgatgtatttgaattcaattatggttaccccctacacagatgtgaactcatagaggaactgaaatccttcctacaaagctacacagtgactgtgacaatggtgatgcacaccaggctactgttcagaatgagtttatggccagtaaactgtggtcaggaaacttactgcaaagtggggactcatctgtcccattggggcagtcaaagatgccatcacacactacactcagattcacacagatgttatggccaagacactgccattgccaactaggacagcgaaagggctgagtagggcagtccttctcatcactcatatccccgcagtcattgtcccgatcacagagccatgccctgtggatgcagtttccgttgtcacagtggaaatatgatgaagggcaagtcttggggacacaggcattgtgctcatcagatccatagaggcagtctggatgcccatcacattcccagaagttcgggatgcagataccatcttcttggcactgaaattcatctgagtggcacataccaggaggcctggttgctagaaggaaaacatggggtaaatcggcttgtgaatgtaatttgtgatcccttttatagtctagactcagaggaaatgattttggatccaatagtaggtttatagtaacaactatgaccaaattaatatttaaggctaaatgatatagagtcttctcccacactctagtacatagaaatatttctttgtggcagctagtggctctgacaacaaacgaagtacagaacgcacaactgctgactagcagatgagtacctgtgtcaaaagaacatcctgtttccttttcctgtgtttttaatgtacttccaattgcagattcaataataaagtttatctatctttctatgaaagaatcaccagaacattacaatagagcttaaatagctatgattactttgaacttcatgtgtttcatatcatgtttgggtgttattattttccctcagatgaactatacctaatgaaaccatcacacactaactaaagatgatggtaaatactcagttctttgcaaactttccactattcatcaagcaatcctggagagatacgtaagaactgcttccctatttgacaagggtaaaccaaaactctctaccagggatctcacaaggcaacagcaagccagcggcaattgacagtttaacctcagctcatcacagaattttatgtttttaatgtgaaacaggaaaattagtgattagtaatttctagatgttgtgcaaactataaagtatataagcattttatttaacttttctttttaatccatggctttacacactacctttctgacgcaggaggagaattcatgaaaacttacttttttggtctaaaacaccattgttcaaacaaatgatcaactcactgatgagtttttgcaagtctaaaatccatttaaaacaaaaagtgggcaaataacaaatcatgtgagtataggtttccagtctgtgaagattatagatccatcagaattatactgtatgaagtcctacttgaatcctccaactagaagaaatttcttttctctgaacctccatagaattttatctgtgccatttctaagacccttgtaactgtctatcttgcttaattgtctcttgccttctataatctccatagataacatcttagcagatattcaacacataatagcacaaagaatgaattcatcagagtcaatactaaacacagctccataccatttctacaccatgatatgacttctctactgaaacttaaaagaaaccagtaaaatatctttatatggagtagagcctcaaaagtttaaacctactaaagtgggaagtcctaagaaaaactaaaagtgaaaacaaaaatatctaagaaatatttagcccatctaagagactatttgaagtgtccatttatacaaccacttgatttgttaattacacattatatggcaatgtctactcaattttactgtatgttcaataccacattcctttgaggatactttcccccagtttgtctgagttagggaaaatgtgtggcaatatcaatatcaatactggcaaaaatgaaatgacccctttgtctgaaacattctgggtatgtgttacttacgacagcctgcttcatccgagttgtcactgcaatcaaaaacaccatcacaacgatttgtgacgccaatacatttatccccactggcacacttgaattgagaagcagtacagtttaatactaagaatgaaagagaaaagcattagaaattagctcagggctaaaatgactaaacactgagatttttcttttttgttgttatactttaagttctggagtacatatgcagaacatgcaggtttgttacataggtatacacgtgccatggtggtttgctgcacccatcaacccatcatctacattaggtatttctcctaatgccatcccttctctagctccccaccccccaacaggccccggtgtgtgatgttcccctccctgtgtccatgtgttaacactgagatttttctaaataaacattgtgaataaaaaagaaggcaatgcacttaccacaaccaacctcatcagatccatcaacacaatccttgtcaccatcacagacaaacgataggtcaatacatcgatgattggggcaattaaactgactaggttggcatgtctctgtcgaatctaatgtcatccgaaaacaaaaccaacaagtttatttcctgtgcaacaagtaccagagccaaactaaaaatggctaaatagctacagaagttatctcaattgtacatgggttcaaaattcttttgaatcagccacactatcaaagtcagctaagcaaaagaactcaaaactaggataggttttagaattgagaataaaaagattacagggcagagtcagaaactgtgattacaccttggaaaatagaccacattcagaaagtgagcatcatgtgcttggacttggactacatttcatgaatactatgaagtccatgactctagaccaaagccaagcaatggagcccaatcaggcaacaaaaccagcatgacccacatgcctagtagcaacagtgtgtagacagacccccaaaactggatttaaaagtctgaacagaacaattctaaaaaccagggtcctaccttactgttaagaccatagccttggagtcggatgcagtggctggccccacccacaacatgaaattatattaaatacacacttatagggtatgaaagctagaagggatcttaaagctcatctattccaaatgatagtgacttgcctagtcaggcaaccaggactagaacttagcccagggaactttgctccatcttaaactattattgaagacatgaaataaaacaacaagctaaaggaaagcagaactggcaagatggaaaacaggtggataagatcaaaggaaatttaaattttctgtgcctctttattttgatgtctttttgcttgtaccaaatgaaaaagaaacatcaatagccaaaggtctggatatatctatatgacttttagtattgttttaaatatataaatagatagctgagggattttcactttttcaattcctatctgaattgaaatgtttggcatcagaggcagtccttgctttgcttccatagaactcaatatttgtaggtggactctaagaatcccatgtgcaggcacgtgcctttgttcttgtaacctattgacacagagattgacaagtggaatagaagtactaaagagacaatgaaaattgcatgagccttagaggaaagaatgcaaggccatttggttgttgaagtctatttacgaggctgaccaaccaagggaaaccagctcaaaacttactgcagttcttttcatcagatccatccccacaatcattgtctgtgtcacagacccagttctttgagatacactggtgattatcacaggtgtattgggtgtcaaggcaggaagcaggtgcgtgggtggggcagttgtgctcatcactgccatccacacagtcgttgcgtttgtcacagcgccagtgtgcaggaatgcactccccatggccacaggtgaacgccgaagatgaacaggtattatctacaatagtaacaaactggtcatgaagacatttgtttttacagccttttaaatgagttcttgccttataaaggctcagttcaccttttttaatggaggcattgtatataataaggagaaatgttcatcaagtgatgtcatcatcactaacatcattattggctggcatttatttggtatttatcatagaaaaggcatttttctaagttatgcacccacacacatcatataagttctctttaaatcctcacaagaatactataaagtacatataattgtctgcattttacagataaggaaattgagtctttgagagatttaggaacctgcctatgattcacgctctggttggattcactctaaagctcatccttaactttcaagctgttacttcctccaaccacaatttcaaattcagactatagaaagcttgaaaatatgtcatatgaaaagtgcaaatagataaaatattaaggtaaaatgctgtgctcttagaaacaagaagataatacacaaaaagatgaaaatttaaaaaatttcagaaaaatgtacaagtgagcactttactcttgcaaatctgtcactcctctttctctccaaaagaaaggttattattagtattaacttcaccttgatagagatttctgagatttcaactgtcctctatcttttttttaatttgaatgtaatacttttgccttctgcaatagtgtttattaggccccaaactatatagactagattaccgtcaaaagaagaatataaaggttaagaccaccatttcattgttaatttattttactctaacatgggagaaaaggaatataacacatgagattttccaaaggctatgattgcaagtagttattctgtgatactattctctcggttgctaaatgttaggtctactttatttttggtttttgttgttgttgttgtttgtttgcttatttttttgaggcagggcttcactctgttgcacaggctgaagtacacggcacagtcttggctaactgcagcctcaacctccccagctcaaacaactctcccacctcagcctcccaagtacaaatttttgtattttacaaattttgtgaaaatacaaaatacaaattagctgggtgtggtggcatgtgcctgtagtcctagctacttgtaattttgttttttttgtattttgtaattttgtattttgtaatagtcccagctatttgtaattttatatacatatttttttctgagctcatctatttcttttttatttatttattattattatactttaagttttagggtacatgtgcacaatgtgcaggttagttacatatgtatacatgtgccattttatattttttgtagagaccggatttcgtcatgtttcccaggctggtctcaaacttctggacttaagcaatcctcctgtctcggcctccgattacaggcatgagccaccttgcctggtcagatctagtttatttcgatttgactttttgaggagtttgccaagacataatgactgcattggtccaaacagccaatgtcaaggaaaaaaattgttgaagatagtctaaatcaaggccagaaaccatccataacattatgaatgaaatttcttgcttagcttcctaaaagccttcaaagtgcatgttaagaatctgaaattctaaaagatatttttcccatataaatagcccaagcttttatttattttctttaaagcccacctctactctattcatcccaggaaatatcgccagtgcatagctacttactaagtgtgccacatagttgctcatcactgttatcatgacaatcatcgactccatcacagagatagtaattgggcacacatctgccatttttacaggggaaggaaaataagccacactgctctgtgggtggttcattggttgggtccccctcgcatgtcaagtgattggaagccagcctcattccataagggcacccacacactcgctggaaatttggcaccgggaagcagaagtggctgcagtcaccgttaggatgcgtgggttgattacaggcgttagaacctgcaaaagcaaagccccgagggagtcagtcatgtacattttcactaggtaggtcacgggtttgatttgtgaaggaaaacaaacaggacaaaacatttttcagacccaatactaaaaagtagcttcctcttggaaatcaacccgccaaatacaacattccatttaggtatggaaaagtcccaaaatgtgtttttcctgacaacatgtttaaggctagcagcattgaacagagatttcaagtcttacactcttagattatgtgaacgacaagaatataaaactaccaggagctagacctttaagtaataagtacttaaagagaacaggagccactgtaacaaataaataaacccatacaaaaaaataaaaaaaactgggcaatctcactcaccagtctggatgttgacatcatacgatttcaaatgcagtatgtaagcaatgccacttcggataactgtcatttctccaccatctgctttcctgactcgaataatggcacccagtctccagtcagtaaaaaataaatgctctgaaaagaaacatgggtagattagtattttcagtcacagctaacttataaataaatcacttgagaaaatgcaataggcttgaaatgcttcttgcaagtacgatcatctcccccataaatatctgtaatatgtttctctaaccattttccacgacttgttactccctagtaatgctctgtggaagtctgtatgttaataatatcagggttcaggttcaggcaagcacatatggagttttatgatggcatttagtagcaattggatttagttctgcataggtaatagtgaaaataagaattggggaattcttctacagagcattaaatgaggcctcataggtctgcacccgctaaagcactcacctgctgagtgctcttaggcaaatactacgctgtgtgaaggagacagtctgaatcattcctgagatccttcccaggtcaaacagttcatattctatgttttaatgacagcgcttaaattgtaatttttttcccttgacttaaataagaagctgttgagaaggaaaagtacaggtctagcccaaaaaaggaactttcagtgtatgtttgaggatcaataaaaatctcaacacaagtgtggattcacctacaaccacactactaatgttagaatgatgctcacaatggtaagagagaggcgacataagattctaaacaacaaaaatttaatcatgttcactttacactaactattgcagcaggaaaataaacatatatttttaaaagaaagaattgcatcaatgtggattttctctttaatgatagtttaactagaaaaccctaattaatcagaaaatgtttaagatgtcataaattttatttgaccaatttccttatctgtggtctaatcaatgaccaatcagtcattggactccctaaatctttctagagcctggcaatcccagtcccactactaacaaaggcatcctcatatacttaaataagtaaggagttcaataaatcttttagttctgtgtggtgcacaatcaagaagatctagccctttagtaaaaaggtacacaatttctatggtgttgcacaacaaaagaactttccaaaagaaattcacaaaaaacagcaatgttgaggggaggagccaagatggccgaataggaacagctccggtctacagctcccagcgtgagcgacgcagaagacggtgatttctgcatttccatctgaggtaccgggttcatctcactagggagtgccagacagtgggcgcaggccagtgtgtgtgcgcaccgtgcgcgagccgaagcagagcgaggcattgcctcacctgggaagcgcaaggggtcagggagttccctttccgagtcaaagaaaggggtgacggtcgcacctggaaaatcgggtcactcccacccgaatattgcgcttttcagaccggcttaagaaacggcgcaccacgagactatatcccacacctggctcggagggtcctacgcccacggaatctcgctgattgctagcacagcagtctgagatcaaactgcaaggcggcaacgaggctgggggaggggcgcccgccattgcccaggcttgcttaggtaaacaaagcagccgggaagctcgaactgggtggagcccaccacagctcaaggaggcctgcctgcctctgtaggctccacctctgggggcagggcacagacaaacaaaaagacagcagtaacctctgcagacttaagtgtccctgtctgacagctttgaagagagcagtggttctcccagcacgcagctggagatctgagaacgggcagacagactgcctcctcaagtgggtccctgactcctgacccccgagcagcctaactgggaggcaccccccagcaggggcacactgacacctcacacggcagggtattccaacagacctgcagctgagggtcctgtctgttagaaggaaaactaacaaccagaaaggacatctacaccgaaaacccatctgtacatcaccatcatcaaagaccaaaagtagataaaaccacaaagatggggaaaaaacagaacagaaaaactggaaactctaaaacgcagagcgcctctcctcctccaaaggaacgcagttcctcaccaggaacagaacaaagctggatggagaatgattttgacgagctgagagaagaaggcttcagacgatcaaattactctgagctacgggaggacattcaaaccaaaggcaaagaagttgaaaactttgaaaaaaatttagaagaatgtataactagaataaccaatacagagaagtgcttaaaggagctgatggagctgaaaaccaaggctcgagaactacgtgaagaatgcagaagcctcaggagccgatgtgatcaactggaagtaagggtatcagcaatggaagatgaaatgaatgaaatgaagcgagaagggaagtttagagaaaaaagaataaaaagaaatgagcaaagcctccaagaaatatgggactatgtgaaaagaccaaatctacgtctgattggtgtacctgaaagtgatgtggagaatggaaccaagttggaaaacactctgcaggatattatccaggagaacttccccaatctagcaaggcaggccaacgttcagattcaggaaatacagagaacgccacaaagatactcctcgagaagagcaactccaagacacataattgtcagattcaccaaagttgaaatgaaggaaaaaatgttaagggcagccagagagaaaggtcgggttaccctcaaaggaaagcccatcagactaacagcggatctcttggcagaaaccctacaagccagaagagagtgggggccaatattcaacattcttaaagaaaagaattttcaacccagaatttcatatccagccaaactaagcttcataagtgaaggagaaataaaatactttatagacaagcaaatgttgagagattttgtcaccaccaggcctgccctaaaagagctcctgaaggaagcactaaacatggaaaggaacaaccggtaccagccgctgcaaaatcatgccaaaatgtaaagaccatcgagactaggaagaaactgcatcaactaatgagcaaaatcaccagctaacatcataatgacaggatcaaattcacacataacaatattaactttaaatataaatggactaaattctgcaattaaaagacacagactggcaagttggataaagagtcaagacccatcagtgtgctgtattcaggaaacccatctcacgtgcagagacacacataggctcaaaataaaaggatggaggaagatctaccaagccaatggaaaacaaaaaaaggcaggggttgcaatcctagtctctgataaaacagactttaaaccaacaaagatcaaaagagacaaagaaggccattacataatggtaaagggatcaattcaacaagaggagctaactatcctaaatatttatgcacccaatacaggagcacccagattcataaagcaagtcctcagtgacctacaaagagtcttagactcccacacattaataatgggagactttaacaccccactgtcaacattagacagatcaacgagacagaaagtcaacaaggatacccaggaattgaactcagctctgcaccaagcagacctaatagacatctacagaactctccaccccaaatcaacagaatatacatttttttcagcaccacaccacacctgttccaaaattgaccacatagttggaagtaaagctctcctcagcaaatgtaaaagaacagaaattataacaaactatctctcagaccacagtgcaatcaaactagaactcaggattaagaatctcactcaaagccgctcaactacatggaaactgaacaacctgctcctgaatgactactgggtacataacgaaatgaaggcagaaataaagatgttctttgaaaccaacgagaacaaagacaccacataccagaatctctgggacgcattcaaagcagtgtgtagagggaaatttatagcactaaatgcctacaagagaaagcaggaaagatccaaaattgacaccctaacatcacaattaaaagaactagaaaagcaagagcaaacacattcaaaagctagcagaaggcaagaaataactaaaatcagagcagaactgaaggaaatagaggcacaaaaaacccttcaaaaaatcaatgaatccaggagctggttttttgaaaggatcaacaaaattgatagaccgctagcaagactaataaagaaagaagagagaagaatcaaatagacacaataaaaaatgataaaggggatatcaccaccgatcccacagaaatacaaactaccatcagagaatactacaaacacctcttcgcaaataaactagaaaatctagaagaaatggatacattcctcgacacatacactctcccaagactaaaccaggaagaagttgaatctctgaatagaccaataacaggctctgaaattgtggcaataatcaatagtttaccaaccaaaaagagtccaggaccagatggattcacagccgaattctaccagaggtacatggaggaactggtaccattccttctgaaactattccaatcaatagaaaaagagggaatcctccctaactcattttatgaggccagcatcattctgataccaaagccgggcagagacacaaccaaaaaagagaattttagaccaatatccttgatgaacattgatgcaaaaatcctcaataaaatactggcaaaccgaatccagcagcaaatcaaaaagcttatccaccatgatcaagtgggcttcatccctgggatgcaaggctggttcaatatacgcaaatcaataaatgtaatccagcatataaacagagccaaagacaaaaaccacatgattatctcaatagatgcagaaaaagcctttgacaaaattcaacaacccttcatgctaaaaactctcaataaattaggtattgatgggacgtatttcaaaataataagagctatctatgacaaacccacagccaatatcatactgaatgggcaaaaactggaagcattccctttgaaaaccggcacaagacagggatgccctctctcaccgctcctattcaacatagtgttggaagttctggccagggcaatcaggcaggagaaggaaataaagggtattcaattaggaaaagaggaagtcaaattgtccctgtttgcagacgacatgattgtttatctagaaaaccccatcgtctcagcccaaaatctccttaagctgataagcaacttcagcaaagtctcaggatacaaaatcaatgtacaaaaatcacaagcattcttatacaccaacaacagacaaacagagagccaaatcatgggtgaactcccattcacaattgcttcaaagagaataaaatacctaggaatccaacttacaagggatgtgaaggacctcttcaaggagaactacaaaccactgctcaaggaaataaaagaggagacaaacaaatggaagaacattccatgctcatgggtaggaagaatcaatatcgtgaaaatggccatactgcccaaggtaatttacagattcaatgccatccccatcaagctaccaatgactttcttcacagaattggaaaaaactactttaaagttcatatggaaccaaaaaagagcccgcattgccaagtcaatcctaagccaaaagaacaaagctggaggcatcacactacctgacttcaaactatactacaaggctacagtaaccaaaacagcatggtactggtaccaaaacagagatatagatcaatggaacagaacagagccctcagaaataatgccgcatatctacaactatctgatctttgacaaacctgagaaaaacaagcaatggggaaaggattccctatttaataaatggtgctgggaaaactggctagccatatgtagaaagctgaaactggatcccttccttacaccttatacaaaaatcaattcaagatggattaaagatttaaacgttaaacctaaaaccataaaaaccctagaagaaaacctaggcattaccattcaggacataggcgtgggcaaggacttcatgtccaaaacaccaaaagcaatggcaacaaaagacaaaattgacaaatgggatctaattaaactaaagagcttctgcacagcaaaagaaactaccatcagagtgaacaggcaacctacaacatgggagaaaattttcgcaacctactcatctgacaaagggctaatatccagaatctacaatgaactcaaacaaatttacaagaaaaaaacaaacaaccccatcaaaaagtgggtgaaggacatgaacagacacttctcaaaagaagacatttatgcagccaaaaaacacatgaagaaatgctcatcatcactggccatcagagaaatgcaaatcaaaaccactatgagatatcatctcacaccagttagaatggcaatcattaaaaagtcaggaaacaacaggtgctggagaggatgtggagaaataggaacacttttacactgttggtgggactgtaaactagttcaaccattgtggaagtcagtgtggcgattcctcagggatctagaactagaaataccatttgacccagccatcccattactgggtatatacccaaatgagtataaatcatgctgctataaagacacatgcacacgtatgtttattgtggcactattcacaatagcaaagacttggaaccaacccaaatgtccaacaatgatagactggattaagaaaacgtggcacatatacaccatggaatactatgcagccataaaaaatgatgagttcatatcctttgtagagacatggatgaaattggaaaccatcattctcagtaaactatcgcaagaacaaaaaaccaaacactgcatattctcactcataggtgggaattgaacaatgagatcacatggacacaggaaggggaatatcacactctggggactgtggtggggtcgggggaggggggagggatagcattgggagatatacctaatgctagatgacacattagtgggtgcagcgcaccagcatggcacatgtatacatatgtaactaacctgcacaatgtgcacatgtaccctaaaacttagagtataataaaaaaaaaaaaaaacagcaatgttgaaagaaataaataattattgctattttgggaatgttgtgttgtcctcatgggtatgcattcaaatttttttcatactgatgaaaccaaaagatactaaaactacattttctcgaatcccaaaacatcccagcccagagcagagaaaattcaactttttataatgtttctatgtgacagcaaatagcatgtgtctgacatcattagtgaaaagggagtaaatggatggcagcggcgggagggggacgggaggagtatttataattaactcatcaaaaatctcatgagcattttttaaataccacacactcctccacagataaacagacagcaggacaagatatgcaatatacttactaactattcattccacacatacattctatgcatgtgagaaagtctttgatttatagtgagtgtctagtcttttcaagcactgtgttaattattcaaagtaggaggtttcaaccagggacacaactagcatatacacagggcttttggtagacttaaacaaaacatgacccctctaactggagtaatcatggtttgtcaaacagacccaggatagatttcagtgtctcctcaccctcttggcctggcatttttatgcagtgcacaagctatacaaccattcacagagctcctgttttcaagactaagcaaaccacctgtttcatggtaccaggctacattcttattcccagaaactcaactcacagcagcatgcctgcactcaaatggggagctgagaagacaggcaagcactggctgtgctcattgtgactgtagttccccagaattcatgcttctcagcaatcttcactagtagcatgaaattatttggaaaggttgacgaaaaaaaattatgtcttgctgttcttcataaagcataacctaacacttccataaaacaaagacgatgtcagttctccaacattttgaataaaaaagtttcaaagtcattcagtcagcatatagttgatgaatatgtgtaatcgttttttccacaaggatttctaatgagattcttacaaacactggagaataatgaaatgctacaatgattactataaacagctcttgctgttttattcttgaaaatgaaggcagtaatttactgtttcctcacgtgatacttgtataactaagtacttgggatgttgaattgtataatacatgtaatctacaaagtgctgtacccatatacactgtcaacattatacgaatatatacaaaacaaaaatcacactctaaaaatgaaatacaccatcaacaaaccaaatgttttgtctaaatatatagcaccattttaaattttttcattttaaagtggccagcttttctgggattgtgaaaatgccacatgaggatgagtttactattgtaacttgcaatgtataaaaacaatacatacttttattgctttaaaacatacctccaaagatggcaagtccaaacggatgtgtcatctgctctatatggcccagtcttcttctgtctaaaccatcaaaggtgctgtgctcaattttatcaaaataggcatctacccagtacaatcgtgaagcactaaaataataaaatatttagttatctcttatccaaaaactatcagagcaccctttacacaaagggcatccaaaaacagtagggtcagttgacacatttattaaacaaagtttttaaaatttaaattatattcattaaaaatttaacagttttatgtcccccagaaagagacggctacttttcatgaagtggctttcaatcaattgtcttagaaaacttaaaatgttgctatctttgagccagaaattttattttctccttgtgaaatcaacaagttaagaaaaacagtggtagtaatctatgtttaaaaggtgaaatatatttcttccctttttttctcccataagttaccttggcatttcatctttataagcttatttactctattccttttcctatattcctagatagatcatcaatttcttgagaaccatagcttatacttttaaagtcctcccaaagtgcatgtaagcaaaggtgcatttgttgattaattgactccaaagatttcctaaactcaagatgttccctgtaagaaattacacactgcctacagttcaacaaatctgtaccctactttaaatgctgcttgggacccacctcccccatcttgagtttccactaaatcttgtcattcagctttctctagcaattttctcagaatactcatgaatttattagttttcaccccagcagtagctggccaactatgtttatgtcctttgtgttcttgttcaatatccttctcccatcaccaattaattatttaaaattccgcgagggcaagcagtaccagtttccttacaccatcatatcacccaacctgcctcattatgtgttctgcagtaaaagagaactaagtatcggggatgatgattcctacttacgcccaatcgatggccaagccattgggccatccaagagtagtgtttattacaggcaagaggtgagatccgtcactccatgctctcataattttagcaggacggaaccaatcagtgaagaatagatacctagaaaaagcagtagtaaattaaggctgttaacactgggacaaactacatgacttccagagatttagaacaaacagagattctccagatactgcaattaattttgttttctttatatgctattgaacttaacatacttagtgtataactcatgtaattctcagttaaaatttagttaacatgtaaccaaagtcacaaatacaaatggcatttaaatgggcattgagagaagagaaccactgtctcagagtttaggaactaaaactattgtcgcctaacatattctctaacaagacacaattcaggttacctattaaatattccacgttattaaaataaaataataaacaacgaacagagcaagaaaacatttcaatctctttctctctagattaaacattcaggatcctctagtcattcttccataaggaattgataaatttgcaggaaaccattcatctcagatgaagaaagcatccaaatcaatgcaatgcaaacagtatctgacccaagcatttttttaatattctaaagagtgggaaaaagataagtctagaggcaaaaaaaaacaaaaacaaaaaaaaaaaacacaaaaaaaacaaaagaaaataaaaaaacaactttttctcttttatgggatccagaggaatcaaaattattcttttccaaaatgtaactttctgaaatgtaactacttcatatcattttaaacaaaagagtcatcaggaaaggaattcaacagtttttcaaaaccaaaggccaaaagtttgagttaagacaaattcattaaaaaactaaactgtttaactctctatagggcaatgaaatttcttatcaataataacatcagttttaaaatgtgtttcttttattatcttacagagaggaaattaaagcagatactctagatgcagcaaacagacttttttaggcacacaggcattccagtcagacaggtctggaatttgaatactgactgttgcctaatagctgcgggccctttcacaagtcactttatctcactgcgccttagattcattctctctaaaatgggtatttacacatacctccttcacaaactagctttggaagctgatgagattatatatctaacggaagaacaggtatggatgttccctgggtaatcaggcattggtgggttagcagccatcttttttatcattccactcatatacaacacatagctcagatttgttctaaataaacacagtagctgttaaacatatttaaataagaaaagtaggaaccaaaaaggaatactgtgaactcttctgtctttccttgtctggcaccaccaattatagaatggtaaaacatgaaactttgtggtctgaaaaactttttattctgaaaactactgaatgattaagcaagttttgctaagctttatataaatatattaaagcagggaaagaatttgggtctttcctgttaattctgttgcctattcactccttttctactgaatctatatcacattgtttggtcctctgcaactgtgaaaaaaactactcttcagtgaagactgagaaagccaaaagttagaagaaatgttttgggtttaaaaacaattttttttactcccccagaataaagttttttggaggaaaaaagaaataaaatttaaggtgatttcaacttatacagttcaatcttatatttgctgaacttacctaaatccctagggcatcacttttcaatgactgtaaaagacatacagtttcaagctcttaggaaaacatgaacacacttacccggcaaaaggatgaactaccaccgaccgtgggttatttaaatactgaactactgtgcgtctcgttttatcagctagcctcatgacactgatactcttgtaatgagagtctgtccaatagagattctttgaaatccaatcaaaagccaaactttcaacattttccaccctgttagctgcgagaatttctcttcctataagttaaaatatggacatattttaagctaagtatattttgtaaggcatcaattttcctactaatgcacactgaaattttgtgtcagagttagagcatatttcaggaacacatgtggaattctttaaaaaaaaaaaaaaaaaaaaactctgtaagctgctgagcaataacatgagacaaacctagaatctatccattcctcaaactttggatctcaaagagtagatatgatactgacaaacagaaccaggaatggtatggcctggatttactcccatgtccaaccttccagaaaaaaatttctcactgtagaatatctgaagaagagatacctgagttcacctactaccacccggagacggctctgataagctgacaccaccaggtacgacctgagggtaaccctgaggtatcatcgcccaaccctctcatcaacagtcttccacagccacaaagttgccaagttttgaaaacaccagcagagataccagaaaggaaatcagaactgattaaaaacaacaacaacaaaaaaaaaaaaacgctttcctctttatggagttattatgctttcttttaccctcttttttctttttttcactaaagaaaatctgaatcagaataaacagccatacctctttcttttgcagtaggaagaaaaaatcctactactttttctcttcatttattcagcaaattgtgaaaagaaagttctctatgtgatagaaagccaactatatatttagaaaacacaatattgttagtagtgttaataatcacagcttagattaaatgagcacttactaggtggcagaaactggaccaagtattctacatggattcatccatcctcacagccactcaatcaagtaggcattagtatcgttcctattctacagatgagagaaccaagtcaaagagaagttaagcatctggaaagaagtgtggacaccaccctcaaggtaattcatagtgaggtggtgaaagaggaggaggcaactaggccaagagacaaaaataaaagagtaatgagtgctgagatggagagatgcataggatggtctgagagcacagattcctaatgggccacatggcaaagcagaggtctggggtggttgacagacacagagactgaaaactctacatgttctaggagtgtggctggaggttaatgagttaatgatagaggctaaaagagagggagatgttcatgatgaccaccaggtggggatggggcaccaaggaaggggtgagtggtcatgcccttcctctaaggcctgtgagaagttggatgaagcatccacttagacatgttggtttagaggtgattgtaggatatccaggtgacgtatccaaaaggcagctggcactatgggtctgaacctcagagagagaacttgcatagagatttttatcatgacctacagaaaggcttgcttggtctttccctcattccccagtttaggaggaaaaacactcagtaaatgcactattataaaagtctccccataattatttatagttgctacatagatagtaatcaaaggcaggaaaggtgtgaaattattcagagagaggaggaccaatgttgaacaacagatttacagttttttatagaacaggagaaaaagaaaagatctccagggtacactagaaaaaaaaaaatgatcaagaaatagaaggaaatccaggagtatgctgtcatggaagaaagaatatttgagagaagatggctgaagtaccaaatacaggactgataggcattatttaatttagcaagaaagggattagaggtgaccaggatgagaggggtgtcagccacctggtgggcagattgcaagaggtgagtaatcagtgagaaatgtggaagaagggataggaaagtgcaaaacaacctttcaagaaacttgaccatgaaatgcagagaaggggttatcactaaagaggaacatggagtgaagggtaagttgcatattttttaggatgggagaaacttgagcatatctgatgatagggaaaagtcagtagaaaaagagaatttggaaaaaagaaggtatcattgaaggagggagttctcctgagggcttcattcagctaatcctgacttttaatatgatttctttttctttttctttagagacaggtcttacctaggctggagtgcagtggcacagtcatagcccactgcagcctcaaacacctgacctcaagtgatcctcccaagtatctggcactacaccacaccaccacattagctaatttgatttctgacaactcatttcctgcatatactgtgtactcattcaaaaaaaaaaaaaagaacaatgtaatgcctccctcaacaaagcatacagagtttaaccactgactatgaggaatattttaaaaggtaggttgccaaaaagagtccaggaccagatggattcacagccgaattctaccagaggtacaaggaggaactggtaccattccttctgaaatgattccaatcaatagaaaaagagggaatcctccctaactcattttatgaggccagcatcatcctgataccaaagccaggcagagacacaaccaaaacagagcattttagaccaatatccttgatgaacattgatgcaaagatcctcaataaaatactggcaaaccgaatccagcagcacatcaaaaagcttatccaccatgatcaagtgggcttcatccctgggatgcaaggctggttcaatatacgcaaatcaataaatgtaatccagcatataaacagagccaaagacaaaaaccacatgattatctcaatagatgcagaaaaggcctttgacaaaagtcaacaacccttcatgctaaaaactctcaataaactaggtattgatggggcatatctcaaaataataagagctatctatgacaaacccacagccaatatcatactgaatgggcaaaaactggaagcattccctttgaaaactggcacaagacagggatgccctctctcaccactcctattcaacatagtgttggaaattctggccaggccaattaggcaggagaaggaaataaagggtattcaattaggaaaagaggaagtcaaattgtccctgtttgcagacgacatgatggtatatctagaaaaccccatcgtctcagcccaaaatctccttaagctgataagcaacttcagcaaagtctcaggatacaaaatcaatgtacaaaaatcacaagcattcttatacaccaataacagacaaacagagagccaaatcatgagtgaactcccattcacaattgcttcaaagagaataaaatacctaggaatccaacttacaagggatgtgaaggacctcttcaagaagaactacaaaccactgctcaatgaaataaaagaggatacaaacaaatggaagaacattccatgctcatgggtaggaagaatcaatatcgtgaaaatggccatactgcccaaggtaatttatagattcaatgccatccccatcaagctaccaatgactttcttcacagaattggaaaaaactactttaaagctcatatggaaccaaaaaagagcccgcatcgccaagtcaatcctaagccaaaagaacaaagctggaggcatcacactacctgacttcaaactatcctacaaggctatagtaagcaaaacagcatggtactggtaccaaaacacagatatagaccaatggaacagaacagagccctcagaaataacgccgtatatctacaactatctgatctttgacaaacctgagaaaaaaagcaatggggaaaggattccctatttaataaatggtgctgggaaaactggctagccatatgtagaaagctgaaactggatcccttccttacaccttatacaaatatcaattcaagatggcttaaagacttaaatattagacctaaaaccataaaaaccctagaagaaaacctaggcattaccattcaggacataggcatgggcaaagacttcatgtctaaaacaccaaaagcaatggcaacaaaagccaaaattgacaaatgggatctaattaaactaaagagcttctgcacagcaaaagaaactaccatcacagtgaacaggcaacccacaaaatgggagaaaatattcgcaacctactcatctgacaaagggctaatatccagaatctacaatgaactcaaacaaatttacaagaaaaaaacaaacaaccccatcaaaaagtgggcaaaggatatgaacagacacttctcaaaagaagacatttatgcagccaaaaaacacatgaaaaaatgctcaccatcactggccatcagagaaatgcaaatcaaaaccacaatgagataccatttcacaccagttagaatggcaatcattaaaaagtcaggaaacaacaggtgctggagaggatgtggagaaataggaacacttttacactgttggtgggactgtaaactagttcaaccattgtggaagtcagtgtggcgattcctcagggatctagaactagacataccatttgacccagccatcgcattactgggtatatacccagaggactataaatcatgctgctataaagacacatgcacacgtatgtttattgcggcactattcacaatagcaaagacttggaaccaacccaaatgtccaacaatgatagactggattaagaaaatgtggcacatatatgccatggaatactatgcagccataaaaaatgatgagttcatgtcctttgtagggacatggatgaaattggaaatcatcattctcagcaaactatcacaagaacaaaaaaccaaacactgcatattctcactcataggtgggaattgaacaatgagaacacatggacacaggaaggggaacatcacactctggggactgttgtggggtggcgcgggaggagggatagcattgggagatataactaatgctagatgacgagttagtgggtgcagcgcaccagcatggcacatgtatacatatgtaactaacctgcacattgtacacatgtaccctaaaacttaaagtataataataaataaataaataaaaataaaaaaattaaaaaaaggtaggttgctcagcatacgaacttgaagtttaccaaaaatactatgagaattccagatcaacaaaacagaaggaagctgacctgtggaggtgcctgtgggagacttggcctgcatgcagctagaaacccaatactaccttttcctgagaactaagctcgactgcagtgctccaagctcagtgggcctgattctaagtcctcaaaaaagataatttctcattcaaaatagcagattgacaaaccaaacatgtttatctcctcttcctccgaaattctacttaaaagacagtaaaataacagcagatgagtaattccaacaaatgtttgaaaagtaaggtattggaggagtgataactcagttaagaaggggaaaatgctacaaactaagtgtcaacagaagagagacacacccacatatgcagaagcctcagtgcactcacactcagaggcaccaggtcctaacaaaggcaggggcgaggaactaaggggctcagataaagcaagataaggagcaatccaatgcctaggtccctcccagatcctgagtgtcacgccactcctctatctcctctaagggaccacagattttctctggaggagctgaagcagaatggctatgggttcaaggcacagtcctcaacacagaactgagatggatgtggaactgagtacaggaggattataggaatactgaaagggcgccctcagctccctttcctctgcccactcccagaacagaccaccatctccccacatcttccccttaccccaagaaggagaatgaaggcatctatgaaggagaaattaatcacccccagaacagaccaccatcttcccacatcttccccttactccaagaaggagaatgaaggcatctatggaggagaaattaatcacccccagaacagaccaccatctccccacatcttccccttacctcatgaaggaaaatggaggcatctatgaaggagaaattgaccatctccagaaaagactcactaatgttgccttggggagcaatctggcaaccaagccaccttcctgcctgaagctcaccagctgacaaggcctatccacatgtacagacttttgggtcaggttttataacctcacccttaataccaaactagcaactcagacacttggaaaaagcttccatcaaaaagaagaaagttgaaaagaaatcaaaaggaaaaggaatccagagaaaatggaaacagaggaagattaatttttaatgtcatatccatatccatatcaaagtcatatccatagaaatggtactcagaatggcactggactcaacactagatattagacgtcactagagcaatgtcttcaaattccaggtttaaattaacttgcaacctgtacccagccaaacagtcaagatggagagcaaaataaaacactcacagacattcaaagactcaaaatatatgccacctacttatgtttctcaggaagctatcatgtaacttgtttcagcaaaatgaggaaataaatctagaaaaagaaataaatggcctgccacaaacagaagttccagcacaggggagtggcaaagagaagtctgtgcaccaggccagagaaaaacaagtcccaattggaacacaggataggggtctccagaaagaaaaaaaaaattatagattgttttctgtctttgtacaggcatttgatagagctattagagcatttggggaaaatacatgattgttatatttaaaaactaagcaaatgaaaatggggcaattgtcaaaaattgtcaagaaatgtcatcctagaatactaattggctgagcagtgaacaatatttatatttatattatgttaataatataaacacatatgattaatttaaccaaaaattataatctagctttttaaggagaatggggggagggaagtcagaagctgggagagaagaatgatgtaagaaagcaaaacgctcacctagaacaaggaagtaaatatcaaaaatgataaatcaagaaatagaagtataaacaaagcatttagaaacatggagacaaacaaaagaagaaatagtcaaaagagctgttccctccccagagcaggtctggattaggggcaggggagggtgggcaatatggttttatattgataacagataaaatgatatccaacatttactgaatatttactattttctagccattactctaggtgtttacatgcattagccaaaaattctctcaacaaccttatgagcaatatatgaaccgcatatttttcagactagaaaattgaggcaaaaggaaattgagtaacttccccaaagttacaaagctaggaaatgtgggaagctggaatttggaaccaggcagtgtagctcctaagctggctctcttagttggtatgttatattgcttacaaattttattactattacaaaccaaacccttggcatttacatagtccagcatccctgaagagatgtcttcccctttaatcaatctggctgcttgagtatgaaaaacagtgtctagtcaattaatctgttaatggctctcatacacgtgacatttcttttatgttaacattggtcattgttaaaatacacacacgtttgtaaccttttttttttttttttttttccgagatagggttgcactctgttgcccaagctggagtgcagtggtatggtcatagctcactgcaacctggatctcctgggctcaaacaatccttccattgcagcctcccaagtagtggggactacaggtacatgccaccacatctggctaatttttttctttttttggtacaagtggaatctcactatgttgctcaggctggtctcaaactcccggcctcaagcaatcctcccgtctcggttcccaaaaataacgtgtttctaaaataaaggaaaggtgtttgttttaccttaatccataaaaaagcaataaatttattttctcaatctaaaactatttaggaagcttagtaaaatctctgcttacataactatccaccccaaatcaacagagtatacattcctctcagcaccacatcgcacttattccaaaattgaccacatagttggaagtaaagcactcctcagcaaatgtaaaagaacagaaattataacaaactgtctctcagaccacaaggcaatcaaattagaactcaggatccagaaactcactcaaaaccactcaactacacggaaactgaacaacgtgctcctgaatgactactgggtaagcaacgaaatgaaggcagaaataaagacgttctgtgaaaccaatgagaccaaagacacaacacaccagaatctctgggacacatttgaagtagggtgtagaaggaaatttatagcactaaatgcccacaggagaaagcagtagagatctaaaactgacaccctaacatcacaattaaaagaactagagaagcgagagcaaacacattcaaaagctaacggaaggcaagaaataactaagatcatagcagaactgaaggagatagagacacaaaaaacccttcaaaaaatcaatgaatccaggagctggttttttgaaaaaatgaacaaaattgatagaccgctagcaagactaataaagaagaaaagagagaagaatcaactagacacaataaaaaatgataaaggggatatcaccacccatcccaaagaaatacaaactaccatcagagaatactgtaaatacctctatgcaaataaactagaaaatctagaagaaatagataaattcctggacacatacaccctcccaagactaaaccaggaagaagctgaatccctgaatagtccaataacaggttctgaaattgaggcaataattaatagcctaccaacccaaaaaatgtccaggaccagacggattcacagccgaattctaccagaggtacaaagaggagctggttccattccttctgaaactattccaatcaaagcaaaaagagggaatcatccctaattcattttatgaggccaacatcattctgataccaaagcctggcagagacacaacaaaaaaagagaattttagaccaatatccctgatgaacattgatgcaaaaatcctcaataaaatactggcaaaccgaatccaggatcacatcaaaaagcttatccaccatgatcaagtgggcttcatccctgtgatgcaatgctggttcagcatacacaaatcaataaacgtaatccagcatataaacagaaccaaagacaaaaaccacatgattatctcaatagatgcagaaaaggcctttgacaaaattcaacagcccttcatgctaaatcaataaactaggtattgatgggatgtatctcaaaataataagagctatttatgacaaacccacagccaatatcatactgaatggacaaaaactggaagcattccctttgaaaactggcacaaggcagggatgccctctctcgccactcctactcagcatagtgttggaagttctggccagggcaattagtcaggagaaggaaataaagggtattcaattaggaaaagaggaagtcaaattgtccctgtttgcagatgatatgactgtatatttagaaaaccccatcatctcagcccaatatctccttaagctgataagcaacttcagcaaagtctcaggatacaaaatcaatgtgcaaaaatcacaagcattcctatacaccaataacagacaaacagagagccaaatcatgagtgaactcccattcacaattgcttcaaagagaataaaatacctaggaatccaacttacaagggatgtgaaggacctcttcaaggagaactacaaaccactgctcagcaaaataaaagaggacacaaacaaatggaagaacaatccatgctcatggataggaagaatcaatattgtgaaaatggccatactgcccaaggtgatttatagattcaatgccatccccatcaagctaccaatgactttcttcacagaattggaaaaaactactttaaagttcatatggaaccaaaaaagagcctgcattgccaagacaatcctaagccaaaagaacaaagctgaaggcatcacactacctgacttcaagctatactacaaggctacagtaaccaaaacagcatggtactggtaccaaaacagagatatagaccaatggaacagaatagagtcctcagaaatgatatcacacatctacaaccatctgatctttgacaaacctgacaaaaacaagaaatggggaaaggattccctatttaataaatggtactgggaaaactggctagccatatttagaaagctgaaactggatcccttccttacaccttatacaaaaatcaattcaagatggattaaagatttaaatgttagacctaaagccataagaacccttagaagaaaacctagacaataccattcaggccataggtgtgggcaaggacttcatgactgcaacaccaaaagcaatggcaacaaaagccaaaattgacaaatgggatctaattagactaaagagcttctgcacagcaaaacaaactaccatcagagtgaacaggcaacctacagaataggagaaaatttttacaatctacccatcttacaaagggctaatatccagaatctacaaagaacttaaacaaatttacaagaaaaaatcaaacaaccccatcaaaaagtgggtgaaggatatgaacagacacttctcaaaaaaagacatttatggaggcaacagacacaagaaaaaatgctcatcatcactagccatcagagaaatgcaaatcaaaatcacaatgagataccatctcacaccagttagaatggcgatcattaaaaagtcaggaaacaacaggtgctggagaggatgtggagatataggaacacttttacactgttggagggactgtaaactagttcaaccattgtggaagacagtgtggagattcctcagggatctagaactagaaataacatttgacccagccatcccattactgggcatatacccaaaggattataaatcatgctgctataaagacacatgctcacgtatgtttattgcggcactattcacaacagcaaaaacttggaaccaacccaaatgttcatcaatgatagactggattaagaaaatgtgttacatatgcaccatggaatactatgcagccataaaaaaggatgagttcatgttctttacagggacatggatgaaattggaaatcatcattctcagcaaactattgcaaggacagaaaaccaaacaccacatgttctcactcacaggtgggaattgaacaatgagcacacatggacacaggatggggaacatcacacgccagggcctgtcgtggggtggggggagggggagggatagcattaggagatatacctaacataaatgacgagttaacgggtgcagcacaccaacatggcacatgtatacatatgtaacaaacctgcacgttgtgcacatgtaccctagaacttaaagtaaaatagtataaataaataaataaataaataaataaataaataagactgcttaaaaattagatactgagttttaattatcaagttgtaagtatcattacaataaacaggcaaaacacgcatacacacacacacacacacacaaacctttctcacctgtgccatcaatcttttgcttaaaaatcatgtgttttgacatatctgaaaaaaagatagtgctgtcctgggcgtcaaaatcaatcccgacaaagaaagaaggattccccgaaactggaaccatgacatcttcctgggtagacaaggtgaacgggatcccacgaatagcaacttgggatgaaaaaatgaggaaattctgaacagctgtaggaagaataacacagcacagtcagtcacagcatggttcttttctctcctcccaaattccagataaatgcatccacagagcaaactttaaattataaaatataattctgaaataaatgtaaaaataaatttttggaaagcatagttagaaataatacagggaagaaaaaaagataagcaactatgagggagatacaagtattagaatcttccttcttcctaagaaatgtatccttaaaatgtatttatatgaaaaatgatatccatatgcttaatttataaaataggagatacatctaatgtaatgacgagttaacgggtgcagcacaccaacatggcacatgtatacatatgtaacaaacctgcacattgtgcacatgtaccctagaacttaaagtaaaatagtataaataaataaaataaaaaggactgcttaaaaattagatactgagttttaattatcaagttataagtatcattacaataaacaggcaaaacatgcacacacacacacacacacacacacacacacacacacacacacagaaacctttctcacctgtgccatcaatcttttgtttaaaaatcatacagagctgaactctatagtaattccgtaacaatcctcaagttggtttaacttctgcatagagatctacaccaagaaccttacagtagataccaagataattaacagcaatcagaaatataaagatataaaggagtgaaagcagggaaggaaggggagggataaaggaaataggtaagaagaagtgatgtttaacagcaaagaggagactgtgacaggatgccagggagtcaagaagatgaaggaggtatgcccaagacaaagataaaaatcgcagtaacggaatttaaaagcaaaattattagacaacgcactattgatataatagttagaaatacatgttgtttttaatgagggtgatttttctgaatctaaaactacctaagaagttaacaaatgtgtctgggttagaataagataatttatatacgacgctagaaaccgcaacatctggagagcaagaatttgtcacaggcacagaaaggagaaatgtagaagtgaaaataagaaaaacaaatattgtaggagtgcatttcatcattagctggggcccaggcgatggcttaagtgtgaatagatgtgtaggaaaccaaagaggaagaaaggaaaccttcaaggtaagaatgaaatcaggaatatggaggcagatacaagaaagtttgaactgaaaggtgaaaaactgtgtgagtaactgagccaccccaatgctcaggagtttactttggaatacagagagaaaaaataagccagataagattcagatgtgattacctggttgaaaggggcatacgtggtggtctaggagaagtcaaagtggggagaagtacagtacttcccatcaaagttaaggctaacatctaaagtggaaaaggtatacatagcatagaaaagagctcaaagttcaaccatatggaatttcaagatcatagttaataggagaaaaaggcttcaggaaacaaagggggaagggaacccaagaaaaccttagatgtgggattaaagcaaaatcccaaaagacagaaatttacattttcaaacatagttctgtgtatagtagaagtggtgcctaccaaggaagatgccctgtgggctacagaaagcttatttgcagtcaagaagttagacagggagctggtccagttcaagagtagcagttagtctagttagaggtttggacacacatacacctgtgtcacctgccaacaacgtccaaaacagacttcttaccaatgcagtggcgctcatctgtatccagttggaagccgaatgtgcacttgcaacggaaacccaaaccatcattatctgttctgtggctgaggacacagacctgctcacagcccccattgttatctttacacggattggtagctggaaggaaaaatgcacagggttaaattgcaattagaaatgtgtaattatccaagacatgaagccacttctagcccttttcacctataggtgaaatagagtaatggattagcaacgtgttgaaaacattactactggttactactggatacatccacatctggctacactaaccctcccaatttcactgctgctctcccatccactctccaacagacggtggcaaaaaaaaagaaaggactcctacaactttctccccaataattatgtcagagtatgtctgctatcctccatgattagaaataattgtcaaaagaaaacccacacttcactgcttttttgccatttgtaggatataataaatattactcactggatgcttactttgtaagtaaaccaacttaaccaatagctctaagaggtaagtattagtcctccaattttacagaggagaaaccaagaatctaaacagttaaataacttgcccaacattattcagcagctaaacagcttgactaggattcaaagccagatctgattccaaaaccttaaatgtctgcaacacaaaccagtttatacttccaaaagccactctcaaagtagtgaccttaggaagagcactgccacagctagaaattttatatctgctttcaaaattgtctttttagcctttgacttattctttaaaatattctctttatcttctcaggtggattgatttggggaaacaataggcagatgtcattctgagccaaataatgaaaatagtaatttgagtgatcacattgatcattgatctaatggatctaatgtgagggcaggtgtgagtttagttgtgaattgagtgtaaaaactattcaaaacagatatttccaaaaatgttttcagataaaatatctatttttagacaagtttatactttcccaggatgatgacattgaaggagattcatctgaatgtgtcatttctagtggttgggcttttgttaagttaacctcattactttgcagtctttcttcatcctaaatagatccatcacttaacatgagttttagagcaaatctgttttcctctaaattattgctcaccaatattaagctttctaccaacgtagtgtagtttatgtttctttttctttgatccacaagcaaatacagaaaagagctatatacagtcctgatagacttatcaaagctcaagctataacctggaaacataaacaaagcttatgataggccaggtgcagtggcttacacctgtaatcccaacactttgggaagccggggcaggaggatcgcttgaagcccggagttccagaaaagtctggccaacatagtggaaatcccatctcagaaaaaataaaaagaaaaaatcacgtggtaaaataacaggagaagactaagcagtgtctgaatcaaaatatttctttttttaaaataagtgaccagccagagagacaccaaacccagttggcctatgacagattaatcagaaccaaagaacaggtgccatacatatgcaacagagaagaagaaaaaaatggctctgatgctaccgaaaatggacacttagacatgtcattttcttctatgggacctgtttccttaactgtaatattagaagtttgaaatagatgtctttcccagtagaatgaggataggtattttggtttggtttgtgagctgctatacccccaagcatctttgcaggtgctaataaacatctgttaaataaatctctaaattccctctagatttggcatttaactgtgaaatacatcagtttcttcagaatgctcctaacctgcagaaccagtttcagagagtttaacactctgggtaacccttcatatacttgagaatgccacccaaatcacataagacccctcattattaactttcaaagctttgagaaaacctttccaccaagtccggtaccaagcatggttaccactgctctgaggcttaccatagggctgtctgagggaatggtaaacagtcactccatagggcctcagggaagcctggtagtacacttgtgggttggtctctgtgaacttgtttgccttcagcacggccatctttgtccaatctgtaaagaacacctgaccttcaaataagcttactccaaagggatgaggaatgagggagcctccatgaactacagtcttcctgttataaaagacacatatatatcatacaatttgttagttttgctttattataattaaagctgtagttagttcaattaaatgcctgaaaagctaaataatttcttgtcacaaatacggaatagatagaaaagatacattttagatgtatacatatttccatctacatatgatagaaggattttcatgttgtctcttggaaaagacccttgagacttacattccagtcccagtcaatcctttagcttgtcctagacttttttggaatttactgtttccccttttgttcttcattccttttaggttgccccacatctaaaaggctaagatgtgaaatagcattttgaataccataagtgaaagagtataccaagactttggaagtctgggaaaagatgcctttgccaactatttcccactgcaccattgagcatttcctagcaattagggagcaggacagtgagtggtagggttcaagccccagcaaacgcccacatctgttcctgatgtcactgtaaggaaagcaagaagcaatgccactaccactcttatgcatctgcttgatggaactatcaactgatcatacttgtaatggaggcccaaagccacttaactgggaagaaaacagaagtaaaattaggcactaagcgaagagaggaaatcaacaacgccccccgtgactatgtctccataaacaatgattcagttagactcatgaacagagtgaggcagaggacggttgatatgggaaaactcttattttctttattttggcgtaatacaaagacctcaaagaaaaatcttagcatcccctgaaaactaaaaaggacaatagagctctaagaaaagacttgaagatattaaagctgggaaacacactaaaggggagtaaacaaagaaacctaaggtggcaggttagtgcacactttgaaacattctataatgacatggtacattaagattagagaatagtttctctctcagttagcaaattccaaaaccctgaatgccacctgctggcaaagcgagaggcaatgactttatgatttcagctgtacttgtgagctttaatatttctttgatgtttcttcacagccagcaaaccactcaaatctttttgaaattccattgatttttatcttttatgctttacttttttttacttcagcaaaagttagactatataatataatgctaaaacatcccaaagagaaaaaatttaagcaatttcacaattattttatgtgacttattgggttagctaattttttcataaaatttattcatattctccttatggaagccagtttcagtgataggaagtcaccatattaatacacaatacttcatttaaccaagcagagattgtcccaaggatatataatccaatggcaaactgtgatattatccttacaaaatggaaatacaagaggaaacaaaactataatattgctttcattgagaaaacaataaaatcaagtcattgggaaaaattaagttaaccagcctatttgctgaatccacaaagaataatattttgggtcaaaatttgaagaacatgttttacccaatttttgaaaataccaaaaggagaggatctaaaataattttttttacattaagttgtagttagctctaatcagagtaaaaagatgaaaaaaaatatgccatattcagccaggtgtagtggctcacatctgtaatcccaatactttgggaggctgaggcaggcgaataacttgaggttaggagtttgggaccagcctgggaaacacggtgaaattttatctctactaaaaatacaaaaattgccaggcatggtggtgtatgcttgtaatcctagctactggggaggttgaagcaggagaatcacttgaacttgggaggtggagtttgcagtgaaccgagattgcatcactgcacttcagcctgggtgacagagtgagactccatctcaaaaaaaaaaaaaaaaaaagaaagccatattctacattcaaatattgctgtttaagtatctttgtataccaggtaaaaatacaatacaaagaatttctccttgaaatttgaaatatataagagcagagtaaaatccaattaattcccagtaggcaacatcaaatacctaataaaacatgtatttattgggggaaggttagaaaattaaaagggaaagtgatcttgagaaacaaagcacaaatgaactcaggagtgaatgaaaataatgtgcatcatgtgggactaggggaagagttggagaggagaaatcaaagaacaaatgctggaggttatatttaatgagcgtttacctcttgtgttatgggacacaagaaaagttaacaaaatagagcaggtcacttcatgcaaatgtcagtacaaaggtcattaaagctatcatgtccaccaacaaagcaatattttaattctggtcctttgatatttctctgcagccattttatgcactttccctgcaacttataaagccataagccataaaaaatacttcttacctttgaattccatcataagttacagtttcaatgtaatcaaaccgagagtcaacccagtaaacacgcttcgatatcatatccagagttaccccagcaggccatcccagctttgttttcaccaagtctttacggttgctgccatccatgaatgccctttccagcttaggttccccagaaaggctctcccaatctgagaaaaataaataactacaaaagaaaaacagaagatgaaagaatctggtattttacaagttaacctgggaattttttttaacagtgtgtttggatcaatggaaattttatccagctgattagagaaccacagtataaaacaacagggaaattaagttgttttttttttttaaagagactgtgggggtcagtcaggagcatcaacagttccaaatagcaactattatgatgcactaatatggcagtctaaaagttcatattcagccagccaggcacagtggttcatgcctgtggtcctagcactttgggaggccaacatagaaggattgcttgaggcccatgtttcaagaccagcctgggcaacatggcaagaccccatctctacaaaaattaaaagattagctgggcatgatggcacttgcccatagtctcagctactcaggaagctgaggtgggaggattgcttgagcccagaagttcaagtctgcggcacgctgtgattgtgctgctgcactccagcctgggcaacagagcaagaacctgtctcaaaaaaaaaaaattcatattcaccttctgaactttctcctctgtttcctttatttgtcctttgcttctcttttttacacccaggaaaacttacaaataccttttaaaagaagctatcaagccattttgctcctcagttttccattctgaggcacagagaacatttccgtcattttcaaggaaggatagctgatataatgaagtagaactgaataatcatcattcacaaagactaaaatagcctaaagcttatccaagggtcctaagacccaattgtgaaattctaggagaaagctaagtctcctataacacttctcaaatgtgaagattgggaaatttaaatttaaacctgaagaaaagcattatcggtgttgctggattgattcagactgaacaacttgtaatgagatattagcattgatatctcaatcccagcctgtatcaagaaagttctgaaaggaatagttccaacctccatctttaaaaatctttacagctaattcatgttagagtaatcatcttaataataatgaagcataagtgatgtttagttgtaataatattattagattgagttagaacacaaaatccaatctcttagctaggaaaacgtggcaaacactaagaataaaattcatagccccaaaacaacaagtatttttagtacaccactaggtgtgtttgggtaacatgtcctcaaataggattatatttaataaactctcttaaagcttctataaataagggcacaaaatagacatggcttctagagtatacagcctaaaagaaatcagaatgagcctttgattaatccagtagatgttcagtgtatagagggagagagaaaattctaaaaatacaggaatcaatatgttttcacatcacttacccaacagttgggtccacggcaattcctctaggatgccccaagttttcagttataagggtaacccgatagcttccatccaaatttaccatatctatgcggttgaccttggtttccactagatagattttattattaacccagtccacagccaggttctctggggtttcaacagaaacattgagaacctcttggatatttaaaccattaatgtcaactgaaaaaacctgaaagaaaaaccaaaattattatatttcttcagcatcactaactacgtggtttgttttgattttttttagctataatcaaatcagaagtgctaaaaatctaaattctcaattttcagaaatttcatgcaagttatcatttaaataaatgagaatcgtattaatggtataataaaatgtaagaagaaataaataaaattccataactctttaagagtttctgaaatttatgtttcaaaaatctccattgcattactccaagatgaaattaaacccatcacactttccaaataagacagtgaaacaaaatttgggccattaaacaaaataccgtcaatatttgttactcgatcccgaattacagttccatttagaagatgcaggtaaaaatctgatttttatcatccagaaaagcagtgtgctttttacattttaaatgatcaaatttcaaaaattactaccaaatatctatccagttttgaaagaatgtctactatttcttttaattaggctcctggactccacttcgaataaaattaaaagttgctcaaggctaatccatataatagactgctttgtttaataggtcacatgtaatagtatagcatggaaaaggtgctgattaacataaaatatctcaagggccttttttgttagaaaacaaaggaactttcccctctactccctctaaaagtgaaaagctatcaacactttgtgctcagggttccattcagctactgaaatttctatttaccttattttgcacggtgtctgtccaaaaaactctttgcaggtgatagtggaaagccacacccacggccactccacgattctgagactccactaggatccggaagctccttccatgaatatcaccaattaacaaatcccgaccattggagaagataatggaggcctcgccaactaaatgcgaagaaggaaggcatcaccactccttcagatgagcaaggatggtgaagtagcttacaaatgatatgctttctgctttttcaaatgctatcttctaggttgtcttacctgattttaacataaacctctgaggcagacagatagctagcattctatccattttacagaagggcaaattgaggcacaaaaaggcttaatgaagcgtccaaaatctcagtaagttaggaagaatttggtaagaattcaagcattctggatgctagtccaatgcactttcaatgacactgaggagagtatttctcagatattttcgagactccttgatggtatgggcaccttagccccatgtgcaactttagattttgttaaacacagaagacattttaaagattaccaggaaatcactctgaaaaagatggtaatggtggttccaaatctgttctgtctgtttactcgcaggtatgcaaaatgatatatgaacaaggtattaattgcagtcttattggcaatagcaaaagataaggaatgatataaaaattgatcagtagaggactagttaaacaaattatgaacataaaagaaggaatattatgccattataaaaaaataattaaggccaggcgcagtggctcacacctgtaatcccagcactttgagggactgaggtaggcagatcacctgaagtcaggagttcgagatcagcctggccaacatggggaaaccctgtttctaccaaaaatacaaaaattagctgggcatggtggcgggggcctgtaatctcagctactcaggaggctgaggcaggagaatcgcttgaacccgagaggcggagattgcagtgaggcaagatcttgccattgcactccagcctgggcaacaagagcaagactccatctcaaaaataaataaataaggccggatgcggtggttcatgcctgtaatcccagcactttgggaggccaaggcaggtaaattatgaggtcaggagatcaagaccatcctggctaacatgatgaaaccccgtctctactaaaaatacaaaaattagctgggtgtggtggcagaagcctgtagtcccagctactcgggaggctgaggcagagaattgcctgaacccgggaggcggaggttgcagtgagccaagatggcgccactgcactccagcctgggcaacagagcgagactcattctcaaaaataaataaataaaaataaataaataaataaataaaataattaagaaataacttcatgtgctgaaatggaaagctctggaaaatatcttcagtacattcacaagatgcagaactgtgcatatagtttactaccatatatagatatgtaaatacagttaaatatctatatttgtatgttcttgtttattcattaaaaaatctctagaactaaaataaagaaacggcaattactcataggaaagagaaggtgaaaaccatgcagaggggaatagttatggaggaaggcatttcactacatatcttcttataatttaaaatttgtgaacatataaatatgttacctatgcaaaaataaacacattgaattgttaaaaatccgctgaacctaaaagttactacacagcaaatcaggtatttctacacaaaaacaagtagaaaatgggccattcttcagtcatgggagcagttaagtttcagaagacaccaaagacacttcaaaatcaagtgttaaataactattggaaaataggagtttatattgagaccttcgtccggagaaatcaacagcgacaaaatgctttggagccctcatctattttttgcagattttctccatgacttttctctactactctgtactactctctacttttcatactcttacactgattccaacaaattacccagagttagtgcattcaaaaaattgttaatccaaatttagcatgtccatttggaaatatccctaaattttgcaagaacactgtgaaaattatttctgtagatagttgtcgcctacttttgtggtaggtaattaattaaaagttaaatgtccaagccaatcaaatgtaggcatagcatttattccacaattaaaggtgggtgacatgatagcctaggcaaagtaaacaatcaatcaattaaaaaatattaataatggtcaccattagtcgacaaattggtccttaataatcaaagtatgaaattaatgttgaccaatttttctaggcagtaggagccatccctgatttgtaatgataaagccctgccaacaacaaaaatgctgataattctgttgtcatcagaaggaaggaaagaagctattagaatctgttcactgttcagagacacaggtgtccataatttactcacaggaatcattagctttgcaatactgtccacgctccaagatatacccttcttcacagtggcacaggtgacggccaggtcggctttcacacttctggtcacaaattccccatatctggcaatcatcaaactctgccatatggaaaatacacatttgtagtcaaggttatcagcatttattaagcactctctgacaaaaatcctagataagatggccaagaatgtggtgttgcccatgtctaaataaacaccctctggaattaggcacaggttctgagaatttataacaaccatcttcatgtaaggaaaaagaacatttacatcattttttaaacctacatgaaggataactttacagaaaatgcacaacacttcctgaattcatagccctatggtactgcatttcatttattaatgttagtctacaaatatataaattttggtgtaaatgtttcccttcaatactatgctttccaacatggcagccactaaccccctgtggctatctaaatgtatctttagattaattaaaataaaataaaattaataatttgctttcctagtcacttgccacatttcaagtgctcaatagccacatatgactagtggttacaatatgacagagtgaagatacacatttacatcactgcagaaagttctattggacagcactatttctgaataaagtaagacctgcctatagacagcccctcaggaagaaacaaatctatgactgcaataaagtacttggaaaggtctatttacccagctgtctttcctctgatgtcaaaaaattataaccaaaattaaattgaacttattttcaagacatcaaaaatgtcttctcctctacttattggttaacttattattcactcatttagtaagtgttcattgaagtcccttacatgacagagctctgttcattaccagagaagtcccagttctactgtttaaaaatagttccaatataattgacataaacaatagaatatggaggggagaacacaacaaaatattagaagagtctttcttaaagactataaggcttcaggggtgcagaaattggtacatctgactttccaagtccacgtccactctccatcatccttcaccctcctcgcttccctgggaggatgacctatacaaactataacaatagagttcccacaccctctggtttcaggaagttctcaagtagattataatttctgaaaccactgcactcccaagtctagaattctccagatttctatgatctgattacatttgcagcaactgtcagagttgtgaattgggttcaaccattcctgctgggtggcccaccattccataacccaccaaaaggccaagtttcttctcttttcttttctttttcttttttttcttttttttttttttttttttttttttgagatggagtcacagtctgttgcccaggctggagtgcagtggcacagtctcggctcactgcaacctccgcctcccgggttcaagtgatccttccacctcagcctaccgagtagctggaactacaggtgtgcgccaccacacctggctaatatttttgtatttttagtagagacggcatttccccatgttggccaggctggtctcaaactcctgatctcaagtaagcagcttgccttggcctcccaaagtgatgggactgcaggcgtaagccaccgcatccagccccaagaaggctcttctaatgatcccattttccctgcagattaaacataacaacatgagccagcatatctttctttccaaggaccgtgactaaccagaggaaaaaaaacccaatccgatctggacactaccaagtgaaatgccacatgagggtgtgaaatgccctcactgatgaatcccttctgtccccttaactcagccctgagaaagctccacctaaggctttgcctcagcaggaaaaaaagtacaggacattctccctcaaacccccagaatgtcataacttcattttgaatgcaagatccatgagaccacgtctaaggatctggagtcactctaagcagaagttctgatgtcaaacagaaggaaaccaaaggtggagaagtcataactaggaattctctagcacaaatgcccttcctatcacctgcactacaagtggtttaaagatttgaatgagtgggccaggcacagtggctcacgcctataatcccagcactttgggagggtaaggtgggaggattgcttgagtccaagggtttgagactagcctgggcaatatggcaagggtttatgtgtactaagaattaaaaaaaaaaaaaaaaaaattagccaggcatggaggcacgtgcctgtagtcccagctattcgggaggctgaagtgggaggctgcagtgagcgtgataatgccactgcactccagcctgggcgacagtgagaccctatcacaaaaaaacaggatttgaatgagtgtataaaattgctgtcacttttgtgacaataagattgtatccttggatcactatagaggaatatgaaggttaattaacatccatcagcagccagagtgaagacaagaaaaataaaagtagaattgagggttttcgtgagagtagaaaagatagtggaaaccacacaaaacactaaaacactactttacaatccccctctcactccaatacctttatctatttttctttcctttttattctttgtctcctcccaccaacaaatactgctgtgaaaatgactcaaaaacccctttttaactgagccccccttggccaccctctgatccatctggctgtgtgaaaccccaccatgctgaatgacctccctgccctcactctgcaccacgatgtcattctgtcaacaaacagcatgtcctgtcaatcagaaacaatgagcccagtaaactgcttcagcatgcctcagagcttccactgccaggtcaacactaccagaggcagatgaatggtagaaagacacaagatttcgtgtcaggattattcaatgttattcttgattaccaccgaggtattcactggggagccatgtctaagataataaatgttgcataggtttccaacacctgaagcctgtgtaatgcgtcagccatgcagagggttatagccatacagagagtatttgttgaaatgaaatgcttgagagagcaaaccaaagcaacaattcccctaaaaattcagctcagctgaaacaagtgtaactggtttcctaacgtcatgtatttaaagagttctctataaagagagaaaaatacagtcttctttgaaacaaatgtgaaataaatgttaacccagcctcaaaactcagaggcaaatgacacattcttgaaggacagcaaaggtcacagaaaaggtctctgcaggtggcaggaggcctcatattcacaaaggccctcaaatgtagacttttgagattatctccaaatgaggttgtctgtactaaagtcccagaaacgcgctggcgggaatgaaagaagatgtctgttgtggaacttaaaattagtgccccggtattagaacacactacttccaatgtgttattaattgtggtatcttctctgatcctgaaattatcctgtgcacacataatactgcaatattctgccttacattcactagtaggttaaatgcaaaattttataaaacaagaacattgttatgacagcctttcgctttgtgagaggctattgaaaattgaagtggcctgaatctctgacatttagaaaaccctagacatttggaaatacaacccaaggctcaccacagacttatatgttggaaaatatggaaaatgtgttatctgggctctagggtggaacaaaaaactgagaacagcttgtggggcatcacaagactgaattagcgattctgaaagaacaaatcacttttcctgaaaggacttcatggcctatcaagtttcaactgtaagacagctcagccccaactcctctttgggagttgataaaggaaaaagagagaaaagctgatgtaatactgagaatgtggcttctggtatttctattggaacttcttttctactaagagaaaaggaaaatgcctaaagaactaaaaggctgggaatgggattggcagctgggtagcagtgaggggggaaaaggagcctgacatttgctaaagacacaggagtggcctcacacccacagacgagccccactctgagcagaagtgaggctgcccctttgcgcagggctgcctgaaatccaggcagggctcccagagtcaggtcaccacctaaccaataagggcattcgtgtgaaaagtatctgtaaattacttgaatgcattcccaatataatggtaatgataacaataaaacacaaaatgtgtcctgcaatcttatttaagtccagttgcagatcataacttttatttataaaatgttttaaaatgattagaaatttgggggccttcttaaattattccagagttcacttaagtcacttgatcttaaagtaccttgttgaatatagttacttaagaggagcaattagatgggcaactttgggacgtggtcctgatattaagaacctacagttacccactatgaacacaaggaaaagctcaaatggattgctttactggatataaaaatctaattttttttggcatatggtaggtaagtgagcccaacgattgtagttttcagtaacgctgaggagcagactttctcaagaatttcaagtttaatttgcaaaccagagtttatttctggtatcaatacatttttctgtttgctagcacttccgctgaagaataataataataataataataaagaaaaaaagaaaggcttttctggctatgagtagttgttaagattagctgtatttgacaaagtataattatgttggaagcaatgagctgagactaaagactgaataactgcattaggtttatctatattcaataattttttccaaatgttaccaaatagttctaaaatattaaaattttaatattttaatattaaaattttaatattttaataatattaaaataataatttcagaagaaatacttttctagaagcatttcttacacatttcatgtttgttgctatcccaaaagccctaaagaatacctcacatttctaaggaatatcaaaagaatataaatatcctgggaaaattctgaatcattttggagccccatagatgactaccaaattttaatgaatagtttcaattgccttccagatgccttttcccaacagcagtaaaaatagttttctttaaactccctctgtgatcacttcctgctagtatgtttgttgttcatgtatcaaaaatcagatagaaggaaaaaagatcagagcaccaaaaactcactgagaaaacaaaaactgatgatagttggtcaagtctaattctcccatcataaggccccgtcctaatcacagtgagatataaagctggcatcaaaatcaaaaatctcattgggagaaatcatttctgaagtcagagaggagagatatgaggaaatagttggtgtactggtgtctagtttaatgccagccaccatctggaagcaccatgataaagaatctgctcatcttgaatgatagttccaagtggatgtcacaatcagtggaatgagtagccagcccagcaaaggcactggcccaccagtgtagtcacctgagcaatgacctggtgatcctctgctgtgtcaggtaacaactctttagttgtgggatcctggggatgcttgtgcatcctggagaagaggccaggggagcaaggtagcggtgcttgctgggctcaggcagcagctatctaccaacctcatggaagtagttcagtattcaataaccagtatggctgcaccaatcctgatgccaaatacttgaaaagaaaacagaaaaggactaccgccctcatcaagtaatggataggttccaggtagctagtcaactcgctcatgacagaaccattcttttgccttgtacaccacaccaaaccttctcagagttaaaattccctatttgccaggttttctgtgaggtctgggttgctctttgttatgacagaccatgacgactctccacaagtgcaacctcctagatgtcagagatcagggcacccatcagtgtactgtaatgaaagacaagtagccgccgccccccatcacttaccaacacaggtacggctgtcattgtggttgatgatataacctgggggacaaaaacacgctcctccatacggcgtctcatggcactggtactggcagttcaaggcagagcacagagtcatacctaaacgaagaaaagaactttgttaaatgaatggtgacctctggacaagactgattaatctaatagcttctttttccatgagtagcagctcagtaagcatgaagtagatgtacagaaaaatctgtcacccttcaaagcttactgcaaaactttgcaataaaagttcaactgagacaggaagattgcttgaagccaggagatcaagaccagcctgggtaatgtagctacacctcatattcacaaaaaattaaaaataaaagcattagccaggcacagtggctcacaactgtaatctcagcactttgggaggccaaggcaggaggatcacttgagcccaaaagatggaggctgcagtgagctatgactgcaccactgcactctagcctgggtgacagaacaagaggctgccttgagtggaaacaaaagaaaagaaaaagctcctttttaaagttataactatgtgcaagtataagtcattaaaagtcttatttatgaaaaaaaaatcaggtcatgcatgggtctatctttgtgtctacatagtaaaaagggctaagaactcccaagtgactggagcaagaataagccctagaaatattaactgtggctggcttcaagagatgggatttcaggtgattatatttttttcttttggttaatttttattttccaactttcatactgtgactacatatctcttattaatttttaagcttttttaaatgggctcccaaatgaaatagagaaaaaaatgccatagaggtctctgcctgtttaaatattatgtacaatttttgtcaggaaacaaaaaataaccttggggttgcagttacatgggcacttctaggcaatcacaaatttagttagagtatattattgatgaaatcaaggttttaaatggcatttccttacaggaccatcagctgtccacagagttgatgggttgttggtggggtgaatattctacagccccaaaaaaggagaaaaaaaatccctagttccagtcagtttcctcataaatgaatgtggtcacacaagacataatcgaacaacactgtgcatggccaactcagttttgccattggagagtaactcaaggtacataacccaggaaccagaagctttttttttttttttttttttttttttttagtacagccagacaaggcctttttccataagtataagccaggtaataaaatctccagaacatctttaaggtcatcaaaattgccattgaaacaatcctccctgtgtgtgcgttagggattaggaacggggagttgctaaaaaattgttaggctcttcccatcaatagatggagtctatttcttccatccactctgggtttggccaagtgtcttgctttggacaataagacttgagcaaacttggcataagtagaaccttgaaagtacttgagccctaggatttgctctttcagcctctgggtcaacaaggctaggctagcccaagcttttactgcaacatcctgacgtgtgagtgagctgatacaggccagaggaactacctagccaacccacagaactgtgagaaataagacacgtttctcagtttatgccactaagtcttggggtgctttgttatgcaaatgccaacagatacactgtatttgaacgtctgttctagaaaacagaaatatctttatctgaaagctacccaggtaaatgtctatactcactacagtattttccggtactagtgttgttttcatcttctcttcctgggcaatctaaaatcccatcacaaactttataaatggagatgcatcgtcccgactctgggcaagaccattctcttggggaacatttatgaacatcatgaggaccgctttctgtggggggaaaaagagagagttacaggccataggggaggtacagccagctctttgttaatcagtggtttacagaggatgtagagcaagttgaacaagagaaatctataaatgatctacattttacaataagttagtgatttctaactctaccactagtcttttactgagattctaaggagaggcataatggaattactccacttttcctggaaaaggcagcccccagtagggttataagaggaagaagcagatatgggcctcaattatcgacaaactaaattcatgatcccctaagaaaagatgtagttatttaaatcatgaattatagaattagggccatcaagttaggtccagaattacttgaatttgtggttgggctttttgatttgctttgtttatttagtgaaatgtcaacagtataagaaaaaccataacccaaatgtagaaaaaccactttctggaacataaaaacataaaacatagttttaacaagcatttcccttatcatacctgggattggaatggtgcaggtaacttgctgtagggtatgggtattagtaactgctaaattgttggaggtactgctgatgatatcagcaacataaaagggtcaatatcagcaacataaaagggtgaatatcactggcaatttccttctcacggaatctttaagcacttccctggatagtagcttctcctacacttaccatccccagctccaacccacgtgttcccaaggtggcctctctttcaccactgagtgtcagtgactcatttgggaatcagaatttacaaaaccaaaacaaaaaaataagctgaactgttaccaaggttcaaagtcatttttaaagattgtaaggtctaagacaaatgacattttccctattttctttccttccccagcctattagttttatatagttttaaatctatttaaaacaggcagtcttacagggagaaagtcagactggggtatagaagagacagagactgtcctacctattttgccttaaagatagaagggagaggattataatttaatctgtatttgtgttctgaatcttcttaggagaagttagcgcagtcacctccgtcttccccacccactaagttcctaaacaaccccttcaactccagccaatcctgaggcttgcttgtcacacaaaatttctaaaaaggaaaggagaaaaaacaagcgctggaaaacacttgaagaaaatgcttttcagtaggaatctcttcccctccttaccacatccatcttcatctccattatctttacagtcatcttctccatcacaaacccagttttgataaatgcatcggccactggggcaagtgaactggtaaccaccgcaggtcggatagtctggaataaagcaacagctgcactccaaagacacaaatcaccgggaaaaactgaaagtgctctcacctcactgcctaagcagtactcctagaaattgaaatttctatatcaatttaatcccttagacatcttgacaaaaatttttaaaaaggaggaaaaaaaagagagagaaagaagaagataacagcagctttgggtccaggaaatgaactcaggtgccggtttctgtttttcaagattaaaaattagatcagcctgggcaacatggtgagacctcatctctaccaaaaatacgaaaaataaaaataaatagccaagcatggtggtacatgtctgtagtctcagctactcaggaggctgaggtgggaggatggcatgagcctggtgggggtgtgtggagttgcagtgagccaagatcgcaccactgcactccagcctgggtgacagagtgagaccctgtctcaaaaaaaaaaaaaaaaaaaaaaaaaattaaaaacaagatggtttgcaatgcgttggcacagaacagaaaatgcagacaaagatgctgcagacatgacaacatccaacgttctcatactttactacaagctccgtaattgctaatctatgaccaaatgattctgagtcgaccattccatgatgtcacattctctttaattctctgtcactgaaataagcccaggttccagaaaggaagtcaggcatggctcattgaaaattagggtgatatcgaaaatatttaacaacaccctaaggcatgggtaccaaccaatcaaaagaggtgtggagggaaatcatacattctagtaaataaatcaccacgcaaagctgccaacttactgaacatagtaaaactctttcacagagtcttctaactttactctttccaaaaaacataagtggagaggtggcaacaataagagaggtcatttgcattgcaggcaacagcatggacataaaagcaaggtcagcgtgaagaagtggaggcaagaaagccacctataccacactgaaactttcaggctgggcgtggtggctcatacccataataccagcactttgggaggccgaggcgggcggatcacttgagatcaggagttcgagaccagcctggccaacacggtgaaaccccatctctactaaaaacacaaaattagccagacatggtggtgcatgcctgtgatcccagctattcgggaggctgaagcaggagaactgcttgaacccaggaggcggaagtggcagtaagccgagatcgcgccactgtactccagcccaggcaacaaagcaaaactccatctccaaaaaaagaaaacgaagaaaaagaaactttcctgaccctccaactttaatgcagcagaaatttcaaagtaaagaggagagttagagccactcctaggaacttcctttcccttaaaaacacttctctcattctactatcaaggttgtcagaggtatgggtcatttgagaatccagtgatacaatatatcctgtacccctggagcctaaggaaagaaggcaaactgtccatcaccagccctttacatctacacagatccttggaaaataaaggagcccaggtcgagcaacaccacaaaggcttgtgccaagaccccctagtgaccgtctgattccatctgccatcaaacgtagtgactcttctccttgaaaaaagaggtacattggtgggggagcggggggataaaacaaaacaaaaccgaaacaaaacaaaacactcccaacaacatgacccagcataaagaaatcaccgtactgcaagcatgttcgtcactgccgtcttggcaatcattgtcatggtcacagacataagcacgagggatacactctccattgccacatgaaaactcattgtgcaagcatatctcagctgcaacagaaagttaagaagggaaagaaaagagagaagttaactccattgtagccatttaatctcaaaggaagagcatctccagtttaaaaagggattcttattaagcagtggtgtgctggtaactgtttaagaaccagttatccaggaacaaaaaggccctggtttgtagtgtttgccgatttccagtgtgtaaatactcctaccaacggctgacttcaaactaccaacatgaattcactgaacctgaacttgggaagagatgtacatattggctctctcaaaccagtataaaccagcttcagcacacaactgcacatcttgtgcacaatacttactgcagttgatttcatctgaggagtccctgcaatcaactttccaatcacacttctgactggtgttatagcaggccccattgtcacaagtaagctgctcacatgttgggtactctattgtaaaaaaaaaaaaaaaaaaaaaaaggaaaaggaaacagtaaacaaaccttaaatttccttcagcaaacatttattgagtgattactatatgcaagtcactaaatgcatatattgatacacaaaagaagtatgctccctggcttcatggagagtaaggctggacatgggagacagacattaatcaaataagacacaaatggtaaattacaaactgggataagtgctaatgtggaaagtacagaggactgtgagactgcatagcagagagatttgggggcccagaaaagtatcccctgaagaagtgacttttgagccaaaagatgaagaatgagaaagaatttaactttagttcaaaatcaaacattcttttacatgatacagataacatcccaggaaactaaagtaccactgcacaagcttggaaaaaagaaaggccatttcttccactggcgggttgcagaaagaaagcaggcctagagttcaggagccctggcggcccagaggtaccactaagcagctatttactgtgactcaagcttcatgtcctctccatgttgctacttccctatctgcacatttggataacctactgcacagggtagagcggcctgaaaagaccatgtctggtaaagcatgttgaaaagcataatgtgctttcaaagcacaaattgttgttgccacgttatgtacatatgaccacctcactgctactcactggacctggttttctaggtcacagttgaaaatcaggaagtcccttacaggaataacgtgctatctgtccctcctctctacttgccagacttggaccacctgtctctcatgacttcttactggaggctttattctgtggatggttgatctctttccgccatgacataatgaaactccctgagatcaaggatcctgtcttactcattttagaatccccaacaattagtacaggggtgggacatttctcactgtgcacacttagtacaggggtgggacattactctctgtgcttgagaaatgttcaatgttgctattatttatcacaggtgaacattttagttcattcggctttttaaaatattttgaagttctgccttttatggcctttgaataccctccttttcacaaatgtggatatcttccttggtctgaccatcttcttcatgaaagattatttttgtagtgattatcaggtcatcttctgatttctttttaaccaaggaaaaggtatgtcttaattgactttgagtctcaattttgcacttaagaacccaatttgagattttatagagatataaatatattgaagataattctttggatagtcccaagtcttttcaagcagaagccatgcacaaaattctgtgctgaaactgtactaaacttgtgccatgttaacaacttgcactttttaaaaaaatggactctccaatgatcttttttttggtatagtaaaggaataagcctaactcttctcatctccagaggttcaaagctagtttattaagtgtccttaaatatctcaattgccagagttacatatagtcaatcatatgttaaaatggaaggcatttttaaatagctggttaaaatttaaaattttttctgaattttattttgttttttaatagtccaaaagtgagccagtgcctagagttattgcgtctttcctcgctgagatgatatgccttacaaatgtgccttcaaatgagtcacacaactctcccttcaagtgatgtttattaattctcccttcaagagatgcaaaagaccaggtgaggtcagcaagcaattcctttgcccctgtgagccagatagctcctagagtcaatgtgttatctagccttttaagagcagcagcaagcagaagaaaaactcgtagaaaacccagctctttgcaatagataagctatctgtctggaggaaaattaatctgggcttgaacggtggctacttcatttaaggtgataattataaatataaagaatctggaataagtgtgctggatggatctctcgttttcttcatcctgctttttgagagccagtgccagaaaattgaaaggggaaagattaaaactgtaaccactgacatgactacaagtttactgacaaggcccattccccacccaacaaacaagaagcccagcttgatatcatcagggagggtattgtgatggccagaggtcagcagtttgacttttggaatgaggaacacacagctttcttgtctccatccacactgataaagaatcactctcaatcagcagaggacccctctcaacccctgcacaccttgatctcttcggtgcatagttaacctgggatgtatactcataggaaagattgcacagagctccctaactccaccaaatactgaaaatacctgaaaatctgtttctgaatggttttccctctttggagacccacacagagacaacaggtccaaactgtcaacactgagcaaagaaagaaatgaatggattctactaccattgctaaagatgttaatgagtttcaatctactccagaaaacaataattcacaatcctttgagcttccaactgggagatatctaaagtcttattttttggttcatttgcttggcaagcctaagtctaaccttcttcccacagagcaaatccatcatgtggctataatgtcctgcaagaatttaagtatagggtaaagtgcaatatgagaggagaccatatataagaacaccaaggaaactcttccttctgaatttggttttaatggaaagatcaacaagtagctataaattaagcctcagacctttaaggttttttctaacacaaaaaggtgagaatatccttcctcataccactccttgcttcccctttctttactttctcccaatcccaaatgatacatgttcagatttgttcccccataattgggagctgccccaaaattatgcagacaagagtttttatattttttcactgttaatgatttggtttgaagcaagaaatttctatgctatagttctgtttacataatcagggaggagggtgtagaaatgtagtttgaagatcttgtagacctcttagaatggaaatcattttaagcagagtaagatacaaatataaggcactgttcattattatcttgacaggaagactgcagacatgttttattctcacaatttgacaacatggctgaggacaacatagaaaaaaccattattatgaagaaggaatcttaaaagtaggttaggaaacttaagccaagattgggaaacacacacacacacacacacacaagaaattaccgatacaagtccagcccagacacctgggacttttcaaggtcctagagtcatcctttataagttactttatgttatttcctctggctccaagacagattaatccagtcaatgtaatgatttgccagaaagaatctaccagtttggccaccagcacttacttcaagcgctacccacaaagttaaacaagcaatcatcatcatcatcatcatcatcatcatcatcatcatcaataacatgtattaaaaactatgtgccagacatgtgtcaaagtactcaatatgtataaactcatttcatcttcataacaacttcatgaagtaaatactatgatgactcccattttatagagtaagaacctgagcattaagaggttaaggaatttgaaaaaggtcacataactggtaaagttggagagccagaattcaaatccaatcaacctggctccataacccaggttactaaccactaccacagatacatctaccacttataggctgcagagtaagtaacaggaagaagcgaaaaattaaagaagaaagaaattgaatgaaatggtaatagaaaattcttaaaagagattatgaaaagaaaaagaagaaacccaagaggaaggggggaagattttctttctgccagtcagtttcccatccacattaggaagaagggaaaagtgaggccaactctagtttcccacaacttatggcatagttaacaaagtacttcaatatgatataatctaggaattctaggaaacctacacaggaaaaataactttccagaaggagtaccaggacaaacaggagagtcaataccaaaaaacaggccataaagttagtctcatgaaggtaccaccacgactccccaaacccccattcctggtgaatttcaagtccctaaagtgactgccatcatggactagctcttagggaatgcagtaatatacaaggaaaaaaacagagaagcatatccttccccagtccaaaagtaatttgaagaagctttcaataaaaagttatataaaaccagatttattaaaaaagaaattcagaaagaagaaagaaagaaggaaagaaagaaagaaggaaagaaagaaagaaagaaagaaagaaagaaagaaagaaagaaagaaagaaagaaagaaagaaagaaagaaaaaaagaaagaaagaaaaagaaagaaagaaagaaattcagcaccttggaaagagaaagaaaatatggtcatcccgaggacttgtagaattgaactaacatcaagtttagtctgggtggctttcaggaagccaaaggaaaaagagaaataaactaagttatctagttttccttagctcactccctttgtactaactgggtcttaagcctgagattccttgctggtctctatccacagtgacctaatcttagacctcaactagaaatgtgcctgagagggttgctccaaggagtccagatccacagcactgccttcttcccataacagagctatcaccaaaaactgcaaaggagataaaaactgacatagttctaaattccttaaaaaaaaaaaaaactcacacaagctctattacaaaagtgaccgagcaacaagatggaaaaatgtgcatcaaatgctccaaggaatagtacaaagaagtaagatgccttctaaggggtaaacaaatgtttataatgtacatcatgtttagtggcacggggctacatgttttcattgaaagccagacaacaccatggtttcatactttagtagttattcccagggacccacctgggcagaacaaaagacaaaatctaatcaaagagacaggaaaactagctgcaccccagcattataagagtagccactttccaatcactagaaatggtgtggctcagcctccctgctggaaatgtagccccaaataatttgaatactcatcagcaaatcattgctggatgaatgtcaatatcctagaaaccagttattctacagagtgctgccttcttcttaattagaattctcttgtgctcaacatgtatttattgaaatctgacttcatagatactgtgctaagaattaaattaaaaggtaaacaaaattacaagtgaagtagcaattcccacagcattttattaatcaatccatacaaaaataattattgcacacctatagtgtgcaaggtactaaagaatgaaataaaatcccatttctcatggaacagacattctatttgggagagtgaaattacagctattaaagtaaatgtcacaatgggaaaaaaaacttgcaaaaatagagctgggtaaaaggtaaagagtaactgtggggagtagctctctgagaagtgatatttgaacaagaaccattaggcttagcataatggcagtcattggtagcattgaaagaatattttcaggagattggtgaagatgaaggactattttcagtgggttctaaaaaaaggacaatcagttggatatatcacatatgtaaaaaaaatttttttaaagaaagaaacaggacgagggtaaacggaaacagccattaacgttaatgctaggaaactctgttgtaaaagggagcagagtaattggcaacagctaagagggatcttaggatctttttaaagatgggggatatttataacatccttgtatgatggaaactaaataaaagagagttttctttccttcctccaggtttcagggctctgaatcctatctcaattgtgagaatgctaaaaaggtacatctgtgatgtgacaggtaagatggggtcctttggagagtcgcctgcttcttctttctggcttcagggagagagagaatagcaagggcaaggctcgctgggcagcttaaatgtggaactgagtttgaagaacatgttcttcatgcaccctcacagtccacaaaatgactttaaccatctttttattcccctcccactgttccctcagctggagtttcagcagttaaagatataaagaaaaatgtttaaattctaaagagcagaaagtcaatagaaataaaacttctgggacaaagcagccccagttgcaggcagaccaagtactgctgattaccagcaagaaagccttcattgtaacagggattttaccctttctttggcattcctaagtaacaaaagagaagtgctgcaaaccaacgataattagcaatagttttattcacaccaaaatcattctaatatggtgcttgaaaaagcaaaataatcttttcacttaacagaaaaaaactgtactatttttgagcaactgaaagtcacgtcaatatattaattgaatgacctataattgctgcattgttctgatgtttatcttagaccctgcatgagtggtttttccttgatgctaatcccattagaagtaaaatggaccgcagttttgaatctctctgttccttaaaaaaaaaaaaaagttaattgacaagctgtttaatatgagatgccattttacagatgaccagattgaataataaaagaactaagggggaaaatgagcttttacctgtttcacaggttttaatatatatatattcaaaaatttttctaaaagggtaaaataaccaccaataccttatgcatataaagatgaagcagataaaaagaccaaacgcaataagaatctctcatactataccacatttatctcaaaaataatctttttgttgagaccctaatatcctccccttcctcaccatctcgaacattctctcacctcctctctccctgcctgcctccctgagaggactcttacacaccactctttgttctgtaaaggaatgcccggaatggacacaaggtactctgtcttggagctcagtgtcttgattttagaagcttgaaagggtatgaactacaacctaggggtctggaatgacaggcagggctacaaactacaacatcaagctccctaatccttttgaatattagagggaagaattgagcccttctttggagcttttccaacatccattactatttttaggtggtttccaggtacctaatatattcattcctataggccattctatttctgagaaatagaaaaacaaaagccccattcacaggctaattctaagtttgtccacaagtaatgatttccatgcatcgtcactgcagaaataataaagtgtcatgtctcatgaagatgatttctggctaagcctcatttaatctttgatcacatgaaaacattctaatttaaagcaactaataacagctgttatatatctaatgcaacatttaaaataactaagtactgctatgactaaatggatttcagcaatgatcatcaatggctactcacatcacagacagctagctatcctgtgtctcctaatgaaaatacacagatttatataaaaagtactcttgccttcccttgtttccccaccaagaaaatccttgcacctgttcagtcccctaaatcagtggttctcaactggatgatttggctcctggaggacatttgacaacgtccagagacattttggattgtcacgactgggcaatgctacagacatctagtggatagaggccagggatactgttagacattctacaatgcacaagaaagaactgtccggtcccaaatgtcattagtgtgaaggtcgagaaaccctgctccaggtctagctactaattgccaagaaatacagaggacagagaatgtgttaaaggacatcaggggacacaatgaacacaagccagactgtgggaaactccaggacaagtgacctgggtttttttttttaacaagtaaattgcaaggggtaaagaacagaaatagaaggaaaccccataaattgaaaggcttatgagacatatcaactaacttgaacataaagattttatttggactttgatttaaataatcaaactataaaaaataacaagatgattggggaattttaaaaactgactcaatatctgattattttaaagaagagttgtttaatttttaggtgtgataatgatattatgattatgtttcagtccttatattttagagataaatactgaaatatttacaggtggaattatacaatgtctaagaaatacttcaaaataatggggagaataaagagaataaataaaacaatattagttatgagttcatcattgatgtaattgagtgatgcatacaaaggggttcactatacacttcatgcttcttttgtatatgttaaaaaaaaccttccatactaaaaaaggtttagacaataatatgtaaaaataataaaatagctaagtaacctttaaacaaaaataagttatacgtttctattcctaaagcaaaatcttttaagagcacaggcatatggtttagacctaggttaaaatcctggctcccctactcttacatcttgataatctttacaatctctgtaaaacagagctggtcctcatacccaccttgcagcattgacgtgaaaagtgggtaaggtggtggctggtgctcggtgactggcagttccctttcccactttccacaagagctttaaacaaagaaggaaaacaaaatgggatcactcctgcaacccatcccctatactagcattttctaaggactttgatcgaggccattcatttccttcttgtatatatctgactgtgaccagatcaaagcactaacaaaagaataagaagtttcttttctacatttcctctgatttctgaggtttttttttttacactgctccataaatgaaacttagctataaataaacaaggtagagggaaataggaaagaatgcctcactgcaaaatcccttacatgcatgtgattcattttaggtcacagtgtgccctgaagggttcatgacttgtatgattccagaaacagtaagccaaatttggttttctttccttagtgaatcattatttcaccaactatttgtacttaaatttttttaaataaaaaaaaacttgattaaaaattcctgcccagatataataacttacaaagctcatttcctctgcttcgttcccttttacagcagctacttacatattcgtatcctgccaggtttttgccagaaggttcattggcaaagttgtgagccggttgtattagtgactttagtcttggctgcaaacattctgtttcagctgacttttattttccccaaagtagcagttcctttagtcccactgcatttgcaataaagcactcattttcatctacttgtaaataagggataaagacacagacttttggctggtggtacaggcctctggtggtctcttaacttgtacaagataggactttctccttctgtaaataaagccctccatgaagagcaatcaccagacttggaactagaagacaaattaagccctatctctactatacaacctcaaacaagtcacgcttctctttgaagtttttgtttattcataagagattataatagtgcctgccctattgtcctcataaaggaacctaatagtaacaactagaatttatataatgctctgaaatttataaaatgctacaaaatataacatatggtttatcattattattaatcaaaaatatcttcttcatttgcctaaatgaagaacctactgtgtgctttacaaagcactgaaaggagaatctttgacccctaaacttgctattctgtggcatccagacacacgctaccatctctaaacttgccagagtttagtctaaattctttgcataatttccagagtgaaggtaaatccaaagtggaaacactgtaatgtctttcaaaaaataaagacatatgcacatgtatgtttattgtagcactatttataatagcaaagacttggaaccaacccaaatgcctatcaatgatagactggataaagaaaatgtagcatatatgcaccatggaatactacgcagccctaaaaaggaacaagttcatgtcttttacaaggacatggatgaagctggaagccatcattctcagcaaactaacacaggaatagaaaaccaaacgccacatgttctcactcataagtgggagttgaacgatgagaacacatggatacagagaggggaacgtcacacatgtatcccagaacttaaagtaaaattaaaaataaatagataaataagaatatttcagatgaaaattagaacagaactgtactaggaactctgctaggaaatggagagacaatggcaaatagcacagacatttctcccaaagaaaaataacatgcaagggagaaagcactggagaagggtcgtttttaaaaatgcaccatgtggtcatggtatggatggaagcataggtcttgcttttgcacatatacaagtatatcttccatgaacagtatagtttgaaatgtacagtgactagaaacaatttgcttgccataatcaatgtatgttagctcctaccctagtcacagcaccatattgggaagtttagcaaaatttacacaagatagttcttttatcagaaagcataaaataaaccatttgtatcaaaggaaggaatttagagacaatccagagaactaaaattaaatcaaaattataaaacaatagaggagatatcccgtgagaataggctaaaacttgaatcttccgttggagacataataactgaaaagtttatgatcaagatttctaaggtacacaaaaatctgctcaccaattaatggaatactgggataatttcttgaagtttgaaatataaatttaagagcaaacaaaaggaagtacagtcaggaaccgcatatggctctttcggtcaacgacagaccgcatggactacatgtactacagtggtcccctaagattataataccatatttttgctgtaccttttctatgtttacatatgtttagctacataaatacttaacattgtgttccaattgcctgtagtatttagcacgggaacatggtgttcaggtttgtagcctaggagcaacagtatatgcctagggtatatactgtttaccctaggtgtgcagtaggctataccatccaggtttgtttaacaacactctatcacgttcacacaacaacaaaattgcctaataatacatttctcagaatgtgtccccctcattaaatgacacatgactatatctttatacagcacatagtaaatttatgaaatgcaggactgcacgaaaaggcctgtcagaaatatatgttatatgtatatattaaaatatatatatattaaaaactcaaggaacttctggaaaaattcataaacgctagacttgtaagaacttttcagagaaactaggggccagacacagtggctcatgcctgtaatcccagcactttgggaggccgaggcgggtggatcacctgaggtcagaagttcaacaccagcctgaccaacatggtgaaatgccatctctactaaaaatacaaaaattagtcgggcgtggtggcgcatgcctgtaatcccagctactcgggaggctgaggcaggagaatcgcttgaacctgggaggtggaggttgcggtgagccgagagcatgccatcacactcagcctgggcaacaagagtgaaactccttctcaaaaataaaaaataaaaaacagaaagagagagaaactgtggtatgcctgagattaaagacaattatatggactataggactgacacagcagactaattcctatcttctcatatcctaacacttctatataagcctcgaaagaggaagattgttctttacttacctgttactagataatgaaccatgattgcactttcttattttggtgtggtaatatttatacattatacatagaatactatgatttatatgtcttattttgtggtgatcagttacaaagagatatagtatgctgctgttataggaaaagacattttcaaaatgtaacacttttccaaaggtaatctgaaaaatgttgagttcataaaagcaggaaaactagtgagaaatttgacctagaaacttactatagctgtgtaataacagttaaaatttaccaaacttgattctgtactcaatgtatttaattatccttcctttcagaatctatgttcatgttaaaagtttcttactataaaaaatacagaaacttgatgcactaaggcaggacactcttagaatgtcttgttaaaaatagactcttatcagaacatcacccctaatccacaaaagaatctgccaagagattgcaataacaagaggcatattgtaggcatttatgtccatcaacaaatctaacaaattgattaaaatgccaaagggacaagggtgaaaccaaatacagtgcaaggactaaaacagactcacggcagtcattctcatcagctccatcggggcagtctctgacgtggtcgcacctgtattcacttgggatacactgaccattggagcatgttatctgatgacttgagcatgtactttgtgctgcgaagagaaaaaattattacttaatttataattattgctagacacagactaatctattgtcattaacaaggatattggaaagcataaagttcatagggacacaaggtaaagtacctggctaccaccaagctgagcttacaaagcaaaaacagaagtataatgttatcaaaatgcccagagaatagtgtccacactcaagcatgctatgtacacaattacgttatcaacatgtgtaaagaatacaatatagattttaaaactatatggtaaaaagtttaatgaaataaaaattttgcaagtataggtattaaccaaggacccccaacccacccattgaaatccttgtataaacaagaaggaaatataccaaagctttaatagcagttattccagagtggtgtgaatatgaatatgagtgattttatttttttctatatagtttcctctattctataaactgcctacattgaccatgtatcaattttataaagagaaaaaaatttaagctagcttgatttcatcccatgttgattagtataggtgaaagcagggcatcagcagttcatgaaatttgcctccggataaaacagataaaatccagtgaactgatgcccgcaagcatgatgtgaaagctatcctgtaaatctgaggcaggaattaccataacatggtaacattatcttatcctgggattttaaattgtctacatacaaagagctttgggggaaaacgtgatcatctaaaaaatataatataatcccctaatggaagaaaaaagatttgctctcaatttttacaaaacttcttttttttataattccttttttattattattattttactttaagttctggggtacatgtgcacagcgtgcaggtttgttacatatgtatacatctgccatgttggtgtgctgcccccattaactagtcatttacgttaggtgtatctcctaatgttatccttcccctctcccctaccccacgacaggacccagtttgtgatgttccccatcctgtgtccaggtgctctcattgttcaattcccacctatgagtgagaacatgcggtgtttggttttctgtccttgcgatagtttgctcagaatgatcgtttccagcttcatccatgtccctacaaaggacaggaactcatccttttttacggctgcatagtattccatggtgtatatgtgccacattttcttaatccagtgtatcattgatggacttttgggttggtcccaagtctttgctattgtgaatagtgccacaaaaaacatatgtgtgcatgtgtctttatagcagcatgatttataatcctttgggtatatactcagtaatgggatggctgggtcaaatggtatttctagttctagatccttgaggaatcgccacactgtcttccacaatggttgaactagtttacagtcccaccaacagtgtaaaagtgttcctatttctccacatcctctccagcacctgttgtttcttgactttttaatgatcaccattctaactggtgtgagatgatatctcattgtggttttgatttgcatttctctgatgctcagtgatgatcagcattttttcatgtgtctgttggctgcataaatgtcttcttttgagaagtgtctgttcatgtcctttgcccactttttgatggggttgtttgtttttttcttgtacatttgtttaagttctttgtagattctggatatcagccctttgtcagatgggtagattgcaaaaattttctcccattctataggttgcctgttcactctgatggtagtttctattgctgtgcagaaactctttagtttaatgagatcccatttatcaattttggcttttgttaccattgcttttggtgttttagacatgaagtccttgcccatgtctatgtcctgaatggtattgcctaggttttcttctagggtttttatggttttaggtctgacatttaagtctttaatccatcttgaattaatttttgtataaggtgtaaggaagggatccagtttcagctttctacatatggctagccagttttcccaacaccatgtattaaatagggaatccttttcccgtttcttgtttttgtcaggtttgtcaaagatcagatggttgtagatgtgtggtattatttctgagggctctattctgttccattggtctatatctgtgttttggtaccagtaccatgctgttttggttactgtagccttgtagtatagtttgaagtcaggtagcatgatgcctccagctttgttcttttggcttaggattgtcttggcaatgtgggctcttttttggttccatatgaactttaaagtagttttttccaattctgtgaagaaagtcattggtagcttgatggggatggcattgaatctataaattaccttgggcagtatggccatttccatgatattgattcttcctatccataagcatagaatgttccttcatttgtttgtgtcctcttttatttcactgagaatggtttgtagttctccttgaagaggtccttcacatcccttgtaagttggattcctaggtattttattctctttgaagcaattgtgaatgggaattcactcatgatttggctctctgtttgtctgttattggtatataggaatgcttgtgatttttgcacattgattttgtatcctgagactttgctgaagttgcttatcagcttaaggagattttgggctgagacgatggggttttctaaatatacaatcatgtcatctgcaaacggggacaatttgacttcctcttttcctaattggataccctttatttctttctcctgcctgattgccctggccagaacttccaacactatgttgaataagagtggtgacagttttcaaagggaatgctcccagtttttgcccattcaggatgatattggctgtgggtttgtcataaatagctcttattattttgagatacgtcccattgatacctaatttattgagagtttttagcatgaagggctgttgaattttgtcaaaggccttttctgcgtctattgagataatcatgtggtttttgtctttggttctgtttatatgatggattacgcttattgatttgcgtatgttgaaccagccttgcatcccagggatgaaaccaacttgatcatggtggataaactttttgatgtgctgctggattgggtttgccagtatttcactgaagatttttgcatcgatgttcatcagggctattggtctaaaattctctttttttgttgtgtctctgccaggctttggtatcaggatgatgctggcctcataaaatgaattagggaggattccctctttttcttttgattggaaaagtttcagaaggaatggtaccagctcctccttgtacctctggtagaattcggctgtgaatcagtctggtcctggacttcttttggttggtagcctcttaattattgcctcaatttcagagcctgttattggactattcagggattcaacttcttcctggtttagtcttgggagggcgtatgtgtcaaggaatttatccatttcttctagattttctagttgatttgcatagaggtttttatagtattctctgatggtagtttgtatttctgagggattggtggtgatatcccctttatcattttttattgtgtctatttgattcttctctcttttttcgttattagtcttcctagtggtctatcaattttgttgatcttttcaaaaaaccagctcctggattcattgattttttgaagggttttttgtgtctccatctccttcagttctgctctgatcttagttatttcttgccttctgctagcttttgaatgtgtttgctctggcttctctagttcttttaattgtgatgttagggtgtcaattttagatctttcctgctttctcttgtgggcatttagtgctataaatttccctctacacacgctttaagtgtgtcccagagattctggtatgttgtgtctttgttctcattggtttcaaagaacatctttatttctgccttcatttctttatgtacccagtagtcattcaggagcaggttgttcagtttccatgtagttgagcggttttgagtgagtttcttaatcctgagttttagtttgattgcactgtggtctgagagacagtttgttataatttctgtccttttacatttgatggggagtgctttacttccaactatgtggtcaatattgaaataagtgcaatgtggtgctgagaggaatgtatattctgttgatttggggtggagagttctgtagatgtctattaggtctgcttggtgcagagctgagttcaattcctggaaatctttgttaactttctgtctcgtggatctgtctaatgttgacagtggggtgttaaagtctcccattattattgtgtgggagtctaagtgtctttgtaggtctctaaggacttgctttatgaatctgggtgctcctgtattgggtgcatatatatttaggatagttagctcttcttgttgactggatccctttaccattacgtaatggccttctttgtctcttctgatctttgttggtttaaagtctgttttatcagagactaggattgcaacccctgcctttttttgtgttttccatttgcttggtagatcttcctccatccctttattttgagcctatgtgtgtctctgcacgtgagatgggtttcctgaatacagcacactgatgggtcttgactctttatccaatttgccagtctgtgtcttttaattggagcatttagcccatttacatttaaggttaatattgttatgtgtgaatttgatcctgtcattatgatgttagctggttattttgctcgttagttgatgcagtttcttcctagccttgatggtctttagaatttggcatgtttttgcagtggctggtaccagttgttcctttccatgtttagtgcttccttcaggatttcttgtaaggtaggcctggtggtgacaaaatctctcagcatttgcttgtctgtaaaggattttatttgtccttcacttatgaagcttagtttggctggatatgaaattctgggttgaaaattcttttctttaagaatgttgaatattggccccccctctcttctggcttgtggagtttctgccgagagatcagctgttagtctgatgggcttccctttgtgggtaacccgacctttctctctggctgcccttaacattttttccttcatttaaactttggtgaatctgacaattacgtgtcttggagttgctcttctcgaggtatgtctttgtggcattctctgtatttcctgaatttgagtgttggcctgccttgctaggttggggaagttctcccggataatatcctgcagagtgttttccaacttggttccattctccccgtcactttcaggtacaacaatcagacgtagatttggtcgtttcacatagtcccatatttcttggaggctttgttcatttctttttactcttttttctctaaactgctcttctcacttcatttcattcatttgatcttcaatcactgataccctttattccagttgatcgaaacggctattgacgcttgtgcatgcatcacgtagttctcatgccatggttttcagctccatcaggtcatttaaggtcttctctatgctggttattctagttagccattcatctaatcttttttcaagatttttagcttctttgcgatgggtttgaacatccccctttagcttggggaagtttgttattaccgatcgtctgaagccttcttctctcaactctcaaagtcactctccatccagctttgttctgttgctggtgaggagctgcgttcctttgaaggagaagaggtgctctgatttttagaattttcagcttttctgctctggtttctccccatctttgtgattttatctacctttggtctttgatgatggtgatgtacagatggggtcttggtgtagatgccctttctgtttgttagttttccttctaaccatcaggaccctcagctgcaggtctgttggagtttgctggaggtccactccagaccctgtttgcctgggtatcatcagtggagtctgcagaactgcaaatattgcagaacagcaaatgttacttcctgatcgttcctctggaagcttcgtctcagaggggcacctggccgtatccggtgtcagtcggcccctactgggaggtgtctcccagttaggctactcgggggtcagggacccacttgaggtagtctgtccattctcagatctcaaactctgtgctgggagatccactactctcttcaaagctcagttggaaatgcagaaatcacccgtcttctatgttgctcacgctgggagctgtagactggagctgttcctattcggccatcttggaacctccctcctctcccaaagcgctaggatttgaatgccacaatacatattgattcatgtttttgtccattagtggtccgtgggtatctataaatgaagtctattttagagtccatagatatcagcgttctgcaaaactgtcagggatccgaggctcccagcctacagagcttcttttacttatatgtagtatagatatttaggttcagcaaaacttggttttctgataaaattagatctgttaaggaatgtacccccaaaacttaacatgaaaaaccttttcaaacgacaagtaaacctggcacagtggctcgtgcctttaatcccagctatgggagattgaggcaagaagatcacttgaggccaagaattcaagactagcctgggcaacatagtgagatccttatatcttaaaagaaaaaaaaaataaatttagctgggcacagtggctcacttccaagtagctgtagtcgtagctatttggaaggctgaggtaggaggatcacttgagccaaaaaaaacttctctttttatgtagttagagtgagctataatcatgccactgcactccagcctgggcagcaaagcaagacccctgtctctaaaaaaaaaaaaatatgtaaaagataagtagacagtgacagttttcaaggtggtacttgaaaattcaaacatatagaaattatcatgtgataagatataataattataaaaccataattaacacccttctccatgcttaattgattatatcttccttgtcattttgttccttctttctgtttaattagcaaaatggtgtcttataattctggaacagcaaacaaaatttttcaagtcagcctacttctaacactaaataatttcatattttctctaagtaccttatacctgtgggtccaattttacttctattaataaaggcagaatagatagatttttccagaaggcacttaagtgtctgaattctgcccatggcagagacacaattttatctgaaaaaggttaaagagattaatacttcctcattaaatttccaaataatttatttaagtatatattgccaattttcacataaaattaaagaactttcttttattcccgagaaggcaagtcatgggttgtctcaaacaaaatatgaaaagaacctgggtcaggtatcagtgctcgttcaattaccttggctttcttctttacgtcaagcccaaataattctaaatgttgtgcttaggttttcaaagggcttacgaagaagcaattaaaagctcattcaaatgtagagagcaaacaaattaaaattatataattccatcaacctatctaatgctgagattcatctattcattaattacacaaacatctgttgagggcctataatgtaccacacagtatagcaatatggggatctgcaaatgaataaggcacaatccctaccctcaagaagctcatagtcttctaggggacactaaggagtaattagaaaacaattatgaaagtggattataggcacacaggaatgatagaaccatcaatccaggaacttaattcactctgggatgggagcatggatggggacagtttccttgaaaaagtgacacctccctgggtcttaaagaagcagcagtcaggtaggccaaaagcaaagaaggactgtctagaaccgagcattcagcattcagccagcttgcacggagacaaaaggctaggacacagcatggcacacccacaggaactaaaagcactgctgtgcccaagtggccacttcaaggcaagaatagcaaatgatagacataggaaaataagcactagtcacatcttggaagccactgtaaaccgtgttagggaattggaactttctcctggaattaatggagagctaccaaagaatcttagttagatcagcatcagtgtcagagagaatctaaggatccacagaactggaggcagggaggccaacccagagactactgctgacacccaaatgagagatgttggcagtgggagcagaaataaagagatgggtcagacatggtggctcacacctatcatcccagcacttggggggccaaggtgggtggatcacttcaggccaggagttggagaccagcctgggcaacatgggaaaaccccatctctacaaaaaaaaaaaaaaaaaaaaaaaatacaaaattagccaggtatggtgccatgcgcccgtagtcccagctactctggaggctgagaagtgggaggaccatttgagcccaggaggtcaaggctacagtgagccatgattgcaccactgcattccagcctgggcaacagagcaagaccctgtctcaaaaaaaaaaaaaatctgtccttgccaaaaaataaaaataaaagagagagaaatgaagagattaactttagaaatatttatgaggcaaattaggcaggagttggtgattcaatgtgggcagtgaaaaagaggaaggaatcaagaataacctccaagtttctagcgtgggtgcctaggggattgtgatagccttttcatgttaattgattatatctttcctgtcacttacagcaatctttcttcttcatctaataaaatactttcattatgaaatatgtttcacaaattcaacaagtaagagagcctccatctgcctatttccaatagtttaagactgattttgtattttctgccagtgcctcatagtgggttaaatgctatttctattaataaagataaaatatgtagactagcaaatatagaaggaaaatccagttcaggagggaagatgattattttcagttgggacaccttgagttcaaggcaacttgcagaggtccaaaggtagttgagtatacaagactcaagtgtgggcaaaaatctgggttgtaaacacagatttaagtctcatcaggccacagagggtcactaaagtcatgagaatggtgagactatcctgagagtgtccagaatgagaaaagctgctcagggcagggctctgagcaacaccaatactcaagggctgagtagaagaggaaaataaaatggaatgaccaaagcagctcaaaagagagccaggactgctgggagtcatggcagccaagggagtggtgtcaagaaggaggaatggtctccagagtcaagtgcaatctaaatgcccatccagtgtgagaaggaaggaaaagtgcccattggcaatcaggagttatctggtaactttagtgaatacagaggtggcatattttgtttgtggttaaaagatatctaatggagaatttttatatcattaaaaatgggagaattgcctcatgaaatgtatagtcatttaaaatgatatgcaatattgttttaaaatgactgctataaacttatctccagtctcttttcccaagcagttgcccttagtagttccaatcccctctgtaaagtattattattagcaaagggtcatccaccacacattgaatcgcaaaataaagctcagctttcttcccactctgtgagaggagtaagagaaaatagactcaaaactatatagcctaaagatgaacaacccatcatttatgcatttagtatctatctattaagaacctcctctctgcctgagagaatgtcaggccttcaggatgcaaattttgagacttgagcagcttttatgcaatcaagaaaggccaataggataaatatggcagagcaaaaaagtgagaaaaagctggataatatttctgagctgggaattaatcaaccctggaacaaccctatagttaggcttcttattatgtgagataataaatcccctttttgtttaacttttttgagttgtgttttctttccttgcagccaaaaacatccacaatgatacaagaatgattttaaattatacaaatatccttaatagagaaaggaatggaatgatacatgtgatagacaaattgctcataggtcgccatcttatatttacccaacattacttctcatctaaaattattttcaggccagtcatgggggggtcatgcctataatcccaacattttgggaggccaaggcaggaggatcactttagcccaggattccagaccagcctgggaaacgtaacaagatcgtgtctctacaaaaaatttaaaaattagctgggcatggtggtgcacacctatagtcccagctactcaggaggcttaagcaggaggattacctgagccccggtgtttgaggctgcagtgagctgtgatcgcaccactgcactccagcctgggtgagagagtgagaccctgactctaaaaataataataaaataaaaataaataaaataaaattattgttagacctattaaaacagtcttttccagtctgattccaaagaaattagaatttaaaggttttttccaggttactgaaccaaaccccctcaatgtccagggatgccgcagttgccaagatccgcttcatcgctactattttctttcttgttcaagctctccctatggtggctgtggcagcagtcactgaagtaaccaccaagaagccctccaacaaacctacctacttccactcagtcaaaaagaagagaatttaatattggggcagaaggagtggaaggtttgaatacaaagtatgccacagagccaaaggactcattcagctgtcaaccacacacatgaagacacccagctatacactccaataaatatttggttcctttcttgagcataacataatcaaaattaaagattgggaacctatctcacttccaaattgctggggtatattcataattcttcagtacatccgtactttcaatatcatccaacccctgaatgagattgctggcataggttcccttatgatttaaggccctgctccacatttataaagaatcatcccattgtgtgtaacttctttgcgacaggttgggttttaggtgtccacaaagccaaagcaagattcctctccaaacacttacagcaatcttgacgttcatctgagccatcatcacagtcttgatcttggtcacacacccaggagttggggatgcattgtccctcactctggcacttgaaatagccctgctggcaggtcacaacagctaaaacaaaccaaaagaggactcattatggcaatcatcctccccattatactagcaagcaatgcttgttccagaagagtgtatcatgtaaactcctgctcaatttatttgaaggcaaatagtaaacaacccttatactagagtctgtggacgccagtcagagttcactgtcaaataagctcagcaacagcatcacaacaaactcatgaaccaaagcaacttaaaaacacagagaataaaacaaacagcacacatacacacaaaaaaattatgataaaggtattagattaaaagcttcattcaagtaaacattaactgtgagttactgttaaactatttgtttcataataactaatagtaaagtatcatgatgaactggaaaattcatgagatttgggaaagaaaacccaaaatcaaataattattatttccatgatttacttcctttaagatctttggcaggttctctgaacctcaatgtatgcatcataaaatggggactatactcatctcactgtttgttgtgaaaaataagttaaataatgtatgtgaaagcgccatgtaatgttacttgctatcactatcgtcattgatattgttgttattgttattatttttacaggtcaataaaatataatacaggtaacaatctctgaagagttgttggcatagctgttcacttattcctttaccccagatacactgcccttgcctttttgcttttattgtttaatcaaaatgaactcagtaagcccagaggaggcaaatagttagcacatgattgtgtctctacaaatatagtttagtcccttgttcaaagtgcagtccacaaactagcagcatcaacatcatcaggaagtttatagaaacgcagaagctgaggtcccacctcaaaatatggaatctaaatttgcactttaatgagctcctgggtgatccatttgtgcatgagtatttgaggagcactgtacagaaccccatccttacccttcctcccattttcaaatgcgttgtcatctaaatgacacaccaaagtttgactgctatggtatgccataacatggccaacaattcaaaacaaaaatttttcacctgctttcctgatttttgaaagataaccctcattagttcacctgctgggatgaaggaaattgcagatgtatgattgatcacctatgggaagttgggaagagcaatgggatctgtgcatagacttaccaactgtaagaactttaataaatgacttaacttctccgagtctcaatttactaatctgaaaccgacctcagaagattagtgagaaaactaaatgacaaaatgaatgtgaaagtcattttataattaattagatttgaagtttactacattatcgtatttttcaaattttttaaaactagaatttttaaaaaacataaatcacactaaccaattctgtgatttctttatggtaattgacacaagttattctacatcctttacataaaaatggactcctctttgacttacaaatcacagtagttcagataacattattttttgtttgttcttgtgggtacacaaaatttacagagtgaatattagaaataatcacctacagactccagaaaactgcacccaaatatgtttccatatcaaagttgtggtcaagggataagggtgagatagaaactgatgctctatcatcaatgtgaattgaacccctacctcagaagggagtgaaattattgttaatgccatcagttctctattcaaccacacagatctcaaaagacttgggcccagacctggctctgtcactaaaaggcatagctcttctctttgttacagctgaaatcaccaggaagcacttaggttactcaaaatagaacttagcctggcccctcctcacttaccgcagccaatttcatccgcgtcatctgaacagtctttggtcccatcacacctccagtctgcagggatgcaatgcccacttccacagcgaaaatgcgcactgtcacattctgcaataatagacagaaattttaaaaacttatgccatgcagatatttaaccgaagaaatataaatttttgataaaatgaaaaattattcaactaattagataatcaaagaaatgcaaattagaaaattaggtaaacattctcccaatgataatataaaaatatttatttgaacatccgtgggaagaaagtgattttcatacacagttgattagtgtgtatcttgatggaactcattgggaaagcagtttgacaacacgtatcttgctttttaaaaatacttgatctttaatttagtacttttacttcaaggatttttttcctaaggaactaatcaaagaagtagacaaagatttatgtataaagattttcatcgcaacattatttataacaaaggaagttgcaaacctcctaaatgtccaacaataaaaggattaaatttgtttacatctttatattgacatattagtaacttaaaaaatggttatggagaaattctaagtacttagagaaatacttataatttaatgtaacaaaaacaaggacgtaaatttttactgataacagagttacatatgcaaaaaaaaaaaaagcgtaaaaaagaccagaatgttaacagtggttatctctgattgataacatcgtgagtaacttttcatttgcttgactatactttcttgagttcctcaccttattttttaagtgattttttattactaaatcatatatagcaagttatggcctttcattcttagattcagactaatattttgtcttaatttttaaaaattaaattataacttgccagatctataagctcatctctgcaaacaattttttttaaaccaaagagccaaaaacaaaacaaaacaaaatctctgcagccaacaagagtatacaaacttgacaccaaaagttgacaccccaagtggcagtgatagtccctagtgatactggaaggacaatataacttaaacaagctcacttcactgaactaatatatcctgtgattttcctaggtctccccaagggacaaagttccccaaatacctggccagtgaccttcccaagcattatgtgccacatagaaaaatttttcaaagaaagcagccactaccagccccacttagagaagactcaaaattattttattctttcacaaacccaagggataaaggagaaatttttgcagttggaagaataattatatcttccccatgtatttaagcaatcatgctaaattacccatttcaatttttggctaattaaccaaaattaggtaaatatacagatcaagtacctactcctaaaataaataagcaatgtgctatcctgatttgtgtaaatgcaggcatatcaacagcatgacataaacatagttaagtgatctatttctagggtatataggctactttgttcatggaatgttcaaatctgattgtctggtagtgacatcctgatttataatgtatgctgcaaatggtcagaaacttcgcttggctaaatggtggtaccgagtggtacaggagtacgtacacccaaataccttctatagactaatgcatgatggtggttggtggtgcaggtctggggttggtggtgcaggtctcttatcaactacctttaaaacacaacaacctcccttgcaaaaatgcccctaaggaatgtacaaattcactctggaatcccagaacttctcattggattttgttctacaaagcaatatttccatgggagattaggggctttggaggtttagctattaacacaacatatattaaatcacttttatcaattaggtctattgttagtaatccaacataatacatttgtaagttcagtacatttgtctcccttagtatctgaggttgtaaaggtagtatcttctggttgaaaaattataacaatcataaagaacagtcctcttacagacagtttcatattgctatggagaaaagaaaaatataaatttagagactgagtatttaggaggaaattatcagaacaatatatattgcctgttttgaaaatatatataattaatgctatttcttaagcaacttttattacaagtcccatttttgaggagtggggtggggggatttgtttgtttttgccaaactaaaataccaagttaaacacatcatgaaaagaacacaaaatagagactcaaaagtcattttataaaacacttcaaagtcaattatttaaaatcacacatatgaaaaatgaaactgatggggaaatgttgcaattaactaatttttataggtagtgattttcacacttgatctcctcactccattatctaatatatcaaatccaatttactcaatttatcaacagatctataattcatttgtcaaattcaccttttcagtagtaacttcgatgcctgtttataactcccaaacgactattgtttggaaatatctctccagaaaaaacaaactgatactttatcattgctgggtgacctctcagccatcagccaaaatgcttcactggcctcagaagctcattctctcataaagggaatatgtgttgtttaaaaataaaccaaaaataaaccactagtgaaaaggtctagattaggtctaataacaattgcaggtgccccttacttcaattagtctatatgcaatttattttgagtgttttgttttaaataagtagcctttactcacaagccctccaaaagttttatctagatattatctacattttgttatttatttgaagatttaaaaaaaaaaaaagctaaggggatgatttcatacattggagccacccacagggagaaaaaaaaaatctacatagaaccagctttaaaactttgttcagaaaatagtctcaaaactgccacattcaaccaatccagttttagccaagaagtaatcttgcaaataatcatttatgtaactttaaaacattctccaggagcctctctggtttgggggctgcctgattaaaaaaaaaaaaaaatccctctagtaaaaaccaaggaggaaaggaggaaaatacaatccacattgaaataaaaaccttttgttaagaaccaggcaatcatcacaaaggaaccatcggaaccaaatgaacaccctatctctccagcactagcccctgtctgtcccatcaatcagaatagatggtgcaaagatgaaaagaagtactcatatagcacttaaatggcacacaccattctaagtgctctgccaacattagctcatttaatcctcataataaccctatgaaatagatactgttattatgaatattttacaaataaataaattgaagcacagagcaattcggtaacttgcccaagatccaacagcaaatatgtgcaaagcaaggatttgaatctgacagctctgattccagcattcgtgctacttgaccactactctatgttccctttcaccaaaaaaaaaagtttattccactaaactcaagaatgaatgtaaaaatctgatttttttcccccaaagctgctctcaattaacattaattgagttcattattgggctggcatagaatccatagtgcttatatacttcagttggagaaaaagagtagtttacttggtgactaacatagcattaaaaaattattgggcttaggaaaaattgcagcaattgaaagcaatgcaaaaaaaatttaagcgttttgaaatcggtagtaaaattttattagacataggaataaacttgttttccaacctcataaagagcccaaagctaggggaaaaaaaaaaaaaaagagtaatcctttcttcataagtagccatatcccaagcttcctgggtaagtgttggactaagaatgtgttaagataagatattagagtaacagatagcgcccagagaagaggagtcatttgcctgtttgttttccacagcaaggaacaacactggattgagagcattcctctgtgtcatttacagcctctggcacagcaccgggtgcttatggaatagctaatgcatgttcgtcaggaagtgtagaattctctttgtaaaactcagcctgctgagaccattatatatcagagatatagaaagctatcagagcaaacaatgagactttaaatagaaatttaccatcttaaatccatagaaagaaaaatggaatctggaataatctgaaaaaaggggaatatctagaagtttttttcaaaaaaaaaaaaaaagaaagaaaaaaacattgagtcatattaatagcagtttcattcttttacccgttccttgtaagtttctttctccttccataaattctattcttataagacaaagacaagtggtagtcaatggaacattgtccaaagttaacagagtaaggtaatttctgtggcaaatcctatttccccgctagatcctcttaacacatgctggtccttccaaacacttggtctacctgaggaggtacagtcctctttttaaaaatttgtatgagtaaatcacattttaatagttccaccttcactgaactcaaagaaacaaacaaatttaagaggcaattccttaacttatccataatttttgcttcactttttctatacttaattttgattcctttggtatggatagacatccttctgatattcataagttggctgacagttcactacaattcccataccttgcccacataaacaaggccagtccccttttgaagatttagagtcacctgcttatttccaaaactttacactatagtgatgatagccaagggtaacaaattgtatggagcactctaccctgtctagtgtcaaattgatagaatagtcaaggattcagttaatgaaactgaaacaagacaggaacagcaaaccaacctgctagtctctttctgtgcaacattttaactgtctggttttccttacagatcatcaaataggtggcaggaattcttttgggttttttttttaatccagtttacaaaccactgaatagactgctttgtcccaattattgattcagagccctgatgttttcttagagcaaaacaatactataaggacatttcaagaagtcaaagatttggggacaaaacccacaatgcaaattgatgcattatcatgtagacacatcatttaagtgcaaaaataaatgaataaataaataaggaccaaaagaatatgatgccagattcactaaagccacaaataaattcataactactatatgcaattgtcctaggatcagtggaagaaaaaagaaaaataagatatggtccttttttgctctgcctctccctctccctctccctctccctctccctctccctccccctctcccctctcccctctcccctctcccctctcccctctccctctcggtctccctctccctctctttccacggtctccctctgatgccgagccgaagctggactgtactgctgccatctcggctcactgcaacctccctgcctgattctcctgcctcagcctgccgagtgcctgcgattgcaggcgcgcgccaccacgcctgactggttttcgtacttttttggtggagacggggtttcactgtgttggccgggctggtctccagctcctaaccgcgagtgatccgccagccttggcctcccgaggtgccgggattgcagacggagtctggttcactcagtgctcaatggtgcccaggctggagtacagtggcgtgatctcagctcgctacaacctccatctcccagccgcctgccttggcctcccaaagtgccgagattgcagcctctgcccggccaccaccccgtctgggaagtgaggagcgtctctgcctggccgcccatcgtctgggacgtgaggagcccctctgcctggctgcccagtctggaaagtgaggagcgtctctgcccggccgccatcccatctaggaagtgaggagcgcctcttcccggcagccatcccatctgggaagtgaggagcgtctctgcccggccgcccatcgtctgagatgtggggagcgcctctgccccgccgccccgtctgggatgtgaggagtgcctctgcccggcggcgaccccgtctgggaggtgaggagcgtctctgcccagccgccccgtctgagaagtgaggagaccctccacccagcatccgccccatctgagaagtgaggagcccctccgcccggcagccaccccgtctgggaagtgaggagcgtctccgcccggcagccgcccagtccgggagggaggtgggggggtcagccccccgcccggccagccgccccatccgggagggaggtgggggggtcagccccccgcccggccagccgccccgtccaggagggaggtgggggggtcagccccccgcctggccagccgccccatccgggagggaggtgggggggtcagccccacgtccgggagggaggtgggggggtcagccccccgcccggccagccgccccgtctgggagggaggtggggtcagccccccgcccggccagccgccccatccgggaggtgaggggcgcctctgcccagccgcccctactgggaagtgaggagcccctctgccgggccagccaccccgtccgggagggaggtggggggatcagcaccccgcccggccagccgccccgtctgggagggaggtgggggggtcagccccccgcccggccagccgccccgtccgggagggaggtggggtcagccccccgcccggccagccgccccatccgggaggtgaggggcgcctctgcccagctgcccctactgggaagtgaggagcccctctgccgggccagccaccccgtccgggagggaggtggggggctcagccccctcccggccagccgacccatccgggagggaggtggggggatcagcaccccgcccggccagccgccccgtccgggagggaggtgggggggtcagccccccgcccggccagccgccccgtctgggaggtgaggggcgcctctgcccggccgcccctactgggaagtgaggagcccctctgcccagccagccgccccgtccgggaagggaggtgggggggtcagccccccgcccggccagccgccccgtccaggagggaggtgggggcgtcagccccccgcccggccagccgccccgtccgggagggaggtgggggggttagccccacgtccgggagggaggtgggggggggtcagccccctgcccggccagccgccccgtccgggagggaggtggggtcagccccccgcccagccagccgccctgtccaggaggtgaggggcgcctctgcccagccgcccctactgggaagtgaggagcccctctgccgggccagccgccccgtccgggagggaggtgggggggtcagcgccccgcccggccagccgccccgtccgggagggaggtgggggggtcagcgccccgcccggccagccgccccgtccgggagggaggtgggggggtcagccccccgcccggccagacgccccgtccgggaggtgaggggcgcctctgcccggccacccctactaggaagtgaggagcccctctgcccagccaccacctcgtctgggaggtgtacccaacagctcattgagaacgggccgggataaaaaaaaaaaaaaaaaaaaaaagaaaaaaaaagaaataaataaataaataaataaaaagatatggtccttttttgacagagcctataagtttattgggggcaaaagtgatttatatgttataaattaaatatccatgcaataacaacagctgatattgtttactgagtacctactatgtgttatacaatatataaagctttatacatatccactggatcctctcagaactgtatgatgtgagatttatacttatttaatagaaggggaacctgagcctcagtgacattaaccaactcccccaagggccacaaaggtagaaaatgtcgaagtctgatttagccccaggacctgtgtgactccagagcctgtacttatttcatcatttcatgtcctgcaaagcaaatgacagcatttgttcacccagaacttgccagcaatattttaagtgcttcccatgcattaccttacatatcctcacaacagctttgtgagatggtatcaatggccccatttcatagatgaggacgacaaggcttgaacaaatctcacagctagtaggtagtggagcacagatttacactgaggcagtctgattccaaagctatgcctctgacaacagacaatttggttccaaataagcaatggagataataaaaactaactgactttggcgaaaaaaataacactacaggccggtgtcatcagagaagtcttcacaaagaattataagactacactgggtctttgtgaatgagcaggatttgggaaggtgaagagggagaccaggctttgtgtgtagggtcaaaacaacttgacaggccaggcgtgatcactcacgcctgtaatcccagcactttgggaggccatgccaggcagatcacttgaggccaggagttcaagaccagcctggccaacatggtgaaacctgtctctaagaaaaaaaagaacaaaaacttgacagaagcttagcatgggtgagggtctaataagtatgacccaagcagtgatgacctcttggagagtggtaggcaacaaggctgagaagatggagaaaaagagctttcagtgccaagccaaagagtgcctgtcaaatgagtatgagggtgattactcagacaataactgcattaaaagtgaagatcactctgagtaggtaaagcctgaactagcatacagactttgaccatgaaaagagcttggagctccacttcaatccccagaacctcaccccaaccctgagcccagtgagcaggctggtaggtgcaggcaagaggctgctagcagagaagggtctcaccttgcagcccctccagctgccccagaagcatccaaagcaggtccgcttgcatggcaaactacgaacaggttccatgagggaggggtccccagtccctgggctacaaactggtactggtccgtggcctgctaggaaccaggctacacagcagcaggtgagaggcgggtgagtgagcattagtgcctgagctccgcctcctgtcagatgagtggctgcattagattcccataggagcacaaaccctgttgtaaactgcacatgagagggatctaggttgtgcattccttatgagaatctaatgcctgataatctgaggtgaaacagtgtcatcccgaaaccatccctcccccaccaccaccctgctgtccatggaaaaattgtcttccacgaaaccagtccctggtgccaaaaagcttggggaccgctgccttagggcattgccaacaacatcctagtgaccagcccccaccatcctctccaagctggatgtttctgagtatccaggccacagaatccagtcagctctcaagatagttgatctcaaagattacttaaatatttgcttagtaattaaaataaagtgcctttccaataaccaaatggcagcagaatgagatgtactacttgagcagcctctcaattctgagcaatgagagatttaaactgagccatttataactgagctacccttctccatttccatttaaacactagtcacctgtctttctcccccaaggctcttacatcccacttgttttttcattatgcacctctcacctctacaatcaggcagtccatcagcactacagaacattataagcaaagccacacttctcagaggttcttcagaggacgctatcgccatttggggtgggacaattactcatcttgcagaactgtcctggtcaaagcagtatgtacatcatccctgacccccacctgtggaacaccagtagtgctcccccacatcacggtgacaaaaacactcccaggcacatctatgccgcttgagagtggcagtaccacccccagtggagaacaactcagaacctctaagcagcttggacagtcagagctcaaaattatcttagcccacatgaaagagatcatctaaaaaaaaaaaacataatacattcttcccttctaaagataataaaatttcttaaacagcaatcccactccttcccacccatcaataagagcacctaggattgggcaatctcacgctgcagctgctagtaccagcaacttgaaatgaactcccctgggagagtgataaagaatctaatttccaggaaggcctgtttcaccctggaatgctccattccatcacacgtccacaggtctaccccttcaaggggaggggaccacactagaaaaacacaagcatctgaaatcctcaagtagttcatcattaatgtaaaggattgtggctatgaaaaacagtcataagcacctctgcgttgtggtgcaaacttttcccgtccgtattcattatcagagcaaaaaaataatttctccaaatgtcctctccccatcccaactgcatacattcacaaaaaattaaaaatataaattgacaatcacttaagcgctcaaacattcaaaagaatgtccaagtttttaccaagaacgctgagcaatgaaaacttcctgttagccagcatcaaagcactgaaagtgtatttgtaccagtcttttctgtgctccccctgaatagctcatgcagtgcctcctctatcagctaagtcactgaggttcctggagaggaaccttccctacacgtggaaggaaactaagctcaagactttcttctcctctggccccaatccccactagagactaactggttatttacatctttcatggtaaaagagctacacttacaggatgttgaaaagaacactatccaaacagaagaaaatttaagatggcctgcctgcccaggtaaataaggacccaatgaatcaaactacttacaagaataacatgcccttcagcacctcatgatttgacacaccctgtgcaaaaactacaaatcattcccatttcagagcacatttccagtcccagtcacccagagaattcctatacggctttttgattagcaatataaattactggaaaatggttgagtggaatcaaacactaaaaaagaaaatggacattcatgagaaataaatgacaagagagactttagaaaggcagctttcttgcttaaggcttttgaatggtgtttcagactagcattgatagacagcatcaaattagggttttcctgattaattaggtccaagtgttgaaccataaatcaaactgacatggatatgttaaagctataaacatcactttcattttggtcatcttaataatcagatgagatcaccaggttatcaagtgaacaatagttggatactgcaaattatgacaatagcaacaagaagagaagaaattgactctcaattggtagatttggtaattccccatagtcataggctaaattatttataactactaaatggaccttcttgactgaatcttataaacaccttgctgtattccttctccctaactccatattatttagttcttgactatcgcaatagtaacaacaagctctaaagaaacgagaagagagagaagaggcaaaaatagggagaaaaagaaaaagggagacagagaaaaagagggcagaaaggagagatgtcaaggttagcaatcagtgtccagacactaaatttcatgagacctagcatcttgcatcctagccttggtttaaatgacacctggcatcttgcaccttaacctcaatttggtacaaaatggcaactcacccttatttagctatggcccaaattcagattgaagcagtatgtaattgctaagtgggtttataagtcacaagttacatgctaggaactaaataacctcccattctaaatgtgtaaattttcagaaagtagagatcaggtatatacatatatatatacacacacatacgtacatgcacatacacatatatatacataatttactctaacgaaaccaatgcttcaacatcaataagcaactctgatgacaactcttatcagaaatgtttatgcttggtgatggtgaggctcattgcattgttattcacacaaacactaaactttattcacagttcattcgttagatgaataactgagttgcacacacaggcatgcctcgaccttgaccatttagtgatgggcatgtatggcttctgccaacagagtaagaattttcttaaactattaagaaatattgtgcagcaagagtgccaaaagatttccaacaataagtttaaaagccttttcttgggcagtaagtactgataattaatcatctagtaaactgaagtcaacatttttaataaaaatgtaatatgtcattctcttttttaaaaactggttttgctgatgttttacacaatatttttgtatttttcccctttagtgacaagttatgccttggaaatgattttataagcagaaagttcaaaattctcctgccacgacctggatatgtgaaatataaggaacagaacagatgagactaagcgacctctgtattcccagggcctgttacaggacctcctagtacccagcctaccctcaataaacgaactatatatgatgtgttagaatatatgtgtgaaactaagatgatgtccaaaagatgacaaagagatctacaaggaaggaaggagggaaggaagaaaaggaaggaaggaaggaacgaaggaaggaaggaagggagggagggagggagggagggggctacaagagtacttcttatcctacaatcaaaaattgtaatttgttttataagcaatttgctaatatagcataatcatgattttaatttccctatagagaaacaaatgtaatgccaaatcattgccttgtaaatctgtaaagaaggacctattatatttgcaaatactctcatggtagaatgaccttaaatttcctgtgtctcccctactggattgcttttaacagactgagcaaaaagaacttcagaacatgcctcaccagcaggttatctttgcaccaggagtcctttggccctggtttgttatgcctgggctcaaatagcatgaggaggtctccaaaccactttcaggctctgtcaatgttatcacttcacgttataatgtgattgtgatgacttgaaacaattcaatagcttgttgacacagaatcaacaatattacattgtcaccaactgatacccacgtgtgataaagtggtgttcaggtttctgcacagacatgatgaatttataatgtccccatattaatagcaacatgaataaaattacaagtttatctgcagtgattgccagaaatggaaggaaaaaaagcagggtatatttcctaagattttgcctaatctgtgttttaaatatcattagtaattacagtaaaaacctttgtcactattataaatataaaattttagaattttaatgctaaaaagaagtacggcttcagtaataaactataccagaaaatatatacaataaaatctctactaactgacacacaaataattaaagccatttgcttactggagttttgtttgtattatacttcttacaaaggcaattaaagaaaataaaatgatattagagtgttggtcaagaatagagttttcagtggccatctcaattctgggtgttgggtacctatagttacagtcttggatgagtatgagtgagctaatatgcagaacatggatccataggcattataataattaagtaaaatttaaattaaattcagtaagaatggctaaaataagaataccaatggaaaaagcaatcgccagaaagccaagagatgcatggctttcaactctggcaaagcactgactgtccctgtgtcattccaaactctaagttccatgagggcaggaactgtttgtgtctcatttaccactgaaccttcactcaataaatatttgttactgaactggtttagcttgatgaacctgaatttaaactgatacagtatgcagttttcttacctacaaaatttctgacctgcaaaatcaggttacggtgaggattaaagaggtccctgtaaacctctggcacaatgcctgaagcacagccgtccctccatgaagggtggttccttccagggcattcccactactcatctaattctaacattctaagagttgttcccctactatctgactgagagaaaactttcaaaatctaagccaccttgcttggtaggatgctcaacactgaaagcacagatggtggtggttgcctccactggcccagtcttcggtcaagggcaagagtgaaaatcaagatttattctgagaaacacaggtcaaactagagtcaaaagcaagcttgctcccaacttgctattttcttgtttatgcatttttatgtttattttcttgtttatatatttttgtattttcctacgatgagcatttttattattttgtccattgtaaatcattcatatttcaggtgatcctctggagttttacatgaaatactgtaggtgtataattccatcaccaaaaagaaattgatgataaacatacaggctttcccagaattgaccttaagtcattatactgtacattaaacttggacatcgttatctttctatcatcataaaaggatttctgttgacctcaactcatgccttggcataagccatagaattaaggacataaagaaattgaggattaatcaactgaaaccaagctaaaaagttttccattcaaaaagtttggccagcacagtagcccatgcctgtaaccccagcactttgggaggccatagcaggaggatctcttaagctcaggagtctgtaatcagcatagacagcagagagaaattctgtctcaatagaagaaaaaaaaaggaagttcagcgattctccaggacccacgtttaaaagaatttcaaatttttcctaaaagcatgaaaggccaggtgtggtggattactcccgtaatcccagcactttgggaggccaaggtgggtggatcacttgaagtcaggagttcaagaccagcctggccagcatggcaaaaccccatccctactaaaaatacaaaaaattagccaggcatggtggcatgcacctgtagtcccagctacttgggaggctgagctgggagaatctcctgaacccaggaggcagaagttgcagtgagccaagatagtgccattgcactccagcctgggtgactaagtgagacttcatctcaaaaaaaaaaaaaaaacaagcattaaaagtattcactatcctaattctctaaactttctcttatataacagaagaatgcaataaatgcaaaaatattatttgactaaaataacatacaataatgcctttctaattcattcaaagaaaaactttattatcttaagttgttaccctatttctgtttgaatgagaatagatttccataaacctagacatccagcccctgcaaacgaaggaatgaggccaggcgcagtggctcatgcctgtaatcccagcactttgggaggctgaggcagttggatcactggaggtcaggagttcaacaccagcctgggcaacatggtgaaaccccatctgtactgaaaatacaaaaaaattagccaggcgcggtggcatgcacctgtaatcccagctactcaggaggctgaggcaggagaatcacttgaaaccaggaggcagaggctgcagtgagctgagattggactactacaccccagcctgggtgacagagcaagactccatcacacacacacacacacacacacacacacgcacagaggaatgaaataccccattgccatgaccccactcctattcttttccagtaatgaaacagagagaccttaccaccctccaaagtattctccactgcacagagcaaacactccaaactaaatgcaacgcaacaaacaggtactgaagctctggtagaccatttatctttgtattcttaaggcagaataacacttgtcaggaaacaagccctcttgtccacaaccgtttggctatcctcaagcaagccaataaaactatcccatctccttccagaaaccaagaaactaaagtcagccagttcttccctgggaagagttatgttcactctgtttactataagcactcaacacttcacaaagtttggtgggtaaggttacaaagagggaaaagcaacttaaacttaaaaggctgttctgatagtccaggaatgagacgattagagccttatctagttaaatggtcccacctccgcctgacttcccccaccgctgtctaaaaatcctctccttctctctccctcagatccccatgacatggccagagtttccatggctcacgaccctgaccccaaaaatctgctcccaggtgaacttattcacgggaaggtttgagagattcttaaagccttctacgggtgtttgcactttcagcagaaaacagaagccctccaaggaatgaattttctaattgtggcattttaggcattcctaatgcctacataccttcctcactggcttgatggagcagattgtaggggaacagagtatcttatcagggctcctaacatcgtaccacataggttgtggtaccatgtataaggccatctttgctaatgccagaaacctcatcagcagtgagatagcatttttccataaaagcacaggccagcccaaatacagtcaaagggcttttcaggagaatttggtgacatctctggatcagtgcaatgtattttagattaatctggactgaagaaaaaggccctaaggaaatattgcaaaaacaatgactccaaaggcctcaagagaatccattaacacgtgaacatgattaatgaaacactcatgtgggttctgtttaaactgaaagcccttattctactatttgtaactcaaagaactccttccactggaaacaaaagattcatccattccacccaaagtggaatatatgtgtatgcatgcatgtacatctacatatatgcacacaagacagcccaatattaccaggcttactgatcaagaaacagacttgaggccaggtaaggtagctcacgcctataatcccaacactttgggaggctgaggcaggaggatcgcttgagcccaggagtttgagaccaccctgggcaacatagtgagagccagtatctacaaaaacaaaacaaattaaccaggtgtgatggtgcacacctgtagtcctagctattcaggaggctgaggtgggaggatcgcttgcgcccgggagtttgaagctacagtgagctatgatcatgccactgcactgcactccagcctgactgacagagcaaacccagagcaaaagaaagagaaaaagaaatggggggaagtagggaaggaggaagagagggagtaggggaggagaggaaagaaagaaagagagaaagaaaagaaagaaaagaaaggaagaaggaaggaaggagggaagggaagggaagggagaaagaaaaacaaagaaagaaagagaaagaaagaaagaaaaaaggaaggaagaaagaaagaaagatagaatgtaagagagacagagaaagaaagaaggaaagaaagaaggaaagaaagaaagaaagaaagaaagaaagaaagaaagaaagaaagaaagaaaagaaaagaaaagaaaaaaggaggaagacggagggaggaaaggaaggaaggaaggaaggaaaaagacaagacaagacaatatgcattccagaaggcatgctttatagagtgctcatttggccatgtgtttgtttaccatcactggattaactcaagaagtttcaataaatttgtccacctattgattcaactactgttacatatgaaatcattatttctccaagtataacagtctgtattttccttcttccattctgcccagcatgtctaaaagtcaacagcttttccacagaaggttaagagacaaagtctgaatagccagatgctgcatactactgggaaactactataatattacagaagggcaaggaaggggaagagcacgcgaagactgcttagaagccaagtaactgtccagggtgaagtccttctagtcatatactagggattcaaaccactgctccacctcttactaactatctgacagccattttaatttctgtgcctcagtttcctcatctaaaaacggagataataagagctcttactcataacattaatatgagggtagagtgaggattatgggtctggcatatcagtaagtgtttaataaaaattgattactgatactatttttaggccagtgttttctgatcctttaaactccaaatattgtctccctctcaattctacagggttttttttttgcttcttatatatttgcttatatgagagtttatgtatatatatagctcttctatattcatcatctgcaacccagtttgaaaatctattaaaataacctaattatgtagctaattcccccaaaagctaatttaatacagaaatttgagtattttattattacttttattttacattattacttctcttcccaactaaatctttctgatgtctaagattcacaaaacaacaacatatccatattcaaagtaaaactgaactagaaaaataaaacttaattcacaaagtcaagtttataggcacacatctattccacatgcgttcaaaaatatatcactacttagtgaaataaattaactctttgctaaattatttctctggttgatactagctgtgtttttaagacattttcaacaattatatttcaagggtgtttaagaaatttagtaataattaaaaaatacatgcttaactaaataacactaaccagttgcctaaacatagctatcttaatccaaagaagttgatagtgacaatatttattgaatcactgagttgtacaatatagaattactaacccctgttattagtatctacaattttaaaattctcctcacttcactctgataaatttggaaattgtttctgacttgatgatattttgaaaaacgccaagcatgggggaaacatagagaccacatctcacaaaaggaaaagtccaaagcttttcaaaatgcagactgctaagggtgttatcaccatagcaaccctcagtaaagagaattccaatatgaagtaaccagagaataagcaatattttaacctcaaaagcacaaacttatggatacatctatatggtatgcatctgtactatataaggtcaaaggttaaaagtgaccctaaagtcaaattccagcattcttttggtgcatacgatatatctacaatttctttcccatctcttagagtcatttagagtaagttttatccttcttcatataatagttcctcaaatatttggagagctaaccattgttcccctattctcttgtccaaaagaaacatctccagtttttccatcattcccccataatattgtttccagttttctcatcattcttgtttctctctttcaaataaggttcaaattttctatgcctctcccaaaatgtggtattcaaagctgaagagaagatgtgcagtgtcacccgaccagctttggccaggagcagtcatggcatactttaacattcatttgcctctctctcctcagtaatagaacccagtgttactcaggtgaactatgtgctgagctaaaaagctacattttccaaacttcagccaaatgtgatcataggactaagtcttaatcgatgagatcaaatgcaagcagtagtgttgtgtgggacttctggaaagtctcctttaaacagagaaggcatgtcctcctttctccttctgcaatcccactacctggcatagagaaaggatggctatggctacagcagccattttggacaatgaggtgacttcaggaatgggagtcaccagcagaggactgtggagcctgtgtctctaatggtatcatggaaccaccagaccagccttccactgctggttatgtaagagagaattaaatgtttgtcttgttcaagccaaacaaaatcctctctgcgacaggagcccagagtagagcatgcctattacctccccaccatgatggagttgctttactataacacatgctgttcttttgactttctattaaacaaaaatttcttgagtgcatgcttatgcctgacactgtgccagacacaagagaccagaggagctaggcatactcttagcatcagtggtcctgttctatgcctctcccaaaaggtggtactcttctagaggaagagataaaatacatacacaaatgattgtatctcatggcatgaggagacatgctgtaagagaggttcagataacattcagtggatatcaagaaaggtcctgtagagaaaggtgcatttaagctacagatagatggatctgaggggaggggacgcctcacagaggaaacaaactagaactggcacagaaacagggaagtgcaaggcatgtccaagaaaaagtcacattcttcatcaatgtcactggcacgtcttcaaattacaaagatcatacgtgaggcagattctcttttatgtgaagtaaaaaaaaattaaaattaaaattaaaataaatttgcaagatctttgacaccctctaaagacactaagtgcctccagagtcaattcaattccccaggcatttatggagcaccaactgtttttccatcaaataagagtttcttccaatctacaaaggcatcctaattttaaaaaaatttcatcaaatattttccatatttttaaaaatgcttggaggcgataacttgtcaatattctactaaactggcagaaatgtttccaggaggtatattctgatatttaacaaactgtaaagcacaaagcaagtgtggttctccttttcctcttattattaatttaaagttacaagaaagtaaagcatgtggaaaaacagagtattagagttaagtatgtgaggcccagagccaaatatcctactctgcctcagttcactcattagtaaaaagggaatagtaatggtatctacctccctggagtgtcacaagaacaaatgctatagctatggtgactatatatcaggcatataataagtttcagtgtatgaccgctcttattaccaatagcatccctttctgcctctctattcacttcctatcaaccaagatgggccctcaacaaaagaactattggcatttaagcccagacaattctttgtagtatggaactatcctgtgtattgcaacggtttagcattcctgtcctctgccctctaaatgctggcagggatactcaggcattgtgacaatcaaaaaatgctactatatgtttccaaaggttccctgagggagatgaaccaactaggaatcagtgaactaaaacaaagaaaatgtcacacgctatgcccagacagacagcaagctggaaatttttcaggcaggaaaattaaaaaaaaaaaaaaagttgaatatttatgaatgtaattaacatacacatacattgaaaagacatgtctaatattcccataaataaaacatgccaacttataaaacaaataacaagaattatcaaaaacggcaacaaataaaagctttctctttgttccatggtgactctctccttttctcatcacttccaagtgcacaagtctagttctaccctcatcatctgtcacccagataatcccagtaatcctctaacttaactagttcatctgctttctctcattgcagcaagtattctttttacaaaatgaaaatctgagcattgtacttcccagcttacatttcttcaaaggcaccaaacttcttagcttgacatacaaaatcctccacagtccactctcccaactccttcaagactcagttcaaatggcaatctgtgcggtcttccttggcccttggtcctctcaggtctagttgactacatcactgccttttctgtgctcccaaacttctattatagacctctcaccctgtagcacaattgtttatttgcatgtcttattcatctatgcatgtcagttcctgataaaaaaaaagcttgcaataaacgtgtgtgaaagaaatacatcagtgattattttaactgtaattattaaccaagtctagcttgacagctttctcacctattgaacatctcactgacctttctgtagtttcatgaaataataaggaacttttgcaagagagaaaactcttcattgactgtgattcttacatgctctgtctaaaacctctcacaaaatcaagtgctcctcttcaagtgtagtcttccctgggcaaatccttctccttgcccagaggacacatctgacctccactcagacccatgcttccatcattcctgttctcagagttacagagacatcatcagcaagttctgcataaaaccaagttacagaaagcatgcacaggacacctaaaatggaaacaccaggtccaccaacgtttgaacttcttggcaactttacatttggatctgtgccttcaagacctgggaggtgaagaaccaaacattcttgggggaagaaaggcaggtgaccaggcctgtcttccaacatttttttgtctagtagtttcatctgctttaaaaagctgtatttttccccagcaatttctatggatagagaatttgacaagtggtttctttatttcaaaaaatcacagcatggtggctgctttgctgcatgacctaaccaagagctggtcaactatgaatgatttaatatcaggttccctgtggggccaaatgtttactgaatgctcaccaagtgccaggaccttgcatgttcacaatatcctttaaatattcccaggtacctataaggtagaaattactaacacccattgtatagtccaggaaactgaagctcagagagcttcagaggtacacatctggaaagcagtcgagctaaatctctgagctgtgattccagaccatgtcccagtaccagaaagggtttggccacaggttaactatgtccagggaagttgggaaggggtagttggggtatggccagaaagcttctataataataggaagagcccagaattttgcttggcagccagtgatttaaatttacaacagtggcttcagctcagtttcacaatttaatctatccttaataccttaaaggaagccatagaaattttctctttataaaatgtgagaatagcatagaatttttgcaaatacataaatatttactaactcctcaaaagttattcaagatgccaaatatcccttcttgaagaaaccataaataaacctatatcatctgtcctacagtgaaaatcctcagagaatgcaatggcatattcaggggcataggatatggttttataattttccagctcatatttctttctttttttattattattatactttaagttctggggtacatgtgcagaacgtgcaggtttgttacataagcatgcacatgccatggtggtttgctgcacccatcaacccgtcatctacactaggtatttctcctaatgctatccctcccctagccccccaacccccagcaggccccagtgtgtgatgctcccctccctgtgtccatgtgttctcattgttcaactcccacttatgagtgagaacctgtgatgtttggttttctgttcttgtgttagtttatccagctcatatttcattggagacaaagacataataaagttatgtaagcagggaagagaattttcaattataaagattctaaaaagtaacaacattttagttgtatatttgtatggtatttttaatgcaatcaagctttacaaatgaatgcagtcaatatatcccaatattttgtgaaattccctctaaatagagcatgtaagacatccattaaagtttatttttagctaagagccaaaccctgtttcattttattatatccctcatcgagttttaacttagaaaacataaataaaacaagacattaagtgacttaataataaaagcttatcctagagtgtgtttcaggattgctttctacacccacccccaactactgctctcactaaatcattctttccaaatgtgctgagatgaaggagcaaaggtgtccttaagcctgacttttccttaaaaccatatattaaaagtttccctggtgtgctcctctcaaactaaaactggcttatgattaagagcaagagtggcaggcagtgactgagatgagaaggaaacactctaatttgtcatcaaaaaaataaatcagaaaatagcctttaatcttaagagtacaatttactgatttagtcatttatttacaaaattgatggaaattgttaacaaggagttaattgatttaagtcacctgattaccacagttaattaaccacactgacttaatcttctttgaaaacatcaactaatcatttcccaggtgtcaaggggtaaatcgttaaataaaaaataaacctctgtcctcctcttcaagagagatttcttgagtgtgttttctttacggattccaatctagccacaagccaagtttggggaaattttgttcttatatgactatactgaaagagctgccttctttccagaattttttctccgttatagtaaaggaaaggcagccttgcaagcttaccgtgagtgtcattttgaattacttcaaaaatgagcaaggaacactgcgtaaataaaaatgaacaaataaaaggcaacagagacattcatctgggaaggtcagttttcaaaaaaggaacttaaaacacactttattgggagggtgtggccacaaaggagtagcacaagggagttagtgggggtgattgaactgttctaatcccgaatgaggttgtggctacacaaatatatacatgcactaacatttacagaactgtgcacacacacagcaattttagcctatgttaatttttaaaattaaagcacttcataaaggccgattctcttttttacagatagaaaaatggaggtttgaccccttggccccacctcaaaaggaaaagagggggcggtcaaaaaaaaaaaaaaaaacgagcactgttagagaaactcagaaaaacatcctacatgactcttgtcgttcttgttctgagttagcagaaccactgcttctctccaaaaacaaaacaaaacaaaacaaaacaaaagtcaattgtctttgatccaccaatgtgcccatagaacaggaaggccctggagggaatcaaagtcccaggtcactgtgacaagtcacacttagacctcctaaagggaagaagtaactacagctttaataaaactccatcctcttcctatccctttctccttccttcaatcacagcaaaatgcttgaaaaataaatctggattacagtgggattttgttgcacatattcacaatcagcaacaactattaaagacccttttgatttcccttacagggaaacgaaagtgttcaatacaatatgatccttcttagcccaagtccctcttggtgccatgttctctcgtctgcactgttgggtttaattatttacagcaagaagcatctaacttccactgtctttcagttagtatgttcaatttttaaaccatgcattttgtttttcactagaatcttagctttcaatgattacttagcaaattctttcaacacttcactgaaccaaatattagggaagaagtaaattcttatatcagaagtgaccttgaaaaaaaaatgcagaattttggtacataaaaaccaatcatttgacaattgacttgggacatgtgtatattcaattttatgcatttgcaaattctttttttattacacagtaactttaaagaaaaacagagctaggcacagtggcacacaccttagtcccagctattcaggaggctgaggcaggagggttacttgagcctaggagtttgaatccagcctgggcaacatagtgagacccccatctctaaatttttttaaaaatagaaaaacaggattccctattaatagtaatcattatggtctagacaaattataactgccatgtatattaaaatccaagggtctcttctcaaacttaccaggcactgatgaatccccaaggaatggttgatggagtcttgcaactgtgttgcttttaacgacaacttttccttttgttgtaacaactcagtttcaattgctaactagaggaaggacagccatactagaagcttttaagttctatctttgaggccttcctaatagatcacagctgaaattccccataaagccattctaagaaaaagcacaagcataataaccctttattccccagaaaaggaagttggcttattttcaagactatatcacacctctagtaccttctttccctctttcatccccattaaaacataccagctttgtgtctccttctctctgaaccttgctctgacaaacatttactgtgcattactatctcaactaactactttaccctacaggagtgaacatttccacattgtaataggagtttcaggaggaaagaatgtcttactccgaagaactgactttagtaatgacagagcagagatctttggccgtagtgagagatactttgggaccaagagacctttaagcacatccagcacataggaaatgtcttctccatctctacaacagcagtgttctccgggaagtaaagaaactcagctctcacttggttgttcatttttttcttcagtgactttaaataagagaacttaataatttttttcattagtagtaaacaacaacaacctctgaaaatttatagatgactgctgtccctaacggaaggttaaaattgaactctctgattaggtaagggtcctttgaattaaaagacacataattatagagggaaaaaaaaaaaaggtgttcccagataatgaaatagtaatataggagaaacccagcagagagaaatcaatccgtacctaaaaagtacagtcttctagtcttctagaaggaagtggaaatatactctgttcaatagtaagttgttttggatgtggcctatgttgaaggtctctgtctatactctgcagtacctagttacatcacgcctagagcatgataaggctgcaacatatattgaatgaatgaatgaatgaatgaactgccaagagtagcaaaaaaatgtccaaaagttgggtcgcaatggtaccagcctctgaaatgaggtcatctgatcataatatgagaaattaaatgaggcttcatttgattacgtacagaggactatcttccacttgctccaaattatccatggtgacaacatatacaaataagggttctgggttcaaatgttggctctgccacttagtaactgaattgctttgggcaaattacctcacctgtcattgtcttggtcctttatccataaaatttttactgttactacataagtaggtaaactaatacctacaaaacacttaggccaatgcctggtatagaaagcactcaaataatttagtcacttttattgtggcttatttcccaacttctctactcatctatgtgtggaattccatcattctcctgcctccaacctatttgttacgtatggagtcctcaaaagaatggggactgagatgagggagactatgcccaggagacaagtggccatgggtccttttcagcagtcaggggccctcttcgtctgtgcccatttttccttcattcatcaggaacaagacccatgaatgtcctgacttgacatgtgatgttctttccaccacaatccatgctgcctccctgagtggagaaaccactcccctcttcaaagagggccttttgtttgatcaaggctgttttcactgtgtcatggtctcagacagctttcttttgtgttctgtttaaatacagaatgacagtccactaacacgaagtctaaaaactttggcttatctttttgtaaaagctactgtatcaaatctgtcctaaaaatagcagaatgacccattctgtatgtacaggggaattctcacagggtaaccaagtatctgggatggaagttaaaaagaaggatgcagattcaactactcaaatgcattgggaatcaccagcagggcgggagtgggaggcactggggtggagaaaaggggggagtcagatcgagagaaacagcgttgctaagccacttgctttgatagagacagcaattttcctttttctccatcaggaccttgactgggcctccaggggcctcgaggaattaagggctggtagtaccagggaatggtgatgagctgaggatgccccttcttagcacccatggtgacatctgtccattcatttattcaatgtatattcatttatttagcccttttctggacactagggaaagcaatggataaaagagatgaaaatccctgcccttgtgccatttacatcttagggaagggaagataataagtaaggaaataaacaaacaactaactaagttacataccttatgtcagatggtggtaagcgcaatggagaaagtaaatcaggaaagaagaggtcgggaaagaatcagagaaggccacactgagagggtgacctatgagcaaagacctgtaggaggaaaggaagtaagtcatgcaccatctgaggcaagagcatttaggaaaaaggggggcaagtgcaaaggcccaaaagtgctcaccatgtcagggaaaacaaggatatcactgtgcctggtgcactgtgcatggggagaggagaaggaaatgaggtcagggaggtgatgtgaaggccaaatggttagggtcttgtagatcatagtaaggacttggactttgactcttcatgagatgggaagcagtggtacacccagagttgtgccatgcagcttccccttataggaaggaccagctatgaggaaggactttcttcctgcaatcagctcctttggggtctgcctcagctatagaaagccacctgcccaaggtcgtgtccttccaggacaggccacatccagtgattaagcaaggccatttcagcctgacataggacactctaacaggcaactcttgctccagagcttcctctgggttgaccaacagctgccagagttcaacttcttcttctgcccatcctgcttcctccctttcccttcacacgcattgatcttaataaatattatatactccaagctccatctcagtgtctgtttttgggcaacccaacttgagtatgacagaaaccatgggagcttctgagcagaggggtgctgtgatctgactgatgttctaaaaaagttgctacagcaaggaaatcagtatggaagccattgcaatcgtcgaggcaagagagggcagtcggttgaatcagggtggcagaagtgaagatggtgaaaagtagttggattctagatgtattttgaagatcaaaacaatgggattttctaaggaattctatatggggtagaggagcaaaagaaaagtcaaagtaggatacagtttgaggcttgagcaaggatgaggaagccatttgctgagatgagaaattccacatggaaagcaagtttggacattagtggagatcaggagttcaatttcagacatgtgaagtctgagatgactattggccagccaggtggacatgtcaaatgagcagttggatatgtgggtctagactatagggtagtggtctggattagattcataaatttgaaagttgtcagcatgtacatggtaaagaagtatatatggagtcctcaaaagtatggggactgaggccaggcacagtggttcatgcctgtaatttgagaggccgagggaggaggatgacttgaggtcaggagtttgagaccagcctgaccagcatggcaaaaccccatctctacaaaaatacaaaaattagccaggcatggtggtgtgcacctgtaatcccagtttacttgggaggctgaggcaggagaatcgcttgaacctgggaggcagaggttgcagtgagccaagatcacgcctctgcactccagcctgggtgacagagcgagactccatcgcaaaaaaaaaaaaaaaaaaaaaaagtggggactcagatgacagagactatccccagaggacaagtggccctgggtccttttcagcagcctggggccctctttggttgtgcctatttttccttctttcttcaggaacaagatccatgaatgtcctgacttgacatgtgatgttctttccaccagagtccatgccgcctccctgaattgggaaaccactccctgcttcaaagagggccatgagacaggatgaggccaccaaggaggcagtgtagctagagatgaaaacaggtcagggatatagacaggaacaagcatgagataccaagggtaggccagcaaggaagaaaagaaaccaggagaaggcagtttcttgaaaatctaactaagtgtttcaaggaggaagtcaggatacactgtgtgtgatgctgctaaccagttaaataaggaccagagctgaaaatagatcattggatttaacaacatggaagtcatgagtgactttgaccaaaaaaatatctatcaaggatgagggctaaagcaaaatggcatggatttgagaaaaaattgaaaggtaattacagtggatataggcacatctgtacaagaattttactgtaaagtggaaccgaaaaaatagagtgatagttagaaggtaatgtggaacagaggatttcataaaagaaagaggggacaattgcagagaggtgagagggaatgagatctagaacatgaatgaaatggttggacttaagaactgggaaaattcttccagagtaataggaggaaagacagaagatataagacgaagttcaaatgatgatggttgagttatagaagtttatggaattctcttctggttgcttccattttcacagttttaaaaagctcactctacatgtgagaaggtgatgtcagaggtttgaggaaagaggagaagatataaggaagcaagagaggcaatagacagactaggaagcaagtcctaagcttgagattggcttcatgaatgtcaagcgaggctagtcagtatagttgtgtttttctcctgccatgtttagctacagagttgcagatgtggagaactggatttaaccaggatcagggccttgccaagcacaacagagccagataaaggggccaagctgctgagcgcgtatgtatgcagggaagtgaaattaatgatggccataaaatataagctgaggaagtaaataggtgagggatttgagggatggtgaagaggcggtaggatcaacaaactgtaagtcccaatgaggtcaacaaagagttgaggctgggatacaaaggaaatgagccatgaagtttttcaatacttccattccaagcatggaacagacagcttctctagaagccagtgggctgtgtcaggggtgttctgagatgaattcagattcaggtgagaaaagattagaagacctgcaacagttatttacctcaatgaatccaacgttcttaggagggtctggggggaacttcaaaggtgaccaaggtaagaacaaaacatacaattaagacacaaacagtggcatatttagggagaggttcaggacctgccatgctggccaaaaaaggaggtggccaggaatgagggtagtacttcatgtcaccctcagacttaaaagagtcctgtccttcttgttgtagctagcttgtaacattcccatccaaaagaaagagatttaacagagtatatttaactgccactgaagaaatttgcagtggtaagtcagttcacctctaagtctgtttacaaaactgaaaaatgagagggtacctagatcacacgttcccaaaaattggtccagccctcagaatcaccttgaaacttttaaaaatacagattttccacattttctttatctagtctatcactgatgggcatttgggttggttgtggcacatatgcaccatggaataatatgcagccataaaaaggaatgagttcatgtcatttgcagggacatgaatgacgctggaagccatcattctcagcaaactaacataggaacagaaaaccaaacaccgcatgttctcactcataagtgggagatgaacaatgagaacacatggtcacaggggggggaacatcacacacagagaggggaacatcacacaccggggcctgtcagggggtgggggccaagggaagggagagcattaggacaaatacctaatgcatgtgagccttaaaacctagatgaaaggttgataggtacagcaaaccaccatggcacatgtatacctatgtaacaaacctgcacattctgcatatgtatcccagaactgaaagtaaaataaaataaaatttttaaaaaacacagattttcatacccctgctttagtaagggtgagttttgatttaagaatctctatacttttttaagttcctcaggtgattttgatgatatgtcaagtttggggagctagctgactttgtctagggtccttagaaattctaacaatctgtaagttattgtgatgaaataatacttttgagaacataactaaaaccttctcaaagttggattccccctggataggatcaaggaaacacgtagccccatttgccctggcagccatatcagaatcatatgggaagccagaccgcacacaaaggtgaaacttaggggggagtagggtcaaggaaaacacaaagaaagagaactggagccctgactgcacctcgcctgaaccccactctgcctcagtattttttactcacataagccaagaaataccctttattgtgtaggccattttgagttgggttttctgtttcttgcaacaaaaagtattctccacacccttccccacatcaaaattaaaccagtgtggaagtacatgctagcatgtatcaccccccttctagtgagattaaaatgtgggtaggattgccatatttctgataaaatactttcattcttaaattcaactttaagaatttcctgacaaaataaatgatttcagccgggcatggtggctagcgcctataatcccagcactttgggaagctgaggcgggaggatcacttgagctcaggggtttgaggccagcctgaacaacatggagaaacctcatctctacaaaaaatataaaaattaactgtgagtgctggtatgtgtctgtagtcccagcttcttgtggggttaagcggagaggatctcttcagcctgggaagttgaggctgcagggagccatgcactccagcctgagtgataaagtgagaccctctctggcctgggtgataaagtaagaccttgtctcaaaaaataaaaataaacgattttgattttttcaacctttactcaggaaattttctccttgttaatgacataaaaaccaaagaactgggcccaaagtgacaagcaaatcactgacagtataagacagaatatttttatagaggaatccaagaatgtccagcataacagaagtgtagctactttccttttcgtctttttcaggtttcctcaacaccttcaaaagtacacatgctcttacttaatgtgaatcagtagatcagtgaggaaagacttattttcaaagttaccaggaatcttcatgtgttattcgctgatagtacataaatttaaaggagaccttggatattgcttacaaacttggatctcaagatctggacaataaatgcgccattgtatccatggtaacagtggctcaactattcaatgcacagaatggtaattacatttcctcctttcattcatttctcactgtttccagtaaccttgaggtcaggcatgacctgagggctaatgaccaaaagtgaaacttcaaattgtctaatctgtcattatctaggaaagacttacatttctttgcactgaatttcagtgctatcctaaatcagaagtgtcctaatataaaagttaaccatcttatttttagaatgataatgtctccattttctcagctaatgtgattagagataagacttaaattagagaccaacaaagtaaccatcagcaaagagtacatatatctggcatttctgaattaatccaataaggtgtgatggatacgtgttctaccatttatgaaagaagtccatagatgaagtgctaaggacactcagatgtgcaccaagatgtgttctgtctccacagaagcatcttaacctgtctgcaaactctttaagcttctttctctctaccccatccttatagcaaaggactagtgcttggaaaacagacaaactcttaggaacataaacattggagtgaagtaaattggaaaaggagtaggagcctaagattcacagaaaaatgaaatactgcaccagacttaagggatcctgtagtctgatcgctcagctcattttccagaactttcctgtctatcacaaagctctgctccaaataagaaaactttaggatccaaataaaccttctaaaagtccttctttctcctgttctccttctaaacttaaagttgcaacatggtcacatgggcacagatcaccatgtcttttttcttaatgtttccaatactttattcctttcaattctgtaagttaccccagggctgccagctcttgagaaatttctgtagctttttcaagtgtgtcttcacatacaaaatgaaaataacatcgtcagtcaattttatctgataaggtatactgaacacctgttatttttgcatcccagcctctgttcaccattctcccaataattacccccatttctctctggactccaccccttcatacatgatctcaaagactgagtatacagcccaagcctaagccatgggaacacatcatgacccgggattcagtggttggttctccaatgagtttatgacctaagtagagaccctgagatgcaactgaaacttttgctgggaatagctaagataaaaactctttttctttcccagtggatgtgatctgataggaggtggctccagagccactgacagccgctttacatcaaaggagaacatgtttaagaatggagtcatctcagagccaggagacggaaaaaagacaagattggcctgacatagtttgagcctccattttatattaggttgaaccaaatgaaattgccaatatttgactatttctgcataggaaaaaaaatcaatctcaaatggatcaacctaattatctgtatcttttcaactatgtatttattttctttgagacagggtctcactctgtcgctgaggctggagtgcagtggcatgatcacagctcactgtagcctcgacctcctgggctcaagcgatcatctcacctcagcctcccaagtagctgggaccacaagggcacaccaccattcctggctaattttttgtattttttgtagagatggagtctcactatgttgcccaggctggtctcaaactcctaggctcaagcaatccgctcacctcagactcccaaagtgctgagatttataggcatgagccaccacacccagcctcaactatgtatttcaataaccttccttttttgcctcagacagtttaacttagttttgtgacattcaccaacataacagtactgaataacatgtgaagttgtggtagccactgtaaggatgtaacaacatgcacaggtgcatcattctcagacccacggtaaagaagataccaaaatactgcaacatcttcctcctctcaagtttggaaaaagtaaaattctcgtattgggtaataatgatgaatggaaatctatatgagacttcacagtttattaaacatttcacattcattgcctttgcataaccaccccgtgaggtagatatatgtccattttacagataagaaaactgccccagagcacccagcatgtgtggtactggatttcccagataataaatggcagaggtaggaatcaaaccaagatcctccaacttcaaaatcacaagcccttcccacttcatctcaaaacactgtaactgtcaagaaattacttcggaaacatttgcattaggaacatgtgaagaaccacagaaatgctcttgacatttcaaaacaactactagctgatcattatcaagaagcatcccagaactcggatgctgaaacatctccaatctttctaatgctggtgagatcctgggcagggttattaggaatgagtcaatgactatttcagaatcttaaatgcaaaactgcagtccattttaattgcgagatatgtagacacctcttttcagttctcatcttccttaatgtttctgtagtattgatactattgactcatcagcacactgttgatatttaataaatattcatggaaaaaataaaataaacattcacagaatacacaatagtggtaaaaatttttaattactcaagactataaagttaataggatacgatagaaccatttgatttataccaaaggttccatcaagcttattttttccatgctagaatagggcttcacaattagtatttttttagttgctctagattcgtgcagtcaaccttgagaacccctttcctatccattcaacactctttcataagcaccttctactttcttttcttttttttttcttttttatttatttttattttattttattttattttattttattttattttattttattttattttatttttgagacagattcttgctctgtcacccaggctggagtgcagtggcacaatctcagctcactgcaatccctgcctcctgtgttcaagcagttctcctgcctcagcctcccgagtagctgggattacaggtgtgcgtcaccacgcccagctaatttttgtgttttaaatagaaacagggtttcaccatgttggccaggcaggtctcgatctcctgacctcatgatcctcccgcctcagcatcccaaagtgctgggattacaggcatgagcccccacgcccagctcagcaccttctactttctacttaccttgttctagctactaggacttaacagaaactccaaagccaatatgacaatgcacttgcttctgattacacaggaaatacatctaggttcctggtatcattatttttaaatgataatttaaaattttaatttaaatattttaaaaacctttcagtgttcttacagtgcctgactagagaacatgaacaatgattatgacctaataattacctttagtaagactgaaaacctagtcttacagcagcctgcactacaaaacccaaagatcttcaggaatgcgctttgatggctcaagaatttgaaaaatggatctggaggtatggtctttgggagtaggggcactgacatggcatcagttctggaccaagctgaaagcgcatggtacatggttgtaataacctatcacaggattcctctttggccagggacaggtaacccatccaattgtttttaagattcatctgcttatcagactgtgccttatctggcaagtcaggattccaaaaggaatctagaaatctcaaccaaccaaacaggctggggacattcagaaggcatgaatctaaaaaatggtccactgcaaatttatatcttagctctgtcacaggctagatgtccttaggcaagaaacctattaaccgccttccctttcatcctctcagcccctttcttctccctcctgggctaattgcttatctgtaagaaaaaaaaaatgcaagcagaccagttgatatctaaggttccctctagctgtaaaaagtctgagtttctattaaaatgagacaggtgcatgactgaagggagttcaggcagaagtcttatgaagactggtaaagagaaactttttcaagtagagaaagagaagccaacaactgtgaaattaaagcagcagtgaggttccagagttgtgatggaataaaaacgatacaagtttgctattgcccccacaatccttttaaacatataaacttcatgtgaagatgtaattgtcataaaagctgatactaactcttaaaaacattaccacatttttattggattaaagaatataatgttggaccaggtaaggtggctcctgcctataatgtcagcactttgggaagcagaggtaggaggatcatttgaggccaagagttcaagaccagcctgggcaacacagtgagaccccatttctatttttgaaaaataagtttttttaattagtaaacagaatacaactttgtttaaggccaatacgattttctcaaaaaaaaaaaaaaaaaagaaaaaatcttccaatcacatgctagggtctgagaagtcttcagagaactgttagtgaaaaatgcttaaagaagactttcctttgtatatttgaaaattggaaatggaaataggaataggaagcaaaacaatatgttactttaagggttgataaatataataaaaatattgtatttttagattattttctagtttattttcactgtctatatgctttacaccatgctaagcacttggcatattttatctctttatgcttacaagatgtcattgggtaaattctcttattatcttgtcaattttgcagataagccatctgagctatgcaaagttggttgactttcccaaggtcacacagctagaaagtggtaaagccaatgttggaacccaacagcttgactcgagttcagactctgcaaaatgttttttcttgaaaagcattacacaaaagataaggaaaatgcaaataatttttaacaacagatgtggtataatttttttcaaagactaaacatagaatactcagagctcttttttttcccctccaatttttagtgatgcgaagtttgcaatggtagcctacctaaaaggtagtgcttaaataaaggctgttacaatctcattggattttacttcatatattaagtcaggatcattacaacaggattctagaaatctcaacgtatcaggcagaggacattcagaggaaatgcgtcttaaaatgatcaagtaggaagactgggaatggggagacttgggttctggtcttagaaacctgaggagagattctggaaaaagatccacagttatgaagcagcaggtggtacgagttgcatattgcccctcagcttctttgggaacctcaaacatggacagtaagttagggagcatgacattttttgtacaaaagaaaaaagagaaatcgggccaggtgcagtggctcacacctgtaatcctagcactttgggaggcctaggcgggcagatcacttgaggtcaggagttcaagactggcctggccaacatagcaaaaccctgcctctactaaaaatacaaaatattagctgggcatggtgccccgggcttgtagtcccagctacttgggaggctgaggtgtgaggatcgcttgaacctgggaggcagaggttgcagtgagccgagattgcaccactgcactccagcctgggtgacagagcgagattctgtctctctcaaaaaaaaaaaaaaaaaaaagagagagagagagagagaaaaccagacactgtatactgtagcaattatagactctgaattcagaatcccttgagtttgccattttctagcagtatgaactgagacaaattactgaattgttctgtgcctccactttctcatctgtaaaacagtgataataagagtacttacttccaagggatattatgaagattaattgagtcaataagtataaagtgcttagaacaaagcctgccacatatatgtgtatgctaggttactattactatacacattattattatatattattatcatagaatggaagatggatgggtgcaaaaaactatcaagaagagtaggtattggttatttagtgactaaatcatcaacccaggaaaaagaatatctgttttggttgtacaaggacatagatgaatcaaggtaagatttccttttgccaggcactgacaggaacatatagtaaatcctatagctatatttaggacatgagatacaaccctaagcattgtgcaaactctgcacaataataataaaccctctttctgcgttaccaacactgagaaagggtgttcaaaggaaggttattaatgatctctccttgcctctcctgcctttctgaagacttttgcaagacctgtggggtttgttagggtttccaaacttcttcccaggaagtctgaaatgggtgctgctaggagttgctgtataattacttacttgattccctctaaggagcttacgctaagaattgaggaaagaaagcagattaaccatttgaatacatgccacggcccatccacaagccctcccctcactcctccgtaaatgggggcttccacattccccacccatcaaccccaatatgtgatccaggaaaatcaatttattgctttggctaatcctacaacaataggggtttcattttcattgtagggcaattaagttgtccgacgggagggaaggagcaggaggggaaaggggggactctcccatccccacagacagattagtccctgcggtggcagcagcgtcccctctgtctgtctggtggtcggtcacacgcagctcccggctgctacctagcaacgcaaagccagggggagagctcgccggttccagcctcctcctcgcccttcccattcatcctcggccgggtctctgtctctctgtctctctctgtctctctctgtctctctctgtctctctctctctctctctctctctccctctctctctctctctctgtctctctcctctctctcctctctctctctcttctcccgccccagtcgttctcttccctccttctttccttattcctatttgcttctcttacgctctctcctcttcccttcttactagttttattctctccgcttctttctccctctctttccctcttctctgtttctgttaaaacataaactatcggacaacttgagagaagtttaaagcacttcatactagaaactttctgcattcgatccccaaaactctggccatgcagacgggccccattcatcaacacaaaagcccccagctcccagctggaaaggaaaacttcaagaaaagactccagtccctcagccactctctcggccaatcccacctcccggccttatcttggctcgtaaatgatctgtatggtgagagcggtctctgggggtcaccgcgggaccaagtttcgccggtggtgggaggagtgctctggcccgcggccctgggcgcgcgaagggatcccgggaggggcgctgcaggtggaaagctgcgctctgagcagagcccgggaccgcgccgcccagcagagaactccgctagggagggcaggctgcaaacggcggagaacctcgttctcccgcaaagtgctttccaggagcatcggaccaacgcccgtgggaacaaagacagggtctccgtggggtgcgctgtcaccgaaactggcggggctgctttctcaagtttgctgccgctcagttcctggcgagcgaagaggggcgctcccgctccggcttcgcgaagcaacctgagcgccccaccgggagcagctcccgcgccgccgcccggccctagcccctgcccggacgctctcccctccggcctcccgcggacccgaccctgccacagccggggaagtgggggctccacgagaggctctggctgggctcttaccttggccactggccggcgctaggcaggcgacgagagccaggagcagcgtgcacgccactgctgccggcccgcgatccatctccgcgacggtccccggcctcgccgttccttccccgggaggtgggcgcgcgtagcacaccgcaccggcagcgcctctgctagcgaacgctcctttaggtctgcacctccgccagctcctagtggccaaaagcctgcccccacgcccgaggcatcccgttttctacccgcgccagtccccaccctccagacagtgcataaagccctttagacc

SEQ ID NO: 929 - DNA, 144275 bp, Homo sapiens
agcgctggctgcgggcggtgagctgagctcgcccccggggagctgtggccggcgcccctgccggttccctgagcagcggacgttcatgctgggagggcggcgggttggaagcaggtgccaccatggctagtggcagctgtcaggggtgcgaagaggacgaggaaactctgaagaagttgatagtcaggctgaacaatgtccaggaaggaaaacagatagaaacgctggtccaaatcctggaggatctgctggtgttcacgtactccgagcgcggtaatcacttgaaaataaactgtgcttttatttttgcaaactttctccccctccttacatttgcaaattttgtcctcctccccttgaccctgctcaaacccggactcttaaggagccgcaaactcccatatcctttccttagggcagaaagcagctgagaatttcaggaaggtcttcacctttttgacttttctccccgtttcagactaaaaaggagagggggtgctgtggattgtgactttgcttcttttccccacccacttgttttccagcctccaagttatttcaaggcaaaaatatccatgtgcctctgttgatcgtcttggactcctatatgagagtcgcgagtgtgcagcaggtaaaggcattgttttcacttcaactcattctcccttctgtttggaaggagacgttttactggcaatgttaatatagccgagagttcttggttattcccaaaatttggcttgaggaacctctgactgtgattttaagatgggaatattgttaaatcattacgcaatgtaaacgggatgaagagccccagtatgtgttccctgagtgtctttaagaagtaactttataaaaccaacagtatggatggtggtagaaggaggataaaaatgggttcggttttagtctcgttattggcaagatgaattcattagtgtttagacttgactattccaagtatcttcccaatacagagcatgtcctagatgagaagattatgaatagtttggaaaaggggaataattaatagtgataaaatgcaactttgtcactagcaaactcttgtagagttcagcactttttaaaattcaaagatttctagcctttagttgtagtataccttgtagtatctaaagaaagtgatgtcttatgagaccctcatagtttgcaactgttgtcatataaaatgcatgtagaagtgaaacttttacaatctgtaccataggaaacccagaaatttgctatgtatcttggatttttttttaaagggggccttaaaaatggtaattaagaatgatttacagtcaaaacaaaattataggccaaggtgataacttccttcggagcacttagagatttggggaactgaaatcagttttgtcatctgcatgttaactcatgcagagaaagagaattggactttgaactccttggaggtgcagtcagaaagccaatgtttcttaatggttgagaggcttgacagacatgaggcatctcaatctttaaagtggtgtgggtctatctttatcttgatgtttatctctgtatctagctgtatctagtctgggtgaaccatctagcttctttgatatgaggacatttacatctggaagaaatattttaatttgttttcaactgtgaaatattttccatctgactattatagattttcacgctgctatcaaaccaaaccaagaaaagatggaggcataataaagatgctgttcttttaagactcaaagtcggaattttgcctgtggaatatgagtcactttttgggcactggcctattgtgcttcctgctctgcacccacgtcatcccttcttacttgtctctgctttggtgttcagaagtgcctgattctggccaccttcattccctagactctgtacttgatagagtcactcctgcttgatactgctcaggacagtcagatcctgggtaggcgttttggtctgcagggtctagataaggcagtgctatacttgacaacccaggggagcctggaacatacttcctaattcttaattttagaaattgcccaagcctgagcatacttgtccggagtagttatgagtgtcacttagtatttctgcctagagagtaccagaggcaaagtatgctggaaaataaggaagagtttttttaaaagtaattaattacttttttggatatatcatagttgtatatattttggggatacatatgctatttgatacatgtatacaatgtgtaatgttcaaatcagggtaactggaatatccgtcacctcgaacatttttctttgtgttggcaacgttgcaatttctttcttctagctattttaaaatatgcaatgaattattaaccataatttccctgctatactattaaatattaacttaattgcttgtatctaattatatttttgtacacattaaccaccttctctttatccctccccatcctttcatttccagtctctggtaaccaccattctactctcttcctccatgagatccaccttttccgctcctacatatgagtgagattatgcaatattttatttctgtacctggcttatttaatttaacctaatgacctccagtcccacccatgctgttgcaaatgacaggatttcattttttatgactgaataatattccattgtgtatgtataccacattttcttttatttttagttaagtaattaatttagagacagggtctcactctgttgcccagactggagagcagtggtgtgatcaaagctcactgcaggcctgcaatcctgggctgaagtagtcctcctgcctcagcctcccaggtagctaggactataagcatgtgccaccatgctcagctaatttttttttctttttttactttttgtagagatggagtcttgctatgttgcccaggttagtttcaaactcctgacctcaagtaatcctcctgcctcggcctccatattttctttgttaatctgttgatagacatataaggtgattctgtattttaactattgtgaacagggctgcaataaacatgggagttcagatatatctttgatatactgatgttctttttttggatatatacccagcgatgagattactggatcatatgaaaattctctttttagttttttaagatacctccatactgtgtttcatcatggctgtgctactttatattcccatcagcagtgtaccaccattcccctttttctgcatccttaccagcatttgttattttttgtctttttgataatagccattctgcctgtggtgagataatatctcattatggttttgatttgcctctccctaatgattagtgaagtttaggatttttttttcatgtacctgttagccatttgtctgtcttcttttgagaaatgtctatttggatcttttgtccatttaaaaataagacttttttttttttttttttttttgctaattgagtttttttagttccttatgtattctggttgttaatcttttgttgaatggatattttgcaaatattttctccctttctttatgttgtctcttcactttgttaattattttctttgttgtgcagaagctttttagcttgatataatcccatttgcctatttttgttgtaattgcctgtgcttttgaggtcctaccccaaaaatcattgcacagaccaatgtcctgtagcatttccccagtgttttcttctagtagttgcatattttcaggtctgagatgtaagtctttaatccattttgaaatgatttgtgtatatggtgaaagctgtggatctagtttccttcttttgcacagccaatatttgattctcactgaaatctcactgccctcctggaaatattaccggatgttttactgtcatagcgaagtgagagtaagctgctcactgaggatcaaagagcttgtgacagacctaagactcaagtcttctcacaccttcaaaatctctttccatcatacaatctactagctgctgaattcgcaagctttttgtgcaagctagtaaaaagcaaaatggtttgatacaaatactgtggccatgctaggtacaatgacatcaatttaaattatcattggtcttaacaaggggatgtagaaaggggtctcctactgacattttaatactcacttaaaagtagtatttttccttcagatttctttatattattagtataattactgtaagtatcctttactgctttatatgttgaattagctggaagtgccaaaagaaaaactcttaatgataaatttaaggtattaaggtaaatttctccttcatttaatttaatagtaattcttaattactatttaaaataaagattaaggtttgtttctagatgccatttaacatgatattccagactgccagttttattttcaaagtttgtttcatattttattaatgtttcttcataaatgacagtctttagaaaattgacggttaagctaggtgctttatatttttcttttcctgcctatcttttcactgtgctcctaaattttacatctctttattctcaagggttcaacctttgaagaaggggagcaaaataaatgaaagtggctaaaattttttctttaacccctagactctttcctgttgtgcattaattacatgcttgagtttttagaataattataataaagtaaaactaccaatttaattgtattgtaactgtgcaagatgggaaccttctctcttagagagataagcttttaattgaatagattaatggatcaattgttacctctgctttgctgccagagattctatttaatcacagaagttccatgtagtgctggagagctcagttgcctgaatctttttgcaaagcgtttactgatactgttgcttcaccaaccaaaacaaacaggttttttccttgagtcagctttgtaggtacagagatgagtttggcatcctatgtgacttttttttttttttttttttttttttttaccaccagaagctgttcagaatgttattttcttaaatagttcggaaaaaagtcttgatgtattctatgaaagcacaaaaatagtcagtttctatgacagctggattgtcaacgtctgttcagcttacgtggaggaggatgtcctacttgagtagtataggtagaaatagctatcagaaattgccgcctttgaaagcaatttgaaattatgtaaaaggaagtaatgacaaaataaagcaatttatgtttaatctggaaaagatccaaaagtaatattgtaaagagatcttgagtaatcatttttatcttcctaaaatagccgttgtttactcccgtaagcgagtaagaaacttgtgccattattccttattgggtgcatatagatttctcaccttgtcattcaactccttgcaatattcaactttacttatgcatccagccttatcccaaaatagcctcttccctgtagcagcttccttatcatgtagcagcctactctcctcaccgctcatccgttcttatacaatctggcttaagctctacctcttcatattatattcttctctgagtaatttcaactcacactgagtcttactttcagtatttctattatattggtatttattacacatcacacttagatacttttccattagtctctagagggtacatatatgcactttctctttttttttttttttttgaccatgtcaagtatagttctatagtataatagaatgaattggagatcctttacatttagagagggaggagtctacagtaggaagaataggttaattttcatctccggtttgaaatcaggactttcaatttttttttcagaggtaaagagcaacttagtcaagttggcatcttgtaaacagactgagtgaagatatacttaaaatgcatctataatttcatattttatttcgaaatgtgaaagagcctactaggggtgtctgtgatctctagaccttatcaattcattctagagaaatctggagggagccattgaggagttctacctcctgtctattttatagagctctttctctttttctcctatcagatgtagattcaattgctaaaaatgccacgtttcttgcctctattattctagcttcattacttggggagcagccattctgataacttacattttgctactaaaatctccaacttcacctaatccttcattataagccacttcattttttcctataattaaaattttaaatatgtggaggaaattctgtcaggtagatatgacttaaaacctactaagggccaggtgcagaggctcacgcctgtaatcccagcactttgagaggccaagtcaggaggattgcttgagcccaggagcttgagaccagcctgggcaacagagcgagacccctgtcttcacaaaaaaaaaaaaaaaaaaattagctgggtgtggtggcacatacctgtagtcccagctacttgggaggctgaagtgggtggatcacctaaggacaggagttctaggctgcagtgatctatgattgcaccattgcactccagcctgggtgacagagtgagaccctatctcaaaaacaaaaacaaaaccaaaaaaaaaaaaaaaacaagaaaaaaaaagtactaaggatctggtatagccattcttgcacttaataatcttggtacaacctctaaaactattttttatagtttattttattttgccttatttagacaattggcatgtctatgttcttcataatttagaaattatatgtatttatatatataaattatatatattatatattatgtataaattaaattatatatatatataatatatatatatttgaaatggattcttgctctgtcatccaggctagagtgcagtggcacaatcttggctcactgcaccctctgcctcctgggttcaagcgattctccttcctcagcctcccgagtagctgagattacaggcgcccatcaccatgcctggctaatttttgtatttttagtagagactgggtttcaccatcttggccacattggtctcaaactgccggctgaaatgttgtattttttgtatgtctttctggtatgatttttggagaaaggtgtatcctaagaatacggcttgcttttgtttctgggtaagcattttagggtatcattttgttgtataaccattgtttacaagtgagataagcatctattccactaagattgaagagattcatgtttgactgagtatgctctattaacattctttaaaacatgtgaatatatgtctttcttgttttcaggtgggttggtcacttctgtgcaaattaatagaagtctgtccaggtacaatgcaaagcttaatgggaccccaggatgttggaaatgattgggaagtccttggtgttcaccagtaagtatgatagatatgtaaaacaaatggccttgagtatttatttgtacacatgacaaccttcccttgatacactgtgtttgcaatccaaggctactcctgtggaattctttaaaatacagatatttttccttgagtcaatgatttacatttatagagagctttaaactcagaagtttgatttagaaagcaaacatttaaggtaacatgtcagaagttattattttaataatataatcatataattataaaactggttaagttgtagatttttgatgagtacttttgaattcaaaccatgaagagattttggcttttaataatagaatcgatacaaaccactagttcttaaaaaaatgggaactgagaaaagttagttctgtaagtagtaatttgaaagttgatgttctactgtctttaaatagtacatttatatatatattcctatatatacagtaagtttaaactatggctttcagaaagagttaagaaagaggaaattaactttcagcacatctgtagccaaatcttgatagtaattttaccagctatgtttttgcagtttgcagcataatggcttcttagatgagactacttccttagccatcattaattaagaaaatattttctcaagaagaatgtgtttccaggaaaatacattttggatagctttgtttcttgacagttaaaaaatatcttctaagctactgaggaggctgaggaaggagaatcacttgaacctgggaggcggaggttgcagtgagcggaggttgcagtgagccgagattgcaccactgcactccagcctgggtgacagagcgacactctgtctcaaaaacaaacaaacaaacaaaccttttgtcattaactttaaatcttttttatacctaatatgacttttctttatcacagaaaaggaaattgtgaatattttttggcttccaatggtatatggtttatgaaaatttaatttatgaaaaattttcaggtgtttgtattgctgatcagtgtcaagtagtgctataaatttagacaaattagagctatgtgtttgtccataagtgaacatgtctgtgcttatacattttcccctctttgacaaatgtgttgctcttcttgttttcagtacataaagggtgtgttttggaaagagcatatttacaattaattggagttctcgtcttcaatctaatctctgtaattctatgtatcagttctaaagtatacagcatttgatgaggaattactcaaaatataccagtaattaggaattgtaactttaaatgtcccttggtttgggtgataatttccaggaagtccaaagatgagccagtctataacctcagggagtgtttgggaaactcatctagtcatattcctgtacaaaccaactgttcaaattaaattacataaaagtttatgtaggaaatttcattcactcactcacttactcattcactcactttgttcatccagtcattcatcttctattcattgaatgtttttgaagcctgtcctctgggtcagaaaccatgcagttgtgaagaagatagacacactgctgtctccagtggagtgtattagatcactcccagcaaaaattgattgtaaaacagatttctcttttttcaaggccttttccctccaaagacttaccagtactgaagaaaaatttcttccgtggtaataaagtcaggaattgtgggaatggtatagggagaggtaggggcagggtgattaggaggaaggctggcagagaatcgaagactggcttcattcaggtcctccaattgccaaatggagattatgcaacgtttcttgaatacatacaaaactctagatgtggccagctcagtcttcttccaataatgtaaagccaaacaatgctttgcaggaatagactagagattatattttgggattaataacatagggattaaaatcttatcttgaactaactaaacattattgatatgctaaattcactttttttttttttttttttttttttttttagacagagtctttctctgttgccaggctggcgtgcagtggcgtgatctcggctcactgtaacctctgtgtcccgggttcaagtgattctcctgcctcagcctctcgagtagctgggactgcaggagtacgccaccacgcccagctaatttttgtatttttagtagagacagggtttcatcatgttggccaggatggtcttgatctattgacctcatgatccccccgcctcggcgtcccaaagtgctgagattacaggcgtgagcaacggccaccggcccactactttttaatatatcattaatttctcttttaaaaacagtagcaatcaataatttaaatattcaaatgaattcttaatttatatacacaaactaacatctttattatatctctatattttaatatatcaacatgtctaagataatttataaatttacatcatatataaaaatgggtttgctctcgatgtatataaggcttcatgatattttgaatatggagttgggtgaaaatagtgaatctgaatatttgaatttgaatatttattggaaaataagtagtgcttttaactttttaaatgagacacataatagtcccctgttgatttttttttatttttttaactttattaaagtatagttgacaattaaaaattgtttatatttaaggtatacaattgatgatttgacatgtgtacattgtgaattattcaccacaatcaagctaattaacattccctgttagtttttataagcctggttcaggtttgtagaaagaaacaaacacacatggccaggcacggtggctcacacctataatcccagactttgggaggccaaggcaggaggatcacttgaacccagaagtttagaccagcctaggcaaaatagcaaaccctgtctctccaaaaaagaatgaaaaaattagcctggtgtggtggcatgtacctgtatccctagcaactcaggaggctgaggcaggaggattgctcacttgagcccaggagtttgaggtttcagtgagctatgattgcaccattgcattccagcctgggtgacacagcaagaccctgtctctaaaagcaggcaacaaaaacacatgagcttcactacagggaattaaatacaatgagagtaataaaaaataggtgagcaaaaaaaatgcaaataagcaaacttttgagtatgatatttcattcttatcttgatttctgtttttaactccagattgattcttaaaatgctaacagttcataatgccagtgtaaacttgtcagtgattggactgaagaccttagatctcctcctaacttcaggtaatatgtgtatatgttttttgtgttgattcaaattaaaaaaaaagttgataccattaagtaaatgtgtgtgtgtgtgtttttttttttttttttttgaagatcaggattagggtagcttgatttaaatgtcctaaaattgcatctgtttttagacctagtgatgggacagccataatataatctaaatatcagttatttccaaaattctttctgtttccatctcttctccttatctcttttctctatactttgcctctcaaaaatctcattcaatacattggttttaaacattaccttatatattatccccaaatctctgttggtagtccgatgtttgctcccaaaatctggacctacatctcatattcccccaggttagtggtcattcctgcccttgccattattacttctttctccctatatatctttaataaattttctataatatatgttctggagtatgccataatcgttacattttgaaaacacatagtattacttcttgagtatttgctagatgccaggcttcacaagtaaaatgcttcacgtgcttttaaacacctgaatctgaaaacaccccttgagatagggattttatctcagttttctaagtgacaaacactgaagtgcagagaagttgctttggccactaagaggtagaaacagggtctgattctccatgtcaggttccttccctgagaaaactttggcctggtagataatggacctgaaaacaaaaaatcttgaaatgatgcaacagttgtgggcattgctgtgctggacactggctattatataaggttccgagaagaaaggccgctcacagggagctaatcttgaagggctgggaggagtttccttccatgtaggggagggctttttaggttgagagaagtatgggtgcagaggcctgggaggatagcatgagagaggctggacgtgtgattgggaaggtttgaattgtcctcatcagtcctgctaagagatgtaaagaccatgctggagaaagaggaagatgagagtatgagggaaaaacaagaaggtactcaacatttcactacagctttttatgaccatgttgtatggcatgcactaagagtctttaaccatgatttaatttaacctcacccttgggaggtattttttttttgacggagattcattctccatttggcgatggacaggaagatgagggtttattaatatgaaaaatctaccaacactggaatatattgaagttagcctcatacagtactactactcctattccagtattattatttttattgacagaatagatgctgtttgtgttaagttttggattatgataggaaatgtttggtatagtaaaaggcaagagtgtgacatgcagttagtccaagtacgaagagataccaaaaaaaaaatgtttagtgaggagcagagtttagcatatttggagtgaagacaatgtgcggaaggaaaggagctgatgagatacatgtactatagtcggttgtgtgaaaggtcttgtttttcatactaaggatcatgagaagatcttagtagattccagcaagggatttgcaagaccacatttgtgttttagaaatataatgcaggcaataaaccagttggatagaaattggggactgtagagcaattaagcaactgtttttgcattctagatgagaatgcaaaacacaataggaatgaaggtgccttgttcaaaaggagttttgttcaaaaggaatcttcaagatgtgtaggagatattcttaaaggacttggtaatgaattgatttgttgcttggatagagaatgagaagagaaaggagggtggaagaaggaagatgacttaggagtttctcttgggtagctagtggattatggtatcattgatgaagacagggaacaggagtaggccaggtttggggtaactgtggaatattcagatgttgtctaagaggcataagaatgtatttcagatgtttggggcaagttgtctaggctagaagtactgattgagactcatgaaattatagtaaagtgaactgggagtttatctcatttataaagatctagagcttgataagtctaacatctagggcagttaagtagtttatcaacaaacaaacaaacaaacaaacaagaaaaccatgggtctacaaaccattcacagtcttcatgtaaaaattaattcatgtaaaaattaacacattaaatgttaaagcagctctttactcagagcatattattctctttaaaataggtaaaatcaccttgctgatattggatgaagaaagtgatattttcatgttaatttttgatgccatgcactcatttccagccaatgatgaagtccagaaacttggatgcaaagctttacatgtgctgtttgagagaggtattttaaaatgtcaaattccttaaagtatatataagaaaaaaaggcttatactgggaaaagtagaacacagttataataagaagaaggtttctaaaatcctactatttattaagaagtgggagttgtctgtcaagggtgaggaatggggttaattcagaagtattgcttgttttggtggggtgaatttcattcgtgggttataaatcatgcccctggagtagactttcttcaattgcttaacaaggcataaggtttactttgaaaactggatgtgtgggtgctatgaaagaaaaaataaaactgtgaagccaagcataggttacactgggattatgatgttgagtcatcaccagaaatcatagaaattgcataaagagcctgaaggtttacaaagtgtccttcaggaaaaagactaatatgcatttcatagcctggccctgagattgataactgagattattatgtaattttagagttggttggagtccttgtttagtctttccattgaccttaggaggaagtgggtcacagcagtgaagtgagcatcctgcctgaggacacagagcttgtgacagtacagttcaattagcaattattttaagagccccttttgtatcattatgagagccaactgtgctaggggtttagataagaatgatttatgtgggccctgtgtcagttatcagtttaccagtctaatttcttgcagttcccagaatgggatagatcacctgataactgttgaattccctgtctcctcccagaaggattttaaacagcttatagataattataatacacaagagtaaacaaaatggatgagaaaataggtgaagggacaataatataaagctagattaagtttactgtgtttctaaggtcctgcatatttacaaaggggtgggccagaaatttgtctgtttgcttcctatctgacaaagaaaagaggtaaatatcagtggttacaaagttccttaagataaaagtaaacctattattcaggagaagcaattggtctcatgggagatctgagaaacatcttcccatgggttttcctggatgagacaataaaggacatacattttgcaaggaatacaaagtgtattgcagcgagagtgactctgtcaaaagtcagaatagcatgggcctggtacccagctctttgataatcatacaccgtgaagtagaagatagtttacagcgagtacggaattccttcaggctgtcatgtataaatgttctatcttgcaactaagctttcgatgacaattaggataaagtttgaggttctattgtcttgcagggtctgtaatcttctgtgtggaaggttaggggcacattcttcttcctggaaggagggctagcatcactttatcaccatcgttgtttagtccatctaagacactggaggtagaccatagaatgttacaaagaagaatgttgctcaatagaaaaaccatcagtgctgagagggttatgactataaatgtagagtagaaaaatttctgatttttccaggagtatcaggttctccaggactcaggggtgactataaagttaattttcaaaatttgaaagtgtactgtggaaactagaccataaagtgagaaagttccatgatattcttcacttgttaggaaaacttaactgatttcacattatattatagggacactctggcataaaattaaaaaaaatgaatgttgatcacttagagtgctgtgttttctaacatatttctggcgccattctcaagctagataaactataattttatacatgtttttcaggttgttgcccaataacaatgactccaaatggaacttactggcttgatcaaatgactttaattgtgaaaattaatgatttatatttttgctgtctgatggaaaaccactaagacagagtatttcaaagtctgattacttgccatttgctcaagttgacaactcttgaactgaaacatttagccgagctgcccttcagcagcctaccattaatgcctcccttttaaatattgcaatatgtccagttccagttggccatctttattagtcactgtcagttttctctagaatttcccaaatgaaattgtaaataattttgtttttctgagaactgcttgctgactagcacttttacatttcaaaacatggagtacctaacataggccgaaacaaaattatttgaatctccgtagcttgttttctcattataacattcttaggaagggctgcttcacagaaatatattttttatttaaggagattacacttgatgtatctcacacaactataatgaatattgtaatttttgaataattaaactttcatatcatctttaagcttattcagtattttgtctttcatttttaagtctcagaggagcaactgactgaatttgttgagaacaaagattatatgatattgttaagtgcgttaacaaattttaaagatgaagaggaaattgtgcttcatgtgctgcattgtttacattccctagcgattccttgtaagtagcatttaaatgttatttattttttgtatctgaaaaattacaatatatctcattctgagtatattttaacaatatttttattatttagaaacttgtggatgctcaacccattcattcatttattcatttaattaatttacattcactgacattatactgaagttggctgtgggcttggtgctggagaaacaatcgtggaaaatacagatgtgttccttaccttttcagagcttgtagtacaatgggggacacagataagtacagaggtgattacagtggcagaagtgatggcagatggcagaagtacctagagttaggagatcaaataggaagtgaggcagtgtctcttagcaaagatttaataagtggagcttcctgtgcatgaaggtgtgacctgaagtgagaatgcaggcaaagtggcccaggcagtgggcatggttaatgtaaagatgctggagcaagagagagcagactgccttcaagaagacaaaagtagctcagtaaaggtgtggggttatgagtgtgcgtgcatgcatgcgtgtgtgccgctgtgcatgcacatccccaaatatcctatccgtttgtgtttcattgacagaggcaagggagagcttgataagaggcagtaaatgaggccagagacatggagtggagagcatgaagggcctaaaaagccacatgaaggagtttgaattttattgtgactcttgattagcattttaatgaggctttgaaatttagccacatttttcaccaaaaatattaatcagaagaaattaatttgatgtgtatgctaccaatgattgctattaggctaaaataatggttcatattctgttttgttttgtattaatggttcatattctgttttgttttgtaagtgaccattaacactttgtattttatgtattacttgtgtgggtttctacaggatatacatatgcatttatctagtgatattttcatcctcacacatgtgaagttttgaggattagagttaaacaatgtacctggtatgtaataagtgttctaaaatcactgacaggattattagacaatatgtattttatatgtgtgttgtatactatatgtaattgcatttatggtttcagatatggaaatcactgtgtcaatctgaaggtgtgagccttcggtgtaggcagagtaaaacccaatgcccttgtgaaagaatgcttttttttggtgatgtttataaaatcacaatgttttcttatccacaggaaattaaacactggaaagtgggtggggctgaacaataatagagaaaggccatggttttacatttctctgagacatcactgccaacaaactgaatatgtttttcattatactttttccttggctatatttattcatttatttatttattttgggctggaggtttttggaatccattgttttccacccacattggacataactccagtaaaaatgtgttgattcataatgcaaaagtcaagaaagtagcagctaaaaattaagaaatcaaaagtttttaaaacactgattctaactgaaaaacatttgcttttcagtctttaagtctattgttctgagtcaaagcagttcatttccttacgttgttaattttttttctatgtttaagcattgtaatatactttttgtgaaaacagttgattagttttggttgtgccaaaacaaatactaaaatgttttgcaaacagcctttttttaaacaaaaaaagaacagttaacatttgatgcagagatatacatgttttctccatgtaggttcacacctcacttcctttattgattaattgctttttctggtagagtctttctttcctttctgttttacctgtgtttgtccctaagacttatattttaatattatgcctcctctctttcgttctcccatcttttcttccacctattttggagccttcaggaagcttgattttgctgccttgtacattggttgcccttctggaatggaggaaacaggtcatagctgattttaactgttccatctggtgacatattcttgattttctttcttttggttggggaaaaaaaaacaatgcaaaagtcattctccaatggggttgagcctcgttaagaaatagaccctccacaatggttgaactagtttacagtcccaccaacagtgtaaaagtgttcctatttctccacatcaaaaaaaaaaaaaggtaagcaatataacatgagccatatctaataggacttcagaaattatctatcctatagttccaggatgacgatgatgatggttgtgataatgatgaagattgtgatgatagttatatgggagataaaactttaagcactttacatattaaattctataatattcaccacatctattaaaatatgttacattattgtccctattttaccaacaagaaaactgaccaacaagattaaacaacgtgactaagttcacacaacctgtaacagcagaatctatgtcaatcacaacacaattagcagctatttctgtggcaattttcaataaagatgtgtctggaaaaaaaaaaaagaaatagaccctccaatttatttatctgaaaacttatgaccaatacattacatttccagactttcattttcagtacttttcctttcattttcagtactaaaagtactctgaatttttcctttttttgatcttaaggctttaagccaagaaacaggaataaagtaaattttccttaatgccaaagattagtcctacaccccattatgttattaatgaacagcatagtattttttacagctacttaaagaacatgatgtttaaatttggaaatgcagtcattatgctgccatctatttacagtctatataagacgtctttgtatgcatatttgaaaggagaacatggttaccttattgataattatgatctctttaaattcaggcaataatgtggaagtcctcatgagtggcaatgtcaggtgttataatattgtggtggaagctatgaaagcattccctatgagtgaaagaattcaagaagtgagttgctgtttgctccataggcttacattaggtgagtttcttagttaatatgtcatcacacactgtatgatatacatatacatataaaacatatatatgttgcataataatggataagtagcatattgacatactttgaatgaaaatattgtaaaatcccagaaaaaataaattaaaacaaaaagaaaatactgtaaattaccaaactgttctgctgtgcttagatggacttttaaaaggagtgtcaaaaatagatgtgtagaatgtaaaagaagtattatcttaatcttatttttatagatgtagttctatagatgagtttttttattgttgaggctatatttaaaatataattatgtaagaattgatacatacaaaaatatgcataacatatacaatataaagcataatgcaaataactcactatccaacttaaatgttgtatattcccagtgggggaagctaccctgggcttcttcctgcccttgctttctctatagaggttaacactatccagaattttgtgtttacaaatcttttgtttataaatatgatttactacattttcatgtttctctaagcaaaattgttaatgtttgcctgcttttgcttcatcaaaatgtaatcatactgtatgttgtcttctgcaattttcaaatatcagtgctatgattataagaatcagaaatatttttgcatgtggttgcatgtagtattctattatttggaaataccacaatttatttttccatttttctatccatggacatttggattctttcttattttatgctactactatctgtgttaaaacagataactgaaaaagaacagttaacatttggtgcagagatatacatattttctccatatataaataagggttaatattttaaaaaatatttatttgccattggtatgtccttctttgtgaaatatgcaatctgtcatttatcaatattgttcacaggatagtctgtctttttaaaaccgattcatagattctggataataatgttttggtggtaggttatacgtattgaaaataccttcccttgaacatcacactctggggactgttgtggggtggggggaggggggagggatagcattgggagatatacctaatgctagatgacgagttagtgggtgcagcgcaccaacatggcacatgtatacatatgtaactaacctgaacattgtacacatgtaccctaaaacttaaagtataataataattttaaaaaaaaggagatgaagaggtagctgcaggttgactgagcaagggtcattgtctatttgaagtttcaaaggtatctctgaaaataaacacagttttttgcaagagtgaaaaaaaaaaaaaaaagaaaataccttcccttgacttgtagcatgtcttttcaccgtctttatggtggcttttgtgatatagttaaatttaataatcagttcctttgtgatttactcttttttatgtatcttgtttaagaaatcttaatctgtcctttccctaagataataaatatattgtatattttattccaaatcttactcgtttgttaaactgttgcagtttgtttttgtaaagaacccaattccccctctttttttcagtgtggagagctagttaccatcacagcacaatttattagaggttcacctgtttcccagtcatgtggtatataaatatgtaaacatatatgcttatgtttctgtccttggcgttctgttgcattaatctgatttgtctgaatcagatttaaatctgatgttaaatataacactatttaaattaatagttctgtaagtcctgatatctgaaaagctaataggtcaagtcaccatacattcttttttaggcacagcttgccttttttcttgggcctttactattccatgcaaattacaggattaacttgtccagttccttggaaaacactgttgagattttgactggaattgcacaaaatatgtggatcattttaagaagaactgacatctttacattataatttcttctatacatgtcttgcacatcttagtttttgctacgtatcttattttttattattattgtaaatggtatttctttttaaatcatatttttgaactgtgttttcataaagaaatgcaaatgattttttgtatattgaactaacctacctttctaaactcttcgttaattctgacaatttgtttctaaatgcacttaagttctctacctagcaattatataatttgtaaataatgacagtctgagttcttcctttctgcttcttatattctttatttcatttccttgtcttcttacatgagtcagaattattaatatagtgttaaatagagccattgatactagacatccttgtcttgctctttttcctgattttaaacagaatatttttaatattctcccatccaaaataatgcatcttacaagggtttaaacttttaaaaaaaattttgttaagaaattttattttatttcttctttgcttttgttttttcaatgtgggcttttaaatgtttgcttttatttttacaatgtgggcttaaaaatattaaaatatttaattttatcaaatatacttaaaatgtagtaagtcttttttttccttttcattatgttaatatgaagaaatacatctacaggttttctaatactaagctactgtgcacttcctgataaatttaacttggtcatttattagatttttaaaaacacttctaaaaaatcttctctgtttattttcacatataccaggtgagttttggcagcctcttgttttttcttttttaccctttcttttttgttaaaaacatccttttatttatttaatgattaatacatggctattttgtgttttgtatctgataactatatataaagttctggggagtctaaaccaactgcttctaggctgactgcctgtcagttgcggagccttgttttcttgtatggttgtgagtttctcttttattgagcatcctgaggacttaaattaaagatgctctttcagaggtgtttgccaggagtcagagcacaggactgacctgggagcagtttaggatatgatccaggcttaatatgggagactctggttgagaccttaccttgcagagagtctgaaactggtttgttgaatgcagcgccaggattcatgctttcccacaagactactctggcgttcaactcacagctcttgtttcagcttctttttgaactccctctgcccctcaacacacaccttggaaatttccttgatatttttgtgaggacaacaatgcatttaaaagtgagagtggttgctgaataataaggaatgatcgttaactgttggacattgattctgatgacattttctcaaaaggataaccaggaatattttgtacaaaattaggattattataataggcatttagtttttcattgttacaaattttgaggaaaatcattaatcatttgaaaaaactaattgacatgtctccattgtagcaacttgtattttcacttctagtatcatgattatatcccctgtgtaatttggaaattgattttagcattaggaaatttcctagtttcagttaaaatgaattttttgtaagctgaattctattttacatgcacaactttagtttgttatttctttccttgacaagcatttattgaatgttgttatatgactaaaactgtaagatgataatgttttaatattttcacatttctttcatagcttccaaagtgtatatatatactcacatacttcatatatatgaatctacttatatactgtatataaaaatatgtatataaatatatacacattgtatataaatgtgtatatatatttacacatgtatataaatatacatacaaatgtatataaatatacatatttatacacagatgtatataaatatacatatttatacacagatgtatataaatatacatatttatacacagatgtatataaatatacatatttatacacagatgtatataaatatacaaatataaatatatacatttatatataaatatacatatttatacacagatgtatataaatatacaaatataaatatatacatttatatataaatatacatatttatacacagatgtatataaatatacaaatataaatatatacatttatatataaatatatatattttttgatacgtacaactatcttgggagatgggatattgttattatttccacatttacagatgaggtcctgtggttcatcaatctttgtgttttattcaagattatgtaagcagtaagggatgaaatcaggctgagaacccaaatttcttcatccctaaacaaagtatttcttctaaacatggtatccatttactagtttatctctatcaggtgaccctttattcattatttttcatgagaaggttgtagttgtacaaagtggctgatatctgataatgttttaatctaattcaaagtcgatttcttaaatccaggtgtcagagtagcacactactgtacaattctctgtttcatgttttacaatttaccacagtcaagttacaacttgcacatgttacattaaaatgtgaattcaccttaatttcttgaaatgagccagaagaagaagtggttttgttttgtgatcagggaaatgctacttgactgccaaattgtctagaacagcacattaaagttgcttgattttatactgttaaaattaaataaaacatggcaactgtcatgtcatatgtaacttttgtattattctgtaactttttttgaaaataaaaagtgatcaaattgatcttcaggtaaagaatcttttttctcttgattatctcttagtggatgatgatttgttccatttaatgggtagagaatttattgttgctgttattgtttcaaaagtagctgaatgaaactcttaactttttcttcatagttaaaattaaaacctcaagtaaataaatatttaacgttttgccaaactatgtaatctaattatgggcttaatgcatttaaaggctttgtataatttgctacgtattttcacacaagttacctgaacataagtccagtcttcctgctgttttctgagtcacacagtgattcagtgaccgaacagctgttggcagtggtgtgggtataatagggaaaagagactgatggggacaacccaagtttagacaagctggtaaaagtagaagaaaatcttcttgaaaacactagtgatcactaagggctgtggagaatttttgcttggtgggtgaatgtggaagaggcaacagcatgggaaggtgttggtaaaggagctccatacttgcttaaactgccttttgattgtgaggccgttgatgaatatttagtttgggctttaggttttttatgatacaggatattttccatttctggctttgtatctcagagatcacttagttacacttatagatgaataggagtttcaattccttgttttagaaagaagcttggtaactgttagtgagttacaaataagccaaatagaagaaggtacatatttctgcagtatcaggtaaagtttttcctcataaggatttagactcttggatatcatattaattctcagaagagtgggtataaaaaggtatgggacttcttcctggggtgggttggaggtggtgaaatacctttttttttttttttctgagatcatcatagacaagatcaaataatggtaaacatgccaatgaattttctaagcactattcctttaagtgaaagaagagtgtttcagtaaaatgatttaatattgggtcttccaaaagatggatttaagagtttcaactttaaaagacagaaaaattaagttattttacacaatgaatattgtcgtgccgtgtgtcacagacatgacatgagagggaatcagagaacatacagttaatacaacgcaaactagtatcattacttttgctcaatcacttccattgtctaagtaagataattaaaggacagcataaaataaaatttcaaaactttactcaatcatattaagctattttaattaaagtaaatgttttaatgccattgaatattcatcaccattcaaaattattgatgtaaatagtgttatatgttaaaggtaatttaacttccatggatgagaattcagctaatgtttcacttaacttttaggtaattttttcaatatcctggtattaaacgaagtccatgagtttgtggtgaaagctgtgcagcagtacccagagaatgcagcattgcagatctcagcgctcagctgtttggccctcctcagtaagtaacttcactaaaaaggggattcttacagaggcatttgacatcaaatatgaacattgtaacaagagaatcatatgtacagatggaagcattcaatgccttttctgtcctgtgtagctcattttccagtagaggatactttcaaggaaactaacagttgtgacaaatatacacatctcaatgtagagttttgctttacatcattcttgatttagctttgtcattaagcagctaatctgttttaaaaaaatttttatttgtgcctgggcatggtggctcacgcctgtaatctcagaactttgggaggccgaggcgggtggatcacaaggtcaggagttcgagaccagcctggccaacatggtgaaaccccatctctactaaaaatataaaaattagtctggcatggtggcgggcacctataatcccagctgctcgggaggccgaggcaggagtatcgcttggaactggagggtaggagttgaagtgagctgagattgtgccactgcactccagcctgggcaacaagaatgaaactccatctcaaaaaaaataatttatttgtgttttaagttctggtgtacacgtgcaggatgtgcaggtttttcacataggtagacgtgtgccatggtggtttgctatacctattaacccatcacctaggtattaagcccagcatgcattagctatttttcctaatgctctcccttctccagtcccatcccctaacaggccccagtgtgtattgtccctctccctgtgttcatgtgttctcattgttcagctcccatttataagtgagaacacgcagtgtgtggttttctcttcatgtgttagttatctgaggataatggtttccagctccatccgtgtccctgcaaaggacatgagataattcctttttatggctgcatagtattccatggtatatatgtaccacattttctttatctagtctatcattgatgggcatttgggttgattccatgtctttgctcttgtgaatagtgctgtgatgaactaatcttttcaaataatcctcctctcgtctattaggttttttttttttttggtaccttcttcctcattttattatttatctggataggatggtagcattatgagacgtataatatattaaaaattatctttataattgaccaaggcttctcctaaagcacacctcattctgttggtaatatttcaaaatatggacttagagttggtcaaactgttaagtagataatatatataatgtttttatatatttttcaatttttttcaagctgagactattttcttaaatcaagatttagaggaaaagaatgagaatcaagagaatgatgatgagggggaagaagataaattgttttggctggaagcctgttacaaagcattaacgtggcatagaaagaacaagcacgtgcaggtaggactctcataaatattagagttattcaaaattatgttttccagtcatttatattttgacagatttcttttttctcccctaatccaggaggccgcatgctgggcactaaataatctccttatgtaccaaaacagtttacatgagaagattggagatgaagatggccagttagtagttttgattttatatgatagaaaatttcagttatattttaaatcaatacctataaaataccttaaccgtaacttttattgttagaaatatttttgatataggcatttagttttagatgttgctgcaaaatagtagtaggtatgtagtattttgatctcatcaccttcaggagttagaaaaggtagaatgagagttattattgagagatttggaatcaagggtcatttggtaattcatgaatcatggagaaagaatctttctattttctggctgatcgttttaaaatgccatattaattcatcttgggtgatagaaattgcagagccatctgtgatcttttcttctatggtgactagccagcaggttgtcaatatcagaaattagatttggttagagagcttcctatgatgagttcccaactgatgtgacagagttgacctgtcttctttcgagagggttatttgaagctgtcatctctggataactctttcaataggagtgccattcaaacatcataagaccggcactctctcccaaagatacaagctgtagcaaggagttttgtgcatatcaggtttgtttcatatccgtgagcctttgtgttttatggcaactgattgattatacttgtgctatttgcaatgggtatcctctgggttttaaatagtgaatgacttattttggaaacaaatagtagtattctatgtctgaaatcttgaccgtctatttgtttaattatctattgctgataagaagggaattaataacacagatgctacttaattaaatattttcattttgacaagaaacagtaattcttttgaaaactatgctaaattggcatcttaataatctcatgttgagcaaggcttttggagattagggtaagggagattcatgtcgcagtttataaatttcagttcataggatacctatttttcaatatccataagataactttaaaataaatatattattaaaacaaagaaaatatatttacgttatacatctttaaaacctaccttgcttctttacaattttcagtttttcctctcttgtttccattctcttctcctcactttacctttttcctcagcatctctttacatatctgctgagcttttttatttctctctgctgcatatgcttttgaaaaagcataaaaatactaatttgttaggatttaattaattcgagtcttaaaaaatgaactataattcactcttgtaagtggaggtggcatgaaatattgtttatatgctcttaattgttgttagagatatttgataatggcaagtgagaatttgagatagttatttaaaagattactactaacattttgtttgaatttttgaaagtttcccagctcatagggaagtgatgctctccatgctgatgcattcttcatcaaaggaagttttccaggcatctgcgaatgcattgtcaactctcttagaacaaaatggtaagcagtgggccatgttttcaaataaagggaaacacatttttgtggtatttttaattatagaagctatatactgtgaaaaatttacataatttataaagctatatattgtgaaagatatctctatgtgtagagatgtattgacatatggattatgaatatataggtaaaaggatgaagaataaaataaacatttgttgtatatttttccggacttctatgtgtaaactcacacatgacatatacaaaattttatgtattttgtagaaatgggatcatattatactcttttataaccaaattttatttattctcttttttatgttgatacatgtgtattctcacattatcattttatttttaattttttaaattaatttttgtttttagatatggtctcactctgtcacctaggctggagtgcagtaccatgatcatggctcactacaacctcaaacttttggactcaggtgatgctcccacctcagcttcctgagtatctgggactacaggcatgcactgccatacctggctaattttttgcagagatggtgttttgccatattgcccaggctggtctcgaattcctgggctcaagcaatccatctgccttggcctcccaagtgctgggattacaggcatgaaccactgtgcccggcccaaattataatttttaatagctttgtagtttttcagtgcttgcctgtattctgttttatgaaccaatttcttactgatgaagttttagtttgtgtccagtgggatgtttctggaacccatagtaaacaccagtgatcactttcctcctctgttttcctttatacatggttcctattattttcttgggaaaatttcatagaaatgcaactgggtagagagctattcaccattttaaaatctggtaaaattgtctattataaatttccacactatacttttttaaaaaatcgttctttaatgtaattcttataaatcttatagctttgtataattatgaagagaaaaatggcttgtatccctttagaaagacatgagttttaagattatggttcaggctgctcaaatttcttcccccataaacaggaatactgccagaaatccttaggtgaaaactcatcataaaggcattgggacttggcagcttttgcaggacatttttagagggcaaaaaatagagaaaaacactgaaagtcagagacagagaccagtgtaagcatcagcttttaatagagaaactgggtagggtggaaaaaaaataaagcaaccacctcatgcatgtttctttatattattattgaagtcaaataaagaggaaaatcatttcttcttcctcttcctcctttttcatctcacctctccaatggcactttaataaaacgcttggagtggccagggcactgacagacagacaggggctgctctcaaggataatgagtcaaaggggaaggagagggaatcgctgttctcgaatctctcttattctactgtgcagttaaagaggtctggacagggatttcactcctgaaaatgaggactggactttgtggcttctgttggggcacctttagagtggaggtagacttttactatgtacagacaacattgtgttggtgacatcattcataaccacctggaaatctcctttgatatgcaaatcaaacaaccataactttgtgaaatttcgactgcttcctattgtggtgtctgaggactggttacattcagagtccaccctgatgtctttgttcagttttctgctctttctagttccttacttctttgttcctgatcacctgtcaagtaaaatgtcctcagatccttttgtattgtctttggagttctgccttaataaagcatgaagaacttgagtagctcgttcatcaactttcttgggcaatttctcattgaaagacacttgggtgtctttgggtgtgcagagctgagcatggctttatgtttttagaaaaaatggctacattggcaggcagaagaactgcgtccttggaatcatggaggtcccaaggttgcatacattttgtgtgacatttttcctattcaattaattaactaatatttattgagctcccaagtgtgtagtgtctgtaggcacttgggatgcattcattaagtaaaaatcccaggctcatggagtttaaactgtagtagggaagataataagattaactaaaatatgtaatatttgaggcagttaagaataaaaaatgaagcaaggaaggagaatatgatatgttagacatcagaggagatgaagttgtgaataggcagccaggaaagaaggtgactattgagtaagacctgcagggcgtcgcatattgttttttgcctctgaaagcagttaatttcctgttaaaatggagtggatgagatcaagagtattacgtagatagctggtaaatgcgatagtgtgtaaaatgttctataaagtctaacgtgactttatgatgaaatttcttcttctaggtttattgcttgcaattttcaaaccacacattgggttactgtctaggatagtgattcttaaagtgtggttcctggaccagcagcatttgctgggggaacttgataaacagtgtaaattcaaggaccccatacagaccttctcaatcacaaaccctggagttgagacccagcaatccatgttttaacaagctctccaggtgattctgatgcacactaaagtttgagaaccactaacccagtgtcatttttgtcttttaaagtgtcttcttggctagaagctagccactttgggaaaggttattacaacttctgatgtgatcaagcaaagtaaccaactctttattgtatcttaatatgtgatattctgaatgtgtttaaaaggtatgagtttttcaggctctggcagtattttagaatgtgtatgtgatttctatttatttccatgttttgtcctatcttcttaagatagactacttattttaaaagcagtacttaagttaaaactttttatgtttctttttctgccactttcaaagtgttgaatcacagtgtgtaatgttggaactgatatttttatagcggcttcaagacaattgatatttatgtggaaacttgaagacagtaggtttatgtttagtgaaggaagtttattacaaagaggaaaattggccagttgtggtggctcacgcctgtaatcccagcactttgggaggccaaggcaggaggattgcttgagctcaggagttcaagaccaggctgggcaacatagtgagatcccctctctacaaaatattaacaaaaattagccaggcatggtggcacacttgtagtccctggtacttggaggctgagacaggaggatcacttgaggccaggaggttaagactgcagtgagctatgatcatgctactgcactccagccttggcaacagagagagatgctgtcacaaaaagaaacaccaacaaaaaaagaggaaaattattccttaatcattattgctggaatatagttactttccacaaatagtgaagtgccagttgtaaagcatatctatatgtttcctagactttggcattactttgtgaaaataactgtaattacttatgttctatgtaaatgctttccattcatttgtatatgatggcatatatagaaattataatgtttgtaaagtccactgggataaatggacaaagcagctgaaggctgaaagcaaccaagccttttacagccccttcattccccacactcccaaaaagctgagtgaatggtcgatacctccacatgcttataactcattcccagcccaccagtgtctagcatatctggttagtcttagctttatataagtgcagttatttgtgaacttgttttaagtattggaatacaatttaactttcattcttattttggagaccattatttaaacagatttcttttttcctgcaaaaacactcttttcacaatggacagagacacggtgattacattaaaaccatctactctatgaataaaaatgttaaaaccaaaatcccaacaaagggttaataaaggcaaaaaaaattggaaatgacatgtgttttaaagaaataaacatgaattatctttaagctgtcaatgaactataaattatgtgtgctcttgtatatgctttcctgtaaatttggactatattaatattctaaagcttatggtaaaattatgaaaatatgctttcatatctataagtaacattttaaaaaatctcagttaatttcagaaaaatactgttatcaaaaggaatacacctgaatgttttggagttaatgcagaagcatatacattctcctgaagtggctgaaagtggctgtaaaatgctaaatcatctttttgaaggaaggtaatatagattcattaacttgtacagaatatatcatattgggccaggtagaatatcaatatttcaagcatatttctaacaatgaaaagaaaaagaaaaacataagacacttgaaaactgaagcattttgcaatgtaatctcgtgtcactagtaccatagacttactttatctgaacactgaaaggaatggcaagattgtggaaacatgttgaaggtttgcttttgaacctgatgcttgatgttgactatattttgaaaagtggtaattgtatagcacatagcatacagcagtttttctaattattgtgtgtgtgaaagttataaaagataaaatcagtttatggctaaattttgctctttcacaacgaatatattattccttcatctgaatgaactttgtcttctcttcctgctctcaatccttagttagggaaaattttaactacatctagtccaagtgcagagatgctaagattatatagctggcggttagtggcacaacagagaccatatcctttgatctatgtgtggatggtggtggggcagggtgggatgaggtgggggtgaggggtggtaggtgtgggcagaactctcatgtgtaaaaaaaataattggcacagaagttgcagtgaaaactaattttgttcctggttttgccactaatttgagccaactgtttcatctctaaaacttcacgttcctcattgataaagaggaatgataataacaactttgaaagttgtaagcttagaatgtaaggattaaataaattaatttttacaaagggattaggataatgcctgctgcattttaagcactcaacaaattgtgtctattgttgttatactgttactaagtgtgaataaatgaagtgcatatagcatgaaatgtagcgtaactgcagacttgtaagaagtagggttacactgtttttaacatcagtctaactaatctatgtttatatatctttctaagctgtatttctcttatttaagtgttgtttttgaacactgagatgaaaagtttatcttaaatgttgattttaatggggccggaagtgtgcaaacctttacaaatgaggcaaaaacacagcggaataaactccagtctaggattctgtagattctgggcaaggcatttaatgtttctcgctgcatgctcttacgtaaaatgtgtacagttgcagccctggagattccgcattggctctgacagtgtgtctgcccctacagaactcatgtgagtcgagagactgataagtaaacagattattataatacagtctcagaatgcagtggcagtagtgtgtaaaagacgcaatggtaagagtagagtggactcagctggggttacccaaggaggggaggctccaatggagggatgtgtttaaactgggactttaagttggaaaagaaggaatgtatctcagtgtccacagaaccatgcaaagtgagaacatggttctgatatgcacaagtttcagttaacaagcaaagcaaggattgactgtattaaagttcatagtacctactgcattctagtcaagtgacatttgctcatatgtaaaagaaagaatagcttaaatacctgagagaaaccaagactgtaaaacaaattaaaaataattaaaaataccttataagaagtccagtgatgttaatctggaagaggaaggttcgtgtgatgtaaagaggccttgtcttggggtcagacaagtttgggtaccagccttgtctctgtcactttctagtgataagacctgaatatttaacctctatctgtctaagttcttcatgtagaaaatggggataataacacctacctgctgggattgttgttattgacccatcgtaggtcagaaggatgttgttagttttatgaagtgaaataattcccggattactatgaattctatcttatgagttcaaagtttagacaattaaaattatgtatgctcatactactgatttcaaatgcattttcatatagtctttcctgataaaatatattggttctgccctcctgtacttatttcaatttggtgtttataccattgaatcagatcagtctttcaataagcatgccaattttatatccccagcaacacttccctggatataatggcagcagtggtccccaaaatactaacagttatgaaacgtcatgagacatcattaccagtgcagctggaggcgcttcgagctattttacattttatagtgcctggtaagttacatagttgattgtgggaagagataacaatttaaatggatttttgatttttcatgaaatagcaatattctaggcaaatattaaaagactagtttctgtcgactaaatgtaaatctttctgttaaaccaaaaagaggttaaatatgatgcagaagagtcacttagattaatttttataagaaagcaatatgaattcagtaatttatttatacaaagtaactacaatgtaaaatgtggagcttttatttttaaggagggtgttcatctctgataattcttttctatttttgttgccatgacctgagttcaagctttttttctcttgtttgaattgtactattagctaattttcatacctgttctcttccttcatttctatccttttcttactctatgattgaattaatctttctccaatgtggcttgtactcatttacctcaatggcttccaccctccacccacctttaattgttactgacatctgttatcaccttatttgttctccaaagcccctttaaaacacctatgtctgtattcatccaacacatttattaagtgcttcttatgttctaagcactgtgatgctgttaaactttaaaagatgaattggaaaaaaagcacaactgtactattataggagcttagaggtagatggaagtgtaaatagataattaacaggcagcgtgagagaggcgatgatagatgcatatataaaaggctttgagaatatcgatggaggcacaaataatttcttcaaaggagtaggacagagattgtaatatttgaggtggaagggtagatagagctggcctggtagaaaggccaaggaagacatttcaagcagaagaaagtgcacatggtcgggggtgagtgaggcatggaggataaggagaggagtgcttggggatgagtgtggaaggaaaggctgaggcccaaagaaaagggccttgaatgcagtgctaaaaattttttgccttttaaaaatggaagccaacccaagtttattaaaattgtttgcagattgtagtgtcacaccgaaatttgcaactaaagacaatagcattgtggtgcagaggatgatagacagggagagagactagatacaaggagattgggttggaggtccatggtagtcaagtgagacccagtgaagggacccagcaatggaaacacagatgagagggcagattggacagatggttgggagatctgtttgatgtgacatcgtgatccctaagtatgagggatgatactttgttctgtgaagttcccaatcttttgaagtcatttttgctttgttcttttaaaatgaaatcttcctaaatctatcattttctctagttatataggtattttgtttctctgtataagagtattactcaatataaaagttttttcaaggacagagctttcttcagtcatttttttctgggccccccagtcctctggtggctattcaatcagtattttaaaaattgaatcatggtgtcctattcatagtttcagcttagttttgagacgtaatgtaacagatgtaattttacttgaaaatattattgcatgttttattgaattttatttttagattgtaattaaaaacaataaaaatgccttttgattatccttaaagttgacagccttattcttttgagggaggttttgggttttaaagataaccaaaggacactcaaaaaccgtttctgttagttaataaaataatactcttttagtccaaaagcaagttttgaatacagtatttcttttcttttattgttcttaaactgatcctgaaggaaaattgttagttaacaatcaatcagatgtattatgggtgcccttgaaaataatcacttgaggactgtacttaatgtaaaaaaatacattttataagcatatcagtatgtaagtacattcttctagtaggtaaaggcttaatcatttactgtatgctaacatattatactaccacagtacaccatactgtactgtacccaacgtaatgtaccatgccgtgcagtaccgtatcattctaggtatcaacaagtaactatggtagcaatactccagtagttttgaggttgaatatgattctggtttgaacatgttaagttgaggttcttatgagatacctaggtgtacatgtattcatttattagctagattatattcaggttttttagtggcaaagatgtacattatggcaaatgtgtataatttagggtccaattaaggatagcatattgcatctagtgcatatatcttaagtttctttcaatctattactgtactttttctcttctactttataataacttgttatatagacattgagctggttgctttaagaaaataataatgaagacccagttactttaataaaatatcatttgacttgtttcttgagttactgctagttttagaggaaataatgtgaaattctttaagaagggatataggcaaattgggaagtatatagaggagagtgattagggagataaaagcacatcaaaaagagcaataagaggaactgagattgttttatttgaagaagagatgactcaaagggatatgaaactctattcaaatctacttacttataaccagtaacagtaataataccaaacaatatggaggacttaaaaagtattaggcattgtttgaagtattttaagtatattatctcttctgattctaacagcactccatgaggcagatattattattattattattttggtattgtatggactacaaaactgaggcatagaattgtagagatttttaaggtcaggcctgatataacagcaccagattttcagcttatgcaggctgactccagagtaggcattttaaaataaatatttgtgcaacaatcttgtcctgaacaactgttgtatttaaagcactatgtctagaatccttaaggtatcgggagatgatgagattatggatactgctctcaaaaaaatttacagtccacacgacctaaaggactgttatgtagaaaggaaattatatccatttgaatagtaggacctcaagtgatagaacaaagactggagaagaaatttacaggaatgttcatttggtcttaatttaaggaagatgttaaataagacccattacatgtagcatgatgtttttactactcaggccagttttagtggtcacatcttcttaaggtgtaataggcagcctcagaagttactgtggtcttgctcactggaaatgatacacagacagtttaagggacttgccccagaccacacggcaagaggtgaatgtcagaacctctttgagtacattttaaaataaggactgaaagttggaggagggtggttatcaaggctgccttccttaccatagtattcccagcattaacaaaatccttggcatgtaattggaattcagatgcttcttaaataaatgaaaagcctgttgtagccagcttacagtttgcattaatgcagattattaaagtggaagatcataaatgattttttattaatatttatgtctataatcttaggtttggaaaacattattcattcataataattttaattatatgttacattaccacatttttgacttgtagtgtttttagcatagttcagctacagtgtagcttaataaagaatatgattttttaaaatagcaatgctattatatagcctttacagaacttctaaaaaatgacatgttctctaccaccttaatactgaaactcaaatcttattttttgctacgattattccagctactcttttttgtctatatttcatttctgcctttttatgttgtggtccaagtaactctgagcttttctcatgttgtccattgttgcataaaaatcttccagcatcttaaagcacagcctactcacacaaaaaagtgattgtttgctacagaaaatttcttcaccatcgtaattttttgctacttcaaattcagtaagcattcttacacattatatttattttatattcagtgatgaactatttttatagattccttaaaatttctggttatttatttgataaggaaacatgtactagaaaaaagtacaacacatatattgtgagattaattatgacaatttctagaaagtaacagtctgttcaactcaaatgtttataagaaaattctttctttatttatttatctgtgcatttaggcatgccagaagaatccagggaggatacagaatttcatcataagctaaatatggttaaaaaacagtgtttcaagaatgatattcacaaactggtcctagcagctttgaacagggtatgttgaatataagttttctgtatttatactattaactaaaatattaaatttggagaactaggggcgctttttcagtctaagttttctgttctccgtttgctatgataggaggaagtcatgtggttagagacataagatgacagtggggatgtgggaagtgaaaagatatgtactaagctaagtccagctaagtgtattatcaattatagatgtaggcaagattcttttgattgccagtaacataaatccactctagtttgctcaaccagaaagagaaccaaagagccatatatgcagctagaccttgtgagtcatgctgggtactatggctgctgttttctctttctgtcctctggctacttgtctttcttttctggtctcatagtatatggtttagcccatgaagacataccagtgttaacagtaaagtcttcggctgggcacagtggcccacacctgtaatcccagcactttgggaggctgaggtgggtggatcacgaggtcaggagttcgagagcaacctggccaacatggtgaaaccctgtctctactaaaaatacaaaaattaactgggcatggtggcacgtgcctgtaatcccagctactcaggaggctgaggcaggagaatcgcttgaacccaggaggcagaggttgcagtgagctgagatcacaccactgcactccagcttgggcgacaagagtgagacttcgtctcaaaacaaaaacaaaaacagacaaacaaaaacagtaaagtcttctttgattccctacgctccttttcattgttctccggagaaataacctctgaaatgatttggtatacattgtttccattttttagcatttacatatccatgttcctacattataattaaagtatccataaatcatactgagtatgaaaaagagaagaagggaattacatttaaattgtgtaatgcaaaaagtattggtggaattaagaagttttggaaattttgcataagatgaattggttctttattaaagatgttaagaataaagacataattagtgtgaacatttttataaaaggaggagcctatttaaaataattaatggaaatgattccatgtgatttgatatactttgatgaatgtcataaattaattaaagtggcttccagagagatctcccttaaaaattcattttaaattgaactttatactgtcactcactgcctataatatgtttgagtcatttatactcaaactttaatacaatccttgagtatggcaagaatttatgttgtaatgggttaaatttatcttgagaaatatttgttgaaaataagtatatggaaggaaggggttaggcatttagaagataaataaatatgctttgtactcttctctcctgaatctcataagccggttgttgatggctgttgtgaaaccttggttcttttctttaaacaagagacacacagcagaggagatgcagcatcgagtaatttattgcaaaagaaaaagaatattttgcaagttaagtgaggaatagacacttataccctgacagaattcagggtgggcttactagtaaggatgagacagcgtaaattggcactaggaagactccctttgtgggagttgtacatgatttttcataagtgggtgggaagaagtgttactagtaagcatattctaggttgtcctctgagtgaacatgtgcagtagctgtacatgcttgttcatatatcgcatgtctcataagtatctgaaatctccacccaggggtgtgtgttttactattataatgagcaaagggtcagtctgaggacaaggaaaatcaaaatgtgcatgctccccacgctacctgacttcaaactatactacaaagctacagtaaccaaaacagcatggtactggtaccaaaaaagagatataggccaatggaacagaacagagccctcagaaataatgccgcatatctacaaccatctgatctttgacaaacctgacaaaaacaagaaatggggaaacgattccctatttaataaatggtgctgggaaaactggctagccatatgtagaaagctgaaactggatcccttccttacaccttatacaaaaataaattcaagatggtttaaagacttaaatgttagacctaaaaccataaaaaccctagaagaaaacctaagcaatactattcaggacataggcataggcaaggccttcatgtctaaaacaccaaaagcagtggcaacaaaagccaaaattgacaaatgggatctaattaaactaaagagcttctgcacagcaaaagaaactaccatcagagtgaacaggcaacctacagaatgggagaaaatttttgcaatctactcatctgacaaagggctaatatctagaatctacaatgaactccaacaaatttacaagaaagaaaaaacaaccccatcaaaaagtgggcaaaggatatgagcagacacttctcaaaagaagacatttatgcagccaacaggcacatgaaaaaatcctcatcatcattggccatcagagaaatgcaaatcaaaaccacaatgatataccatctcacaccagttagaatggcgatcattaaaaagtcaggaaacaacagatgctggagaggatgtggagaaataggaacacttttacactgttggtgggactgtaaactagttcaaccattgtggaagacagtgtggcgattcctcagggatctagaactagaaataccatttgacccagccatcctgttagtgggtatatacccaaaggattataaatcatgctgctataaagacacttgcacacctatgtttattgtggcactattcacaatagcaaagacttggaaccaacccaaatgtccaacaatgatagactggattaagaaaatgtggcacatatacaccatggaatactaagcagccataaaaaatgatgagttcatgtcctttgtagggacatggatggtactcagcaaagtatgccaaggacaaaaaaccaaacaccatatgttctcactcataagtgggaattgaacaatgagaacacatggacacaggaaggggaacatcacactctggggcctgttgtggggtggggggaggggggatagcatttggagatatacctaatgttaaatgacaagttactgggtgtagcacaccaacatggcacatgtatacatatgtaactaacctgcacgttgtgcacatctaccctaaaacttaaagtataattaaaaaaaaatgtgcatgctccatacaggggcaattccctactggagatagctttgcttaaatgagctggactacaatgcaaatgctgaaacttactatattgacagtaagattgccacagttgccgcgtcctgaggacatggttacttccttttaatacctatcctgtctcattgtgagaggattaacaactgtgcataaaaccagttgttctacatgagcacttaggagggataccagcattgtgaacatagtttaagtacgtagaggagggaacagttaagtttattcatggtgagtgttggtgaaaagtggaagaggtaccaaaacagccgtatagataactggttccagttagccaacattctctaaagttattagagaagcctaagtgaggtgtaacctcagcagtcgggagccaagagagcaagtaagtgctgtgatgtggagaaaatcactttgttccaactgagaagaaatggttgagcactgcttttcccccatgccagtactgacgcacagcctttcacttagcactgattatcgataggggtggggagttaaggtatggggaaacacaagtaacaatattttatttcaaaaacctctccactgtaattcccctaatccttcatcatggttgaggaaaatggctctaaaaaatgagagcaattactgtagctccaaaattctgtgattgcatgtcttactctgaatagcaattacaaagcatcagaggatttaggtccaaatattgcagacacaagaaaatgaattacattttaatacatctaaacttggagagcagagttccaaataaggtagaacttgagattcaactctgatttataaagcagagactaagaagagtatttataaagcgaatccatgtttggatacataaaagtgcaataaaattcaagctgaagttaaaatctctgtctagaacagcgatgttccatttatgcctgatccttttagcttttccacagatgaagactttgtcacctgttccagagagatatatttgttcattattgtttccagagagcaaaatggaaaataaactctgcacattttggccgcatctgtgttttatatgcggtgacactcctgttctcttcagtgaggaaatccagtaaagtaaaaccagtcttctgatgaaatgggcacaaatcaaagaacttgtgagcttcacaaaaaccttgaagcaaaatataccaagcttaaatattgaatgtattgatttcagtagtcaaaaacagagctcatctgcaaaagcaacaacaacaatgacaacaacaaattacatataagtaaaatttaaaaaaggtttacaggatgaatatacagaaaactatgaagcttaggggtagagaggagtagttgaatatatgaaaagatacatcttttttgatgaaggactaaatttttaaaaatgaaaattgatctatgtttatgaaccattagtaaaaataacaatagtattttctggaactaagtaagctagtgtaaaatttgtatgaaaaaattaatacatatgagtaatcaggagaattttaaaaaagagtgttgattcatatggcctaactccaaaagataatcaaatgtattatacaattttagtaattataatggtgtgatactggcactaggggagagagatcagtgccacagaagggtggctcaggaaatagactcaaataaaaatttgtaatgttatgatattcctcgactgcgggaggaaaatagattactcagttacttgtgttggaacaactaactcttcagccatttgggaaaagcaaagaaagctgaatatttatcttactccttttgccaaaacaaattacagatggatgagatttaaagtctataatgaaattggtatatgtacatattaaaagtttcaactataattgttattaacgtaaatgacaacggaacaccttgttggagggaaatttggtaatatctatcaaaattaaaatgccatgttttctgatcagcaatttcattctaagaatttttaatgtagatatacttgctcatgtacataaagattattagacatgaatgttcactgtggcatgattcgtaattaaaaatgtggcaacaaactaaatgcttacatggtaatcattcatgctgtttgccagatatttttatttctccaccttgtggtgattctggcatagtatttagtagttaggttgaagcatgtgactaattttggtcagggagttgtaaatggagggaatagctggtgagacatcttgcggaatactgtctcaggtaccatcgtacctgcagtgtttgagatagtagttgctccatcagtagaggtccctgagggactacaacaagcagagtcccctcctgacctgcaacacatatgtagcatgagcaataatggaacttattatttttgcaccctataaaattttgagaattgttactgcagcttaatttaatctttcctgacaatacaatacctatcaatagagactaatcagataaattataccatttccaaattgtatcatcctgcataaatattaaaaaacaatgaggtgagattcctaatgtgctgctatggaaaaatcttcaattttctatgtgtacgaatgtatttcccaggtattcgttttttccttcctgtatgttgacacattatgcacacttttggatgaaattaatatatttccaccgctttatgtcctctccctcacttttatcacccaattgtagcaaagtatatgtttgcttttatagctttagctatataaaattttctaatagctaagtttgtggttcctggaattaagatatctgaatttaaatctaacactactacctacagactatgcaccctggacaagtacttaatgtcttggttttgttatgtataaaatggagataataactgatttttcacttagagttgttgaatattttataagataattcatgaaaaagtgtcagtataatgcttggcacatagtatgcgctcaataaatgttaatgttattactattagatttaaaagtatcttttgacccctggctatagaagatgaggaaatcagagtatttgcacttctaatatctcctgttttcccacctacttttgttcaataaattaactccacattggcagggtagataatatttatattcagctttctaattatgctttctaagtttgtgtttatcttactcctaccgttatttggaagcagtcttcatctcaagtccttttgttactgttttttcactcatcttttagttgtctgaatttctttagaaaagtttaattccctgaatatttaatgtttatattttgttgttgtttttgcctttatatttggactcctaaaaaaagttttgttggttgtaaaatattgtttttttttccttgaagtgtttgtaggcatttcactgtgttctagtactgaatgttttagtggagaagtctgaggccagcttcatttgtttcttggatatttttgcccagtgctgaaaggattttttctcttgaaatccatccactttattagggtatatctcaatgttagtcctgggatatggtatcctcattctagctatacattcaacttttttcctggaaagttttcttgagttgcatctttatatacatatacatacacgaatacatatacatggtaaagatattaaggataaagataggtgctttataaataccaatttgatataattttggcatgaaaaaaagcctgtggtgcattctgagtttggaagtagaactggatatacttacttattactattgtttttaatacaaaaatggagacagggtctcactatgttgcccaggctggtctcaaactccttgactcaagcaatcctgcctcgacctcccaaagtgctgagattacaaatgtgagccaccgtgaccagcctaaatatctaaatttttctctttcattattttagctctcttctttggggctatcagtcatatgatgttggatctcttttgccttaatcttctaatttttcaaagactaatccagagaccactatctatcaccatgccattactcatagacaagggacatcattccacacatttagcttatttgtcaaaatcagagatgggatttataaaagaaaaagaataaagggagaaaacaaaacacaaattatctgggaatgcgagtctgttttcctttctttggctaatctacttacctagtagctaggaaagaggccagcatgagtatttttccattgagctggctagctcagtcattggagaaaccatttcaatatttatggattctctgaaaaaaacttggagagtaaaaaagcataggtggtaggatgctgccatccttctgttggcatctccagagtttcacttgaaaaacacctcctaagtagacactgataaattgattttaatccctatttgagcaccaatgcaatacattactatttcaagatggagcattagataactaaaggaaattctattgtgggcttgtaaatatcatgatagtcatacctatgtaatacatatatgtatatataaatattaatttttaaacatttacttagctattaaaaatcaaatgctcatatttaaaattattggtttattaatgcaccatcacatgttatcatgtgatactctgaattctctttttgcatagacaaatcagagattacctgctgcaagtcattagtcatcattaacctgtactgaaatggttagagcctaggggagttccaggtaaaaggaccagtaatgagtagaagcttgttagatgtagagatattgaggacagagataggtgctttataaatatcaatttgatataattttagcataaaaataagcctatgatgctctttgagcttgggagtagaagtggatatgtaattttcagggcgtagtataaaatggaaatgcacactccttgtttgaaaattattaacgattttacaagggtgacaacagagcattgaagcaagtgctctgtgagcatgaagccctgtgtgaaatacacacctgtgaagctggccttgcctgccaaacaggaatgctggtactgttaatcaaacagaaagttcagaatgacaatctgacttttttttgtagaagatactaaacttttggccttgaatatctgaatttaagatactggtatcaagccaaaagaaatttgggcttagaacttgaaagatttaaacttgtgctttgacttgtgtgctcacagctctctgtgtcacaatttttttcatctgtacttcgggacaacaatagtgtgtcgacatcacaaaggttttgggaggattaagtaggtgaatacatatgaagttcttaaaagaatgtctggcactgagtgagtgctacctcggttttggcatcgttattgtggtcattgctattgttattatgacttgaagtcatattagtgtatgaaatcccatccatgaatagaagacagaaagaactttgggcagggtttggaggtaaaagaagacattgtaaaggagatgggtaaaggaatgattttaaagactgagaataattaggggagtacgatgtcatggaaattaagggatgataagcaccaattaagttgttattggacttttttctttgaatggttcaaattcagaataataaggaaagaagtctgattatacgaaattaaagggtagggtgactgtggaggtagtgggagttgacttttctgctaataagtttagaaataaaggaaaaatggtagcttgaggaaagagaggagcgattaagggaaagtctctcgttaactcttgtttttcatctctgaggacagcgcttagcccaaggcctgacctgtgatcattactctctcaaggtttattccatggacagagctatctcatttcatgcttataacaaccctacattattagaattgttttagagatgaggaagctgagacacacaccaaaccagccttccaatttcactttgcacaactttgaatttctttatatttcttgaataaaagttccactttttaacttaccacttcttagcagtcattgtctaactgagtaattgttacttcattcatttaatggttctcagattcgcataatttgaacctaaatttaattggcctccaagctgatgtgcttacagaaacagtgacaggaaacaaaaatgtcaagggagactatgtattattaagatgataaatgaaatgatgtccaagctgagcaattaaagtgtgaagtagaaggacacagggtgagaaactgatgcttctcctcagcctctataaaaaagatactgaataaagataattgagaggcattaggggactagactgagaaaggattggaaatctgttcactgagagtacagaaatgaggaagcttggaaggcagaagattttggtcaaagacgtctggcttgaagctatttcagctctttggattatctgtggtggaggccatcacgtctttggagtggaggtaccatgaaactagtgtctgcaaaacatcatctaaatgaaagcaaaattcctgagaaggatggcactataatttttaaaagaaaagctatgagttaagcattcatatcaaggtagatgtttggagtgtattgcttgtgtgtgaaaaggcagagatgaccagaataagagttagaggtatgctgcgttttcttcttggttgatgagtaggatggcctggacaaagaagtgacctctagtaaaataccttcatagtgtcaaatcatctggaggaaattcagattaaagaggttggatgatgtcgtaattaagatcctgggcttttaaggtggacacatttatattcaagtcccaggcccaatgcatattagctctgttacttgagcttttatttctgcatctttaaagtttggcaaacctattacatgaagctgttgaggggataaatgaaataacgcatgcaaagcacttgcagtaaagactaattatcaatattttatttgttaagaggcagcattgcgttttactggtcaagtatgtagactctggggtgaaacatatttggtttggtttcatctctgcaatttatagtttgtgtagactttgagaatagttctcaatcattctaaccctcagtgaattcatcttctaatgggagtgatatcagtatggatttcatgagattatgaaaagaaaatgcctacaaagtatttattacaatgcctggcacagaacaagctctccttaattgtaaaaatgctaactcttattcttcataataaataaaagtaattaatgttatagaaaacaaaatcaaggatactgatttatatttggattacttgatttatattttgtcagtctataactggtcttaactaaggtaagtattaagatctcatttttaacagcgagtattcttttgattttagttcattggaaatcctgggattcagaaatgtggattaaaagtaatttcttctattgtacattttcctgatgcattagagatgttatccctggaaggtgctatggattcagtgcttcacacactgcagatgtatccagatgaccaaggtcagtacaatttgaattcaggatttagaatagatttttgtagggcattagctggtgactggatgtctttaaatatttttcttcagttttgagatttaaaacaattctttttttttattttcctagaaattcagtgtctgggtttaagtcttataggatacttgattacaaagaagaatgtgttcataggaactggacatctgctggcaaaaattctggtttccagcttataccgatttaaggatgttgctgaaatacagactaaagtatgtgcattatcttggaaagaatttgggaacttgtgcgaatttcacttttggagcagtttgtgtaattcccactttgcatgaatggggtattctagttaatggaaaaccatttatccttttgtagtattttaattatacaagcaaagaaaattggattgaatctctaaagatccagtgtttcattatgaaatctctaaagtcagcatggttattcaccatttatcttgcccataaaagttcagagaatgtgctaagaaatcccagctagctgagtttattcgcttagattttagataaatagaatttataaatattccaaagtttgtcactctctgggttttattgcaggttgcttacctttagtaattttgcttgttgatttttttccttgcagtgaaaaaatgtttttaacatttttcatcaagcaaaatttaaaacatgatatataataactgtctttgtaaggaattcaagatactggcctagagttagttcacgggagattaagaataaatttgttttgttttgttttttaattgtagcaaaacaaatagtttttcttcaagagtttctgccttggttgtggagtttgcaactttcataaactacaaaggaattttttttttttttttggagacagggtctcactctgtcacccaggctggagtgtagtggcagatttcagctcactacaacagctgcttcccgagctcaagtgattctcttgcctcagcctcctgagtagctcagactacaggcatgcactcccatgcctggctaatttttgtattttttgtagagatgaggtttcaccatatttcccaggctggtctcaaactccctggtctcaagcaatctgtcctgctcagcctcccaaagtgctgggattacaggtgtgagccaaggtgcccagctgactcaggaaatattttttgtaactggcagcattgaccaggaataaaaatacctggtctctaatctttgcacagacattatcagtaaatgagagaatatgtgtaaagttttttaaaaaattataaagttatgaacatacaaaattcttagattaataacaacaatgtgttttataactgcttttcataatgtgcctcaggctaggctgattaaaccaagataggattgattaaaagtaatcttagggaaagggaaggattttgtgccggtatggaactctcagttactctggattaattcatctaggcataaattttagaatctctatagtagagtttatgaactaaatctggcctgccaacatattttatttgtccagttcagggttttgctttgttttttgagacagagtctcactctgttgcccaggctgtagtgcagtggcgcagtctcagctcacatcaccctccgcctcctgggttcaagcaattctcctgcctcagcctccctagtagctaggactacaagtatgcaccaccatgctcagctaatgtttgtatttttagctgagatggggtttcgccgtgttggccaggctggtctcaaactcctgacctcaagtgattcactcacctcggactcccaaagtgttgggattacaggcatgagccactgcacccggccttcagttcagtgtttaaaagtttttaattcgaatgacgtactttctgcacatttgcatggcctgctctgctgtagcattcacttgttttcagagacctctgctctagaggcaggtggatcacctgtccctcagacatacataaattaaggctactttgcttatcaaatattagtattcgtagatactcagcatcataagagttcgaagtaataattttaatatttagatgacgtaagttaatttaaaatttttttgagatggggtctcactctatggcccaggctagagtgcagtggcacaatctcggttcactgcaacctctgcctcctgggcccatcctcctgggtgggctcaagtgatccacctcagcctcctgagtagctgggactacaggtgcatgcacgggtaattttaaaatattttttataggcacaagattttgccatattgtgcaggctggtcttgaattcctgggctcaagcaatcccacagtgctgagattacaggtgtgagccatggtgtctagccaattttattaatatgtaatattagaggtaataaaacattaaaaagttaagatgatccttggtggctttacccaacctaaataatactaaagtcaaaagcccaatctttcattaaaacatcacatgagtgaagaggacagactctggggatgtgcttaaggtggttctaaaaaagtaacggtgttctttataaataacttattattagaatgtaatcctcagagtgccctcagcgcttctcaactacactcaacataaatgaaatctaggagtccacactagcctttctgagataaacatttcggaagacagcgcaaaaagctgggggatatgctaggctctctagagaacctactgttcaatattataatacaaatttttactctattgacctgtttggatgtgtagttctgctgatccaaccgctttaatcctgtttaatatctgggtttcatcctataactatggctttagacaagcatctttgaaaaccaaatttgagggtattagttctttttcctgctttgctactgaatggtttgttaactagcattttattctctgtgcctgctatatttcttagtcatgagagagagagggagtatttatttacaggataaatactttaaagcaccaacccaatatatctatagttaaatgaacatcctaggtattgtttcatatacaaactctctctgctttatactgtttattcattttgcctgtaattgcttattttattattttttttcttatacttttagggatttcagacaatcttagcaatcctcaaattgtcagcatctttttctaagctgctggtgcatcattcatttgacttagtaatattccatcaaatgtcttccaatatcatggaacaaaaggatcaacaggtacagtgtttttcacttgcatcctaaatgttatgtatttatctgactctaattctcatttccactctttttagtttctaaacctctgttgcaagtgttttgcaaaagtagctatggatgattacttaaaaaatgtgatgctagagagagcgtgtgatcagaataacagcatcatggttgaatgcttgcttctattgggagcagatgccaatcaagcaaaggagggatcttctttaatttgtcaggtaaatattcaaggcctcacttttgtctttgctcagtattcttatagaatgtaagagccctgccattgtgtatctcttacttatatcatattattcttcactacagaaatttaccagtttattgcaattgtttgtgtcttgtagtagatttatagaattccagaagtaatagggtcctttaggtgttatccagtctaatctttcatttcatctgtttacttatcttgttaagttgataaataacttttcaaatgtgtcccttagtaggcatctctacaacttagtctccagatacactccacataacacatagttctaatgttttgataattttttaaccatttttttccatggttttagtttctttgcctagaaagttctcccctgagggctaccacacatggctatgcaggctgtggatggcacacttttgtcggtgccattcacagtgacatgagttgctgttggccaaagttgtgtaacactggtctttctttccttctctcttccctcctgaaccatgtaaacatatatctatctgattgttctgctctcccttcaaaatataattcaaattatctttctttaaagccctccccatacctccaaacctccaaacaaaattaagatttacttcttttgtcagtctatgaaaatatatacatatctcttgtatacttggtgagttgtgtgaaaataacagtgtacagtgttcatctttgtatcattcagaatatcgagctcattgctttacatatggtgtgtattcaataaatactaggttcattgcttatatttcagatttgtattatttgtataagtgttagagtttatactagcattcaggtagcactatgtctattttctagaaatttaatatttctaacaaagcaattatgtagtgatttaatacacattattaaataatcaataaagtactatgtttgccaatagtttactttttaaaccttactgtatttaatatccctactgtatttaatatcccacttgcctatggattgaaatcaatttgttgactgttaagattaagttaatactaattagtaatcaacataaaaagaaaaagaatttgtaacccattttcatgcattacgtttatgaattaaaatcacataaacaatctaattatttaaatttagtcaaatttcttttaagcaagcaacaattaaaatagttgctccgctttactaaagataattaaatttttccatcaataatttaatacatttttactgtgcatcttttgcatgcagattattgcattaattttaattgaaaataccgaagaactaaaaagaaacttccccttctaagtccacattaaggaaacaacatacctaaaagcacctgatacaactgtactacattccccacaggaaatcatttctactattctttcaatttatccaaatctttctacccaacaggatttttactttattcctctttccatattcttttggacttcatatgcttagttttatcttttctttttaaaacgaaatcttaaatccaaggattatgtattaggtttaaagaatttatcccagttgtcagaggttatttatatctagcaaacaataactgctgattaaatcttgtggatgagtttgtcgtatgtaccttatttgtgccagagcaaaataaggtaatcaggactatttattcatttaccaagaggttacatattgaaggactatctagagcaagggtggagttgtgttagactttctgcagagaatttgataatggaatgtacatgattggtagagaagaatatggaagtttaatactgggtatgcaaatgcatggataaaaacctcaaggtaaaactcatcaaatcacagtggaaaaagtatagtgaagtctgaataaaaataataagaggctgggcatggtggctcacatctgtaatcccaacactttgggatgttgaggtgggaggatcacttgagccaggagttcgagaccaacttgagaaacatagtgagactccatttctacaaaacaaaccaacaagcaaaaaaccatgtatgatggcacacacatgtagtcctagcttcatgcagggtggctcatgcctgtaatcccagggctttgggaagtcaaggcgggaggatcatttgagcccaggagttcaagaccagcctgggcaacatagttagacccccatgtctacaaaaagtcaaaaaattagctgggtatggtggtacctgcttatagtcccagctacttgggagtctgaggtgggaggatgacttgagcctgggaggttgaggctgcagttagctgagattgcaccattgcactccagcctaggcaacagagccagaccctgttaaaataaaataaaataaaataaaataaaataaaataaaataatataataaggctgaggtgggaggatcacttgagcctaggaggtcaaggctgcaggagctaagattgtgccactgtacagcagccttggtgacagagggagactctgtctcaaaaccaaccggtcgggtgcggtggctcacgcctgtaatcccagcactttgggaggccgaggtgggtggatcatgaggtcaggagatcgagaccatcctggctaacccggtgaaaccttgtttctactaaaaaaatacaaaaaattagccaggcgtggtggcaggtgcctgtagtcccagctacttgggaggctgaggcaggagaatggcgtgaacctggaaggcggagcttgcagtgagcctagatcgcgccactgcactgcagcctgggcgacagagtgagactccgtctcaaaaaaaaaaaaaacaaaaaacgaaccaaccaaccaaccaacaaaacaaacaaacaaaaaaccaacaaaaccaaacacttctatcatgctcattaccacctgggcactgctccaaatactttacacaatttaatccttacgacaacctacgaaaaggtccagtaggttctaatgttattcccattgtgcaagtgagaagctgaggcactgagggtttaaataacttgcctaagaacaagctcctggtaacagtgtgaaatctgcctccacagtgcctgctttaatttcttggctacacagcagattcatggtagtggtggtagtggtgttcattttctctaaaataacagtttgaataatttggttttgataatgcactgcatttattataaattagatgatcagagaaagattgcagggataagaaattatgcttttgataatctttagttatattcttaattttcttcattattatttaaatgtaaaaataaatatctgtgagcagtagtattttcctgtcatgaagctgaaattactttcataaatatgtgtgaatattctaaagagaatgactctgtaggatttaaagaaattaattcttatttttgctggcatttatttattttatcagattcactttctcatatatgtctctcttcatggcaccatatgcctaaagtcagcttggatagtttggatcctccaaggaaaattccttccacaaacatgtgcagcacacagtgctagataattaatagagaatataaaatgggtttcctgtttcaagatggtttgtaggtctgtatgtgtagggcattgacaagagagtaaaacataaatcaccttagtacaaagtaaggagtgaatggcatatcttagagaaaaaaaagttactgggctataagagaaggcatttgtgagtttttccctccctccccgcttcccttcccttcccttcccttcccttcccttcccttcccttcccttcccttcccttcccttcccttcccttcccttctcttccctcccctccccttctcttccctcccctcccctcccctcccctcccctcccttctcctttctcttccccttccccttcctcttccccttccccttctccttccttccttccttccttcctcttccacctgccttccttttaattttgctatgagcccttaaagaggattttagtaatttgctacttaaattaaatatatttgctagatgttgtgctaggcttcaggaatacaagttggattgcagtaatgtaaagccctttgcattctagcaagaaaacagatgggtatgtatgtttgctcagtgctacattaaatgaaatggatgggagccgggaggagaaatggtgtgtttggcctgagaggttagtagcaaggacttctctgcaagaaagtttgaagccaattcttcaagaatgaacacctttttgctgggtgaaaagtagaggaaggcatttggggtaatagaaatagcataaaaggtaatgaggtttgaaaaattacatgctgtgtttggaagaatgtcctggagcagcagcgttttagaaggtttttaaagacgatggtgacttgatcagagctctgtagtgctttgaggatgggttgaaggtgggcgtacttggagactggtgggcatttaattggtgccttccaaccacataaatgaatgtcccctcaaatcccttggaaacactttaattctagaaaattcaaaaattgtccccaacatctttttcctctgagttggtaccctggatctttgggtcttcttttctttccttttttgatgttttattttgggtaatgaaagtcacacaggttttgaagccagcagatttggcttcaaatccaagtctcagttgcttgctagctgtaagggacaaattatatatcttttctaaatactcatctataaaatgggagtaataattgctatggcataggatttttttaaaaaaaagattagaaatcatgtgtgtacagaatttagcacagtaactgatggatattatttctattacctgttatcttggtcttctagttgatagctccttgctagcgtctagctcctttccatagctcttcctgagtagggccagcatgcagtgccacagcttgctaaggcttctcctggattgctgagttgttctagtttttgtggcacctcacatgctaacccaccctgaacacatgctctgaaaacataacatttagaggaaggttgaagactgagagacaaggtatatctttgaggaaattcagatgcttgtcttgaggagctcaggaaagctagacacgagtaatgactgtcgtttgtgtgtggcattaataaattttacaatagctatgtccccatttagttattctatgtcacaaataaaggcaggacagtagtatttactgtgttaaggtactggtttcccaggtatcttacagtgagaagacagaagctcagaaagtgtaagcaatgtgcatatttggtggagtctggatgtaaacagagatcttgatgccaagcctgtggagctttgtctccatataatgttgtctctttcataataactgactgtcatgtggcagattattcatgctattctgacattgatggcattaatatcatcttattttcccaatctattcaaggatcagttttgccttattttattttgtttcattccaaattggagatgtagagaaaaatcacatgaagtttgatttgccagtctcctaaaaggaagaaaaatgtagatttttaatatacttaattttttttctttaataggtatgtgagaaagagagcagtcccaaattggtggaactcttactgaatagtggatctcgtgaacaagatgtacgaaaagcgttgacgataagcattgggaaaggtgacagccagatcatcagcttgctcttaaggaggctggccctggatgtggccaacaatagcatttgccttggaggattttgtataggaaaagttgaaccttcttggcttggtcctttatttccagataagacttctaatttaaggaaacaaacaagtaagtaacaaggagaatattttttacaattcttatttttaatagtatttttttaagtcactagtcttttagtggttattcatgccagtttgagggaccttaagccaaagatattgcaaaggtttggattttttttttttttggctatgaaatacttcaaaatgacatttaagttctttatgagatagcaaatagttatttataaaaatagagcaaaatagtggaagctttttgaaggggtactttttaatatatattttttattattaaagtaagatatccctgtttttaaaggaaatataaaattataaaaaagaaaataaaaataacttattttatctcttataagtaattaatatggatatttttcctaactttttatatgcttacatgtacctatgcattcaaatgtatgtaaaagcatacacacatatttatttggcatttttaacttagaatatactttatatttcaattgataatgcattttctttatactttcaagctcatgtgtattttgtacatattatgtgtattgatggtaagttaccatcttctgacactatttttatcttttgagctctctcatttgttcacactaaatgtgtttttagcgtgaaagctcccagctttccctgtgttaacttagtcccatgcccatctccttccccatggtcatcaaactccatgaatcaacaccttaaggaccatcttgcaagtaacatgtttgcttctctcatttttatgatgcactcactagcaaaacaccagttttggtcagtctaccagtctactttttccctcagtttcaccaagaaaactgagtgctgctagagaaaagtacccatccatgcaatttggtgcctttatacatcaaggtttccaaccgctcagtaggctccaaaagttccaatcaggctgaattttcctcggtttctcaaacacttcgtgtacccttacttccagtctttttccagtgttactctctctctacctagctctaaattctctcttcacctggctgtctcttcattcttcctgtctcagtgctatcaccagtctggaaggttctcttacatgaccctatagcactttatttctcacatatactaccattcaccacattatataatttaatttttcatttttataatctactttttggtaaattgttagtaccatgaagtcaatgtcaattttgttcatggttgtaaccttaccattgatactagtgttttgcacatagtagattatcatttagaattaagtattcaatattggcaaaaaataaaaattgtgtaatacattatgttgataagcatgtgtggaaacatgcttcatatattgatatgaatttaaattgtcctcttttgaggacaatttggcaatatctactaatatttttaatatatgtacatacttttttgacctcacaatgtactgttaggaatctatgatacagacattctcaatgtgcacaaaaattatgtacaaaaatgcacattaaaacattgtttataatagcaaaagagtaggaaaaaaacctaagtattccccaaaaggaactattcaaataaataatggtacatacatgttgtggaatgctttgcaatcattgaggaaaaaaaaacgtggagcaaatttaatgtcctgataaagattacattactccgtggcaaaaaaaagggcacagacagtgtttttactatgctaatgttgatgaaaatgcaactggaatatgatagttataaaagtttgaatatgaaataaaaccctccagaaatgggttccctggttgtctctgggtctttggaaattactgagacatggttagatcccatgtttcattacttaaactagtcttatgccaaaaacctgcttactttaatcttcaatatccgatggagaggaattgtgggcccattggagagggacagagggagatttatcattcactatattctctttgttctgtctggagtttttaccattgacacatcttacccagttaaaaaaacatagaattgtcatttgattaattggagggtataaccatgatttcactggcagctggtctgagtaaagaacactttgggtcatagctttcaaacatttttcaggtagtatttgcctaagtgacatatttgtgtgtgagctcatcctaccgggcttcgggataatttcccatatcataacatattactctggaaaaaggaaccatttgggtatatgggtatagtgtaagccatagtatcagttgccttcttggggtttatcatatgggtccaccacatatttacagtaggaatagatgtagatacatgagcatacttcactctgctactataattattgctattcctactgttgtcaaagtcttttagctgattatctacacttcacaggggtaatatcaaatgatcccccaccatgctctgagccccagggtttattttcctttttacagtaggaggcctaaccagcattgtattagccaactcatcactggatattgtactacatgatacagcagtatcatgtagtaatatttgaagtcattacagtagtaatatttgaagaaatcttcctggctgtatgtagaacaatgaggactcagccaacttattcttcatagtagagctaatacataatgtaatgaagttgtgagaagaatgttaactttgaaattccatcaggtttcccaatagtcataatgaatcactcagcaaactttataaaaataacaagatcctttatttagcagtttatgtgttctatgcattgtgctaaacattttatatgcatcatttcaattactctttttcatcaccatatactgtatttattatcatcttcattttccaggtgaggacactgatacccagggagctcatataactcacaaatggcatttctatgacttgaacacaggcctgtctggcttcaaagcctaggccttttcctgaataaagttagttccatagagattcagttttgctgtctacatgaaagcattgtgtacatggttatgtttttttaaaaaatatatgatctgccacctgttaattattcaggatcactagtgtaaggtgactttgaaaggaaaaatagaaatattctccagaagcatagcaatacgtaagaactttggtcctatgtatgtttatttttgcataattgttgatttctaagttgctggtgtatctcttattttcagatatagcatctacactagcaagaatggtgatcagatatcagatgaaaagtgctgtggaagaaggaacagcctcaggcagcgatggaaatttttctgaagatgtgctgtctaaatttgatgaatggacctttattcctgactcttctatggacagtgtgtttgctcaaagtgatgacctggatagtgaaggtatttattataaaaaaaaaccctttatgctttatatttacacactgacattgaacaataggacccaagacaaaaacctgacctaaatcatctggaaaaacttgagtagaaatgtgtttattatcgcaaacagttaagtttactaattttggttaaagtgatgggtcaaggaagtgtgtctctgtgcttctaaatgttatactaattggttaatggttaatattccaggaaacaaactctgactagactggaacgagattccacgctctgtcattgactagatcctttcgtggcttgtgtaagccccttaaccttgttaaaggtagtaatgtcgactttgcagggttatacataataattagaaaaaatgtatgtaaaatgtctgcaacaatgcttggcaaacaggaagcgcttaataaaaaaggtttttatctttactatagcttaaaacaatattaatattttaatagctcacttgagataactttttaaaaaattaatatggtgaaatatataatgacaatgattagggctgatgtatttagcattagcagtttggtaaaaatggagtgaggggctttcttattaatatagtatgattgaaaacactgggtgatagaataaggatatttgagagggcaaaaaatgagagttgttccaaaatattgtgtctcaagtcaaaccatttttaaaaatcaagtgtagtgatttatatacatatataatttatataaaataaaatgcattcactttaagtatatattttcatgcgctttgaaaattaacatattcatgtggtcattgtcgctattaagttatgcaatattttcattatccaaaaaagtttcttcatgcctcttcactgaaaacatccccttcccctggcccccctgacccttagcaatcatttgcttcctgacaatgtagattaatgttttctctagttttatatacataggatcatacagtgagtactcttttgtgtctgttttccaaaatgattgtactatgttctacccccaccagcagtacatgagcattctggttgctctacatccttgtcagtacttggtattttcaagttacttttagctgttctagtggaggtttaattcatttagatgtaattttcatttccctgatgactaattatgtagaggatgttttcatgttcttattggccattcttatttttgtgtgaagtgttgaagtattttgcttttaattgggttgtcttattatataagagttctttgtatattctagatagaagttgtgacaggtatatgtattgcatatttttttcccagtcatagcttgtcttttcattttactaattctatttttaacaaaacagaggttttaaatcttggtgaaatgcagttttccagtttttttcttttatggtttgtgctttttgtatcccacttaagaaaccttttcttagcctaaatttgtgaatattttctcccatattttctcttagaagtgttaaaatctcagctttggcatttaggtctaaaacattttaagttgatttttgtgtgtggtgtgtcaatgaagagttgacatttatttctttctgtatggatatccagttgttccaacattacttgttgaaaatattatataattcctcattgaattaatggaagctttgttctctttaattgactatttaggtatggttctattttagcattatttattctgtgccactgatttataccttattcttatgccaataccacactgtcttgattactctagcttaatagcagttcttgaaatcagatagtgtaagtcctctggtgttcttttaaaaaaaattgttcttattattctaggttctttgcatttccatataaatttttaatcaactaactttatgctgggatttttattgtaattaagtccatatttagattttatatagaatttatttataaattaaatcatattacctatgattttaatgtaatctataatatataattaatacataaataataatttatatagattatatctataaattaatttgagggaactaatatattaataatgagtcttttgacatattaatgtgatatatagttcaattagtcttttaaaatttctaacagtgtgttgtattggatgttttctgatactattatagatggtattgtatttgaattctaatttccagtagttcactgttgatatatagaaacataattcatttatttgtacatgaattttgtatcctgtaaacttactaagctcacttacgtgttccagtaccttattatagattctacaggattttctttgttcacaattataccatttggtaataaagacagatttgctttttcttttctaatatttatgtcttctttttttttcttgtcctattgcactggctaggacctccagtactatgttgaatagaattggtcagactgggcatcattccctggtttccaaacttagaggaaaaacatacagtctctaatcactaattatgacattatctgtagtttttcatagatgcccttcatcaaattgaagaagcttcttcctagtcatttttggagagcctttttttatcattaataggtgttgaaaaatgctcttcagcatctgctgaggtattcatatttttcacctttattttgttaatatggtcaaatacactgactgattttctaatgttaaaccaacttgcattcctggagtaaatctcacttggttatggtacattatcctttttatatagtattaaattttgttttctaaattttgttaagaattttgcatctgtgagagatattagtctgtagttttatacttccttgtaattatgggagtaatgctggcctcttgaaatgaattgggaagtgtttcccattccacaattttctggaagaatttgtgtaaaggtattttcttcttaaatgtctgatagacttcaccagcaaaggccatctaggttttaaatttttgtgaggaggagatttagaattatgaatttaataactttgatagatgtatgattattttaattttcttttacttcttaagtcagttttagtaatgtgtaactttcaaggaatatgcccatttcatataagttgccaaatttatttgtttaatgttacttatagcaattatttaattatcctgttagtgatttaattatcctgttaatctcttcaaagaatcagatttttgttatattgattttctctattgtttgtgttactttctcacggacttttgttcttatctttattgttcccttttccttacttatttttattttaattgactctttttatagattcttaatttggaagcttagaacactggtttttagaaccttcttattttgtaacagaaacatttatttaaggctgtatatgtccttataaatatcactttcactgcatcccaatattttgatgtgtcctctttctattcatttaaaaaaatttaatttcccaaatgtccaacaatgatagactggattaagaaaatgtggcacatgtacaccatggaatactatgcagccataaaaaatgatgagttcatgtcctttgtagggacatggatgaagctggaaaccatcgttctcagcaaactattgcaaggacaaaaaaccaaacaccgcatgttctcactcataggtgggaattgaacaatgagaacacttggacacaggaaggggaacatcacacaccagggcctgttgtggggtggggggaagggggagggatagcattaggagatacacctaatgtaaatgaggagttaatgggtgcagcacaccagcatggcacatgtatacatatgtaacaaacctgcatgttgtgcatgtgtaccctagaacttaaagtataataaaatatatatatatatatataaatttaatttcctttgtgacttctttgattcacgagttatttagaaggctgtcatttattttccaaatatttggagattttctggataactttctggttattggtttcagtttgacttttttgtgctcagataacctactctgatgatttctatccttttatatttattgaaacatgctttatggattatcatatggtctgtcttggtgatgtgccatgtgcaactgaaaagaaagtatattcagctgttattgggtcaaatcaataggccaaattgtttggtaggatttctcaagttttctgtgacttcactgacttttctttctatttattgtatttgatagagaaatattgaagttgtaattgaggatttgttggttgccttttcagttttatctgtttatgctttgtatattttgaagctctgttgtttgttgtgcaaacattaaggactatataacaaaggactatatataaaaataattttttaaataaagtaaccactttatattaatctaagtttgcagttagtatcattttcttcctctggaagaattcccttttacatttctagcgcagatcttccagaaacccatatgcagattactggagcactttttccataactgccccagaactcccagctatctcagtctccataaatgttgatctctatctcctcatctcaggaaagccatgagactgtttaaatttcttcttatgtatatggcccttaatttgtctctaagcagaaggccagagtgatcatagggctcacataatttgtttcccttctttcgggtattacatagtcctatgctgtctgttgcccagtgtctgtatccagtcatttaatatatttatccagttttcttgttgtttatgtgagtaggttaagttcacatttgttactctatcatgcctgaaagaactctcttcaagtatttttcaagaaaacattagaaattttaacataaaataattataaaatgcactatgctgcttgtacaaataatgtgctaatagacatttcacacacatataaagtgggataattatgataatttaataatctttataattatgtaattgttactaaattataaattatattttattaaaattcttaagcattaaaataatttaaactatagaattaattaaactttagcaatgaaccaggcaggaactgtttatatcaggatttatactgaatattataagggtggtatttggatatacagattttataatttggttttgacataaaatgaattctttctttttctaagataaagagtaggggaatttaaaatcataattaatttttcacaaatgcattcacattatttatctttaatatgatttttttattgatctttgttttcttgtaaatttattattttgaaagtactgccttttccttattttataaaacaattattgccagccaaatttattgtgtttattttaataccattccataaaagaaaccatgaaacatgaaattcaaatagaaatttattaaaaattgctgactgttaaataatttgtgtgattacaacatttaaagcaagatttgaaaaatttataagaaaaattcagggagttaatccactctctttcctatgctgctagaccctattccagcggtctccataaaaaaaattcagagaaacagaaagcagtaacagtgatcagattgcatacaaactttctgcacacacatatatttgttataacttatgtaaccgttgattgatttggctttttcctgctggactatgagctcctctgaggaatagatttattttttttctgcatatcagtatcccgtgcttacccagtgtctagtctgtaacagccattctataaatatttatgggtgaagaaaaatgttgttgaatttttaaagtgaaaaaccaacatggcttatcatctctattttaaagattttacaaagggaatggactgtgaaatttccattaataaaaataggtctaatcttccatgattgaactatgatagaaggatcttatgattgagtaagctttttgtattcaccttcatgttattttatcattttcaaaataggaagtgaaggctcatttcttgtgaaaaagaaatctaattcaattagtgtaggagaattttaccgagatgccgtattacagcgttgctcaccaaatttgcaaagacattccaattccttggtaagttaaattgtgcaattgtgattatgttgtgttttgctgctgacattctcttgataactaaaatttatgccaaagctaggaacaattggtagggatttccctgatgtatgaaaactataattttgagatttttatatatgtaatagatatgaaaacatattagatgtaaattatgctcaattcacatttgtagtcttttgagtatgcagggtatgaattttttggggcacatatatatatatatatatacttacagtacacttcaagatggttttcttctttcttttcagaactccatgtctgaaaagagcccaggctagacctctacctaatggtgtgggttggtcccatgaacactttagctagaaatctgatagtgatttctaagaaaccagacagaagtctgaaggacactgaacaagatggagtagcataatataattcattgttcatctatctatctatcatctatctatctatctatctatctatctatctatctatctatctatcatctatctatcaatcatctatctattttggtgtattgaaagtcatttaattttttagatacctttattattatttcaacctcttgtctgttttggaactatggaaggactatggcatatttgcatgaggagtctgataattctagttgaggaaattgggagccaccttattctcaggttcactttgaaagacctgttctaacctattctccaattttgattatagctgagtactaaaaatatgagggttgttttgtgttaattctagatcttaagatgggtgaaatgaatgactgtagttgaatcggttaaattagctgtcagtctttatatgctctttcgaatttatatataaatttagttataaaaagtagtttggttaatgagaaattatatggatatagctttttcactcaacctttctgtttttcagtttccttatatttaaaacaaaggagaaagagtagatgctttctaaggtcatttgagcactgaactggagttttcttttatcctcataattgggttcttagtttttacttgcctattttttcccataattataaataccattaaccctattaaaatttcatggttccttccttataaaaatgtcctcttctccaataaatgacagcaattttattataaattattttttaataggggcccatttttgatcatgaagatttactgaagcgaaaaagaaaaatattatcttcagatgattcactcagtaagtatttggatgtaatcataagtaaatagatattttgggcagaatgcagtgtttggttgaatttcctccaattattcaaatattcttggtgccagtttcatcttacataatcttcatatatatttacctaatgattccttccataagctatagaaaaatgaaacatacatttaaaaatttacctttcttgaatattatagaacacattagtctttttttttacaagttttctgaaatgtaaataacacctccaccaaggccactcttcatcctctcctccagttttctttctttcttttttttttcacaccacttacaccacctgattaaatgctttttatttactgttcatctctgccactggaatgtaaactccatagtttggttttctactgaatcttcagtgccttgaagaaagcctgattgctaggaggtgctcactaaacttttactacatgaatttaaattatttgcttatatttccattgtttgtttgtttttgacaaaagggtcatcaaaacttcaatcccatatgaggcattcagacagcatttcttctctggcttctgagagagaatatattacatcactagacctttcagcaaatgaactaagagatattgatgccctaagccagaaatgctgtataagtgttcatttggagcatcttgaaaagctggagcttcaccagaatgcactcacgagctttccacaacagctatgtgaagtaaatttaatttatccttgtaactttcaagacatttgaagagcttttgtatttatatctaatttgcataattaagtcgtttaaaagaacattctacttttgtgtcactgggtgataagtcccccgtgcctctggtttttgcacacatatcttagtctgtgtgatgttcaggagcatctttgagggcaggcaatggaaacagatctgattagaaaggaattccaggttctgtacggagtacatgttaaagtctgtcaagtgtatattgattatactttaatcatttaattcaagtaagacaacttcaacaatttaaattagattaggtaaactagaattagacctggtttggtagtactggctctgactcagctaccaactgtgtgacaatatgaacatgtcactccgcctgctctaatccttcattttctcatctgtgaaatagagattcaactaaatgattactgaaagtttttttttcagtttaaaataatgtgtaacttaaagatttttttctttttggtcaaagttcctgtcttgtaagaattaaagtataacatagtttgttgataggatagctctctgaaaattgactttgctcaccatttgtatgtactacagatcaaaatagttttgaaagccaaagaagatatcataaaagttaaaattattttaatgcaaatgtttaaattgttaaattctcaaggctgggcatggtgactcatgcctataatcccagcactttgggaggctgaggcgggtggatctttttgagttcaggagttcaagaccagcttaagcatcagcaaaatcctgtctctaccaaaaatatgaaaaattagccaggtgtggtggggtgcacctgtggtcccagctacttgggatgctgaggtgggaggattgcctgatcctgggaggcagaggttgcagtgagccaagatcgcaccactgtactctagcctgggcaacagagtgagaccctgtctcaaaaaaaaaaaagtcttgttgcaaatgcatttccccctttttaagcctaaaaaattaatcataattttgagatgttttaaaggcaacattacataaattttaagtatatttaagggatgttttttctctaaagtttttatatctggagacagagagaagaaagaaaggtgacccactcctccagccatgccctaatgtctaaaatgtgtctttctctcttctccacttctttgccttgctaaatacttcaagccacccagggctcaatttaactgtcacttcatcactctctgcttctcttcctttttccttctaccctccagccaacctacccacctagcctccatgtccataacacctgatgctttccacctaattctcattcggtcatccaatttgatttaaaatacctttgcccccactagactgtgaactctttgaggacaggacttgtttcaggcttgtttctgtctattcccagtgcctagtgagatctgacatatggtagaagtttagtacttactgaattgatttgtggaggaataaatgtctgaaacttggtaatccttcaattaatatttgttaaatgagcaagcaaaataattttgggatttagtctagttaaaacaaagagaattggaagagactgtgacaaggtgagacatgccggcattcaatgactggacaagctcagaaccttctcttagggaaatttcaaaatgacaccattagatggcactttgtttgtttgtttgttattgtcaaagggtctcatctatgttccttttataggaacatttcctgattaaaccttgggaataattttaaaatctttacttcagaataagttaatgagggtctgaaacaaaagcaggaattttgaaacaacttctggggctaagagtggttaataagcctctataatgatatcaaactctagagtttctcgtgtggataaatatattgataaataaagaagaccatagagaagtgattgattttggtattttagctctttgagagtattacgtacctaagttttaaaaaattgacataatgtgtaagtaggggtttgctattatcattataaaattagaaattgcttaaaaatagaaagtagaaatttgaaacaaaaagtttcgtaaaaaacaggaggttctaaaatgaaacacattataagtaactatttttatagttaaatcttaaatatatcaaaatatgtaaaatttctgacagcatttaaaacatattcccaggattatattgtactttttgttaaatcattaattcaaatatttgttgaggcgtattctgcttccattttgctctttctggaaataatttacaaaaaagctgaaggaagctttcaactctatttttgtgaacctgctttttacaatctacctgttgtaattttcctggttttacccatgctacaagcagagacgattgggccaattagtatactgaaattctgttgtggattgtgttttcaactttttgaaaattcttgatggttctagttaccagaggtgtgtaaggcagaaatattagctagacttaagttcctcagatggttcactttagaattttaaactattgtcttttcagactctgaagagtttgacacatttggacttgcacagtaataaatttacatcatttccttcttatttgttgaaaatgagttgtattgctaatcttgatgtctctcgaaatgacattggaccctcagtggttttagatcctacagtgaaatgtccaactctgaaacagtttaacctgtcatataaccagctgtcttttgtacctgagaacctcactgatgtggtagagaaactggagcagctcattttagaagggtaagaaagagctcattaaaaataaaagggttgcctaaatatgctgatgttaacaaaatatgctgacatttttatagcaatgagttttaacaacatggtgaaactccatctctactaaaaatacaaaaattagcccagcgtggtggtgcgcaccttataatcccagctactcagaggctgaggcatgagaatcgcttgaacccaggaggcggaggtcgcagtgagccgagatcgtgccattgcactccagcctgggtgacagaggcgagactctgtctcaaagaaatatatatatatatatatataatatatgtattataatatataatacatatattatatatatttattatatataatacctatatattatatatatactatatataatacttattatatatatactatatataatacttattatatatataataaaagaccgaggcaatgaatattacaacttttatcaactgacttacatttttacaactaatttttaaattaatgagtcctctttgatgctgttctttgaaagcaaattgtttttgatattttttctttaaagcatatgaatttatgcaatttaatcattatcttgtctcttgtgactagaaataaaatatcagggatatgctcccccttgagactgaaggaactgaagattttaaaccttagtaagaaccacatttcatccctatcagagaactttcttgaggcttgtcctaaagtggagagtttcagtgccagaatgaattttcttggtaagtgttctgtgtgggtctcctccttaccaggccctctaagttgtacaagatgagtcatatatggaccctttagttgtggatttaaaagtggcatttcagtttaaatattatgctggatttaaaaaataaaattagcaggttggcaataaaacaaaatgctataaaactatgaaaagacatgaaagaaacataaatgcatattggtaagtgaaagaagccaatctgaaaaggctacatactattcgttcccaactataagacattctggaagagacaaaattatgaggacattaaaaagatcaatggttgtcaggggttaggggagggagagatgaatagataaaggacagaggatttttagggcagtgaaactgttttgtatactatagagggggatatgtgccatggtacacttgtcaaaacccatagaatgtgcagtataaagaatgaaccctgatgtaaactatggactttgagtgataatggtgtgtcaaatattggctcattgattggaacaactgtgccaaactaatgcaaattgttaataataggggaaaatgtgtgtggggtggtggtggtggtgagggaagaagggatttattgaaagtctctggactgtgtgctcaattttcctgtgtatctaaagctgccctaaaaatagtctataatttaaaaaaattatcacatttttattgtcagaggttaaaatgatagttacttggcctactgtgtagtaccctgtggttccctttagtcttaaactaaacatgcacatggctgcctgagctgggtaaggcatcctgatactgagatattgtttttcatactgaagtttcttcagcaactttttgtatgataaatatgattactctttgctgttgttagaaataaaattaatcatttaatggttttcaaattagtgaagttaatgtatattcattcagctcttgtgctttgcaagacattataataatgcaaattattatcatcacttttattaaaagttgtagaatcccctgccttctcttagcatatgaaataatagaggaaattatgttcatttgtatcctaaatgaacattttaattttaaggaacaaaatacttttatgacaataaacaggaattccccatattttatcttccttcatagagaatactcacatcttgccacccatgtgtttattctatacctgactcagtaaaataatttttaattctatttaatagcagaatatggcttaactacttattaatagtattttaatttgtcagagctttcagaaactaataatgatcaaagccatcttaatttggatagtattttcctccttttccgcgccctcccttcctcctaccctcctgaatattggccactttccaaccatgatcttgaaactggggatagagttgttgactcactcactagtaagcaaagcaaactcggtctctgtccttaaggaacttgtgattaagttcagagcacagacaaacattaagtaatgatggcataaataaatgtaattttatattgtggtgccttctgtggaaaagtttcaggatgctctgtggtacctcaggggaatctgattcagactgtggagtcaggaaagcatttctgtgcctgtgacatttaagttgggtctggaaagaggagcatccaaaaggaccttgaagcttgtgtatggtcagtgtgtcatctcagctgaatctcacaatgatcctaatggtcatacctaggacaggtatgacctctgcccaattgaggaaattgaagccgtgagattttttgtgtgatgcttacaggtgcatacaattaattatcttgttgtgaaagtttgaatggaccccagttcaaaatctgtttgctttgcactacacaatcttaatagtttgagaagtggtcttacatttgagaagatgccccatggaggtgacatctgagcaggaccactaaccattaaaaaataatcccatgtaaatggtgaaaccctgtctctactaaaaatacaaaaattagctgggtgtggtggcgtgtgactataatcccagctactcgggaggctgaggcagaagaatcgcttgaaccagggagtcagaggttgcagtgagtggagatcaggccacagcactccagcctggcgacagagcaagactccgtcaatcaatcaatcaaacaatcaataaatcccatgtaaaataaagttttagttctgtggccttatgagtgttttccatacagcatatgaaactcaagactctgaagtcttaagtggagaatcatttcgattcatttattttgcgaataggtgaggtataatagctatctttctgcttctcaggaagacagcttctaggagtgtcctggaacattttgacccttgaagattgtctagataaagaataacccatatttttaaccttgaaaatgctaataactaattcctcaatccgttttcctagaaacggtagatttgtagatctctcaagtgtcttagtgttcatctgatctagctacactcttttacagataagaaaagagactgtgtgattttctgtttcccaaattgtgtttcacagaattttatttcttggaggtacctcatactgcatttccttcttaacaattcataaagtaggccaggcacggtggctcatgcctgtaatcccagcactttgggaggccggggcgggcagatcacaaggtcaggagatggagaccatcctggctaacatggtgaaaccccatctctactaaaaatacagaaaattagctggacatgatggcacctgcctgtaatcccagctactcaggaggctgaggcaggagaatctcttgaacctgggaggcggagattgcattgagctgagatcacgctactgcactccagcctgggcaacagagcgagactctgtctcaaataacaataataataataaaataataaaaaataaaaaaatcataaaatataccagagtattgagaactcagatattttactttattttactgaatgtttcccaatctcttaagattatatgatcgaagaatacttttattaaataacacccattattattccatagaacactctttatgagctagtaccataaagaatttttgtccttataatatactgtattttagtaaagtgttcatagttgttttgctatagttatttaagagtaattctagttaatctatatggtatataataacatcacacataatttgaaatgaatattctaggaatttttactttgtacaaatgttgggtagacaaatttatatttaaatagctgtttagcttccaggttaaaaggttctggtaagtatagcatattattttattgtttagtggaagtattaaggctattaccttatttttaaaagtggatttttaaaaattgtcagtgtgagaatggaaatcaaattaagtgacacactattggtagctgttcttatttttgaatttaatggaaatctggttaaaatgattaaaatgtttatctcattttttttcttttagctgctatgcctttcttgcctccttctatgacaatcctaaaattatctcagaacaaattttcctgtattccagaagcaattttaaatcttccacagtaagtttattgttattttaattttaaaagcacattagctggaacagaacctttagaaacatgatttcgatttagtcatatagaggtaattgatttctaaacctactcaacttgatgtttttgtatgtatgaatgattttcactagataaaagacccaactcattacttaaaatggaaacttttatatttatttagtggatcattgtgtaaaaacaacttaagattgtttaattaattgctgtattagtataatgaaatgagattatactggctatcactttaacttttaaaattttaattgtttgtggaacttgatatgttgccaaaatacccttaactttcacattatgcttaagttatgtttgagtgaaattttgggggaagattaggcaagtttatgtagttccaggtttttgagatattttggttaattcatgaaaccagaagcttcctgttaactttaaattcaggcattaattggatcttgagtgtgttgtaatcttaaatgctattctaattatatcatacatgataaaccaaattcataaaaatatatgtgtaaatttatcttttcctttgttttcttgctgtcagctattccttcaaacactatggctttttagaattgacactaaaatgctgcttgcatgatgctgcaatgagctcttctgtgagcttatatttaggcaaataataattagaatttagccatagagagtgttacacaaacctataatagctaaattacgtctagctttagaatgtgtttaactgttctaactactctacagcggttcatctctttaatcttcctaataatgccctacgatagccactgttattatctccacttcataagagatgaagtaacttgcccagagtcatagttcttaaacactggtggttcaacttcaggctctcaaatcacatgcatactcatatgtcaataatgctagttttgacgttacactttattctcaccctggggaaaattatttgtgatgttatttcatgtattttggaaatactcatttggtttatgtcttttctgtgtattgttttagcttgcggtctttagatatgagcagcaatgatattcagtacctaccaggtcccgcacactggaaatctttgaacttaagggaactcttatttagccataatcagatcagcatcttggacttgagtgaaaaagcatatttatggtctagagtagagaaactgcatctttctcacaataaactgaaagaggtaagacgattattgccacttaaaaaatatactttatgatttgcatcattacaaattatcattttaagtgatatttagcttctaaataccaatttcatgaaactagaagcttcctgttaactataaattcctgtcaactataaatccagatttccattaaatttaaaaataagaacagctactaatgatgtgtcacttaatttaatttccattctcacaccgacaatttaaaaaaatctacttttaaaaataaggtagtagccttaatacttccactaaacaataaaacaatatgctatacttatcagaaccttttaatctgaaagctaaacagctagatataaatttgtctacccaacatttgtacaaagtaaaaattattagaatattcatttcaaattatgtgtgatgttatcatataacatattatagattaactcaaattattcttaactgttacttaactatgacaaaacaacttagaacgctttgctaatacacaagatagtataaggataaaaattctttatagtactagctcataaagagtgttctatggaatagtagtggatgtcatttaataactataaattcaaaataagcattgtaaatatcaataccattcaatttttttttgttttttaaacaagttgtaagcctaccctatggtaaatggatatggtaacacagcataatttcctcaaaaaattacttttgtgatatacttttaaaggattatatgaatatatacataattatagatgaatgtgatgctgtgtgtcattgtatcaccaaatctctgtccaatctgttaacagactcttaaataaaccatttttctcaagttgttactggcctgtatactgtattacttgtttttcagctttccttggtacattcttaaatttctgcattccgccaccatgctatcaccctaatggatcaaccttttttgttttgctccattctctctgttgtaaatctgaaattgataatttgtttgtctcagaaaatattatttttcaagttctagcgtattgcctacaaaaaccaaaagaattaagtgtctgacactgtgaggttcagcaaaactgtgcatatattttgctacctgattttttgccagcaaatgagtgttttctattataaatatagtatatattgcttaaaaatttggaacagaaaagaaattactccaattaggatgccacctaaagtataagcatgtagctgtactttgagaacactaaattgcatgcaggtttgtagtgactaggtcttcttgcctttactgaaggagcagaatgaagtcacagataatggataaccaaatccattttgtggtaagaacttccttactttcaatgtcttgaagagatgaagtatgttaccaaaggagattgggttttttaatattacagatgagtgacatagattgtttgggagtaagtttttatatgtaagtttttatgtttttaaacacatactgacaacttatgacaaacctttggaaagttttaaaactctgttgaaaggttgtgcaagctgctgatggaatctgtgagcctttcttgtttcttatcacgttttttggcagagcacatttcttccttcccaccaacaggttttgcccttttttttcccattaagattcctcctgagattggctgtcttgaaaatctgacatctctggatgtcagttacaacttggaactaagatcctttcccaatgaaatggggaaattaagcaaaatatgggatcttcctttggatgaactgcatcttaactttgattttaaacatataggatgtaaagccaaagacatcataaggttagataatttttttctatttggttttactaaatttatttcagattttctactctctgtgactttgatggacatatattgttactatttagggaaaaataaatagtaatatttggcattaatatgctgtgtgtcatttgcctttcatttaatgaatgtgtttctgtggtgccactgtagagatttctcattcttcttagccagactaatgttgagagcggcttctcctccttctgtttcttttcagtggagtagactctaaaagaaaataagtattgctatttggtctctggttaccaattacacaatctaaagaaatacagcacagtataataacttctcacactgtatttcatatagcaactagttaacatatgcctcttacatcttaaagcattatagctactgacatcatgtgaaattactaacttctattttgcccattaggatgagtaatctactcaccttgatcagttttgaaagcaccaaaacttctcaagtatcactgtttctggtctttacactttaagcactttaaatatctttggtaatggattttatcctcctttttgttccctttcagcacatcggtcttattactttctcataaaatcctttgctcccttttccacagttactgtattaacgttgcagacctcagctctgtcatcacctctcaacttgactgtaatatccaccaaggcagagaccatggctgtgttcactcactattcaaatcttggcacccaacacagtgcctggcatacaattaatagttgtttaattaccagtgatttatacttactcattctcttctgcctaaaatctcttaaatttatatttaacttcatctgtttttatgaggaaggattttgttttctgaactcctgagcttgatttcattttaaaggagtttgttatcttttgtgctaattgtggctacccttcatcctacccaattatttttctctcttgaaactggaaaagatggtcatataaaaattggttcagttcttactaaacatttagtagaactagctttcagtgtattatactgtattatctaactaaatatttttaatatttaatatttaatttaatatataactaaatatttttaaacatgtttaacattttcagaaaagacagaaagacctagagcagattagaaattgtaggcatcatttgctttttgaagaaagacattttttcaaatagtggtgcattcttaagaaataaatcaagaaaggtaatgttgctttttggtcatatcatcaggaatgttggtcagattcttattagttacaggaatgaattgatcactactctgatgtaaaattcacttatgatttagtctttttctctaatttgaaactgtggcaacattttaacatatttcaaaatatatctttctctatccattatatttttgataacactttgactctactattagtttaaaggtggttttttagctacctaaacacttctatttcattcaggttttacattaagatcattaggaatgaaagctaacatctgctgatagtataatagtttatatttatttatgatgttatgtgatctcactatccatatatactattatatgcatatgtgatatacatgaatatatagctatacatcatatataccatatatgaatatatacacacacatatataatgtaactaatatgaccctattatcaagctttaacagtatacatatatctctaccttgtttctatgtcatatggactttgtgaaattttgaactttataatttatagggtttttcttttcttttcttttctttttttttttttttttgagactgagtttcactcttgtcacccaggctggagtgcagtggcctgatcttggctcactgcaacctctgcctcttggcttcaggcgattctcctgcctcaacctcccaagtagctggaattacaggcacctgccactgttcccggctactttttggatttttaatagagacggggtttcactatattggccaggctggtctcaaactcctgacctcatgatccgcccacctcggcctcccaaaatgcagggattacaggtgcgagccaccgcacctggcgtataatttgtagggtttttcatactatttaaagacattagaatatgtatacatgtatgtatatgtgtgtatatatagaggtatatatatattgcatatcgtattctaattagtattgcaaacatattttggccttttgattatttctggtgatagtgtaacatgttttctttggtgattttaccaaacattatcaactaccctaaaatctctagcaaaatatatgcattaacagtactctgaaagacatgtacattattagttatatgagatatgcactcttctggatactatattttagaatagtgtgacatgtaaaagaactcacctaaatctcaagtatacttttaagcagtttattattttatttttatctttcaaatactaggtttcttcaacagcgattaaaaaaggctgtgccttataaccgaatgaaacttatgattgtgggaaatactgggagtggtaaaaccaccttattgcagcaattaatgaaaaccaagaaatcagatcttggaatgcaaagtgccacagttggcatagatgtgaaagactggcctatccaaataagagacaaaagaaagagagatctcgtcctaaatgtgtgggattttgcaggtatttctttctatagaattttaaaattcacttttaccatttgtttggaacagggattcaaaaactgagctttctgttctaatatccagaaacctggtagactgtatggaattattccaaagcccttcatttctcctaattttacccttgcctccagaatggagaagaacatggagggatatgttaggaacaatttggtgctaggtactttgatcggttgctgacaaatatgctaaaagtggtcaatcctagtaaaaacccagaatagttctctaaacatggtctgttgtttttctcttattagtatgctaaataataaatagtattattctcccagatttttttttaaaaaaggattcttgcctgtcgtttgaaagattaaaaaaatttgtctctaatctttatttaggtcgtgaggaattctatagtactcatccccattttatgacgcagcgagcattgtaccttgctgtctatgacctcagcaagggacaggctgaagttgatgccatgaagccttggctcttcaatataaaggtgatttgttctgatcatttgaaaatagaaaataattcatgtgtctgtgtgcgtgtgtgtgtgtgtgtgtaagttaatttattttgggcaaacaattgcttcagtctctttaaatactttcttaaaagaagcactaaaattttgaattgggaaactttccgagtaatgaagtcataacatgaaaattgtatgttccatgttggtgaatgttattggtaacctgaaactcttttatgctgtaaaacttgaaaatatatatgttcaactgttttttaattatattatttcttaaatgaaatctaaatttttctaatttaaaataagctatattaaagaaaagcaatctatatatatatatctcatcaactttgtactcaggggccatttagtgtgaaattcttcagattgtatcctttaagtggtcccagattattatgctgttacatctggaatctcccttttgttgcttttctatcttttcctttgttgtcttgttgtcagctattccttcaaacactatggctttttagaatggagactaaactgctgcttgcatgatgctgcaatgaactcttctgtgcataaagtccttaaaaagcttgtgtcaggacatttaaccatgtaattggctgcatacatgcttgttttgtaatttgggtattttttaatgtttcttttattaacttttttacagctagccaacgtgagcaaatagtacagtggcagtcatatttgcttgagtggcttttattctttcattgtagactccaaattggttgactttaaaacgaatttagaagattaaattcacagataaggaagagaaaatataaactatatgacgttaatttgatataatttgtgggtttatgaaatgcttattttatttaggagtgaataactcatcttaaggcatgaagatgggaaaggaaaactataccactaccgttatatatgccacctaaaagggtgaagaattgggttaagaaaggccaaaaatgactttttaaaatgtcgtaaggttacatttttttcttaggtttaaggaaaaaaggacagttgttcttttcttcttctgaagtctgctagtttctcttttccattcaagtgaatgtcacggaaagcaaatatcaacaggaatgtgagcaggcccagtttgaaagcaaacacaagagggttttgtgtctttccctccaggctcgcgcttcttcttcccctgtgattctcgttggcacacatttggatgtttctgatgagaagcaacgcaaagcctgcatgagtaaaatcaccaaggaactcctgaataagcgagggttccctgccatacgagattaccactttgtgaatgccaccgaggaatctgatgctttggcaaaacttcggaaaaccatcataaacgagagccttaatttcaaggtaacatggtaggctggtagagaaatgtaatttattgattctcaactgcctagaaatgtcagaaattttgagaagtgagcaactcacttaaaattgtgggttttctttccttgttgctgttagcattattaaagtcctttccattttaaaattatttatgccagacttcatttctaattcatagaaatgggaacaaaaaataattagaggaacctgagagaaactaagagaccgtttctgggatactgagaaaatgtttctgagagagaatctgagaaaatgtttttgatgccttttctgattcaacttcttatagtggtgattcaatcacaagggtaaaggtgaatactgaggtcttgggatcatctttcttctattattctttaactgttatttttccatttcctcttttcttttggaattcctgttttatggacatcttgatcttttgtgccactcattcatgaattttgtcactgtgattcccattccaatttttttccctccgtattgtgaggcagctgttttatttagtcatgaagaccactaacttggttttcagcagtgtctcactaattacttagttcatacaaaatgggctttttattttaggaattatgttttaaatgtttaaagttatcttctcgtaagccaaatttttataaaatgtaaataaatcagttatcagagagaacacttttttttttaaatacttggcagaaaaaagaaatcttcactgggtactacagggagtgtggtgtaaactgtactgaaaaatacccttgatagttccatatgacaaacataatgatgaatttcacttagtctgtcttggcttagctcaatagcactaatgatcaagatactggctgataaatagagtcctatttggcctgggcagtcccagcataattatgtaatagtgtcccactatattctcaaaagcattccaatttggatgataaattatatagtcaccttggttataactccatgctggccagttagcttagttctgttccatttatatagattatgtgtgcttcactccaaaacctaatgagccatttgtaaaagtgatggcttttgcggtgcccagggagagaatttgtatgtttgtatccttcaacacacatttattacagttattaaaaggttttattgatgatagatggtaatgtcatgtaaaaatgacatattatttatttgtagactttcctattctcttgttggacatgtaattagaaactaatatgacttaaagaaaaacaaatacacaaaatttattcatccaattaatctcttaatccaggtgttttttttttctgagactatacccatacttcaataactttgttgttactgagaatattttgagtttccctttttgtcattgttgtcagagaatgtatcatatctttaaaaagacttgttggaggatgagtttgttttgaaaaggcctgaatttagttgatgcaaagtcacagataagatggttcattaagctgtattaatactgcttttgtctaatagatatcattaccaataagtcagactagtttttcttttggcacttataaatcacctttgaagacaactttttacaaggaaataaaacaaatgctttgagaaataccagtattattgaaagaaaagtatatattgctaatggatgcagcattctggcataatggtttgaaaactcatttgattgctttgtagaagaatgactctttcagatgacccagggcctgtgagcctgccagaacttgaaaattctttcttccctgaggtgcttcaacctgaattcaaagagcagcttttaatctattagagatcattttttgtcctctcatttatttttcatatttgcctttgatcttagctcttctctaatctttttctgtctcaaccttattaacaggtgtctgtgcagacacttttaagttttgttttttggctcagcctgtcagttaactgataatcatgctgaaaggagaagcaggacaaaacagagttcaatgctgacaatactccttttaatcttgtccagcccattagcagagcaggcatctctgtgggccttgagacgtagtcccgtaaaactcatcccgtttctacttgatttgctttctttgagaactcttgtttatttttatatggaggtttcctgccttggattaaaacataaacctcaatctgaagttcaatttcatcttaatttatgaacgactaagagagggaacatgaaaagtggaggttagtgaaattatctctaattctctgggttaagagatacatgaaaacagtctcttgagtaaccatttgcaggtaaatatggaagtaatggttatggttgtctctttaagtttttagtcacaagtagaaaaagaccaagttaatttttttctgtgtgtgctgaatttctatttgtagtaagtgtaagaatttaagcagaaattctgattcgtattttcagataaaaagaatatgtaatttccataggtccagaaatagggagagtttgccatctggtggttcttaacggcactctggatattattaagagttgcatttctatttaaaattatattttaaaaaacgtttggaagatacttttattgtagaaactatcctcttagggccattctttaaaaaaatcttattttatatatttctcattttgttgatagtgattagattctaagagcaacagaacaatgatcatcctctcctatcagaatcactgatgtttagatgatttctcattttcccaagttcaaggttccatgaaaaacatagcttgagtgggattttatgtctctgcgtttcactgttgatatatatgtcctcccaatataacattttacaaataaccaagcacaaaatttaatattttaccttgaatatttaaaatataataatatccaaaagctcttgtaatttgtactgatatcttatactagcgtgtctgtttcacattaagtttaatgtcttaggatataaaaaatcttttttatggttagtgatttatcttgtttttttttccatggaatttctggatagcgagataaatatttccatactattttatttgatatttccaaatttgcctctgaatcaacaattttcctattttaatttcattgtacttgttccttacaacctaaatagctttttattatattttgattttatttaaaaatgtacttctgaataatatatctgtttctgtaaaaactgttagcactgaatttgccaaccatttgacaaatacacaaataaaatagatttttacggcttgtcatttgtaatttcatagatccgagatcagcttgttgttggacagctgattccagactgctatgtagaacttgaaaaaatcattttatcggagcgtaaaaatgtgccaattgaatttcccgtaattgaccggaaacgattattacaactagtgagagaaaatcagctgcagttagatgaaaatgagcttcctcacgcagttcactttctaaatgaatcaggtttgtgtttttcgttccttattttcaaagctcagctgtagtaacttataaaagtgtttctgaatcttttatagaatttacattcaaagttgagagaatatccatacggttctttaataggccactgatttttttctttttggaagatcatcatgtgtgttcatgacaaatcatgtatcatgtcataagaaaacaaatttagaaatcacctaggagtaaagcagtggaaagagtccctgagtgggagttaaaatatttgggttctagaacttgtctttactattcaggagctgtggaaccctgaatagtcaaatgacattcataatgtcaaatgagtttagtgcatgtgaaagttatttttatattgcaaaggggaattattgttggcatggtctaactgggacgcttggagagtcaatggctccctgagatgatgcagcttctgagtggaagatctagctctcttgcatcaaatattgatctcaaagatgaaaattctcaaagcaacttcagtgctaattgtgtacttgatcatattaccttgctagaaatgtgtgagttgtttgatagtactagagtaagtgactgggaagctgcttttgatccctagattctgttgtataaaaaatagcttcccgtggtttatgatctgttccttttccccatcgttcttaaggtatgctgagatatgctgtgtttcttatctgtatttgaaaataaaacatgtctttgtagtgtgtattcagcaagcgaaacagaaaattatgaatttctacttatgtgtgaaatatgctctgtaatgcatgtcagtgtctcaaatatgcttaaatatgatcattttatgtagtttaaaaatactccattataatattggaactttagaccataggatgcacagcttctagtcccagctctgtcactagctatgctgaaatttcttcacctgcaaaatgaggaagttggactagattttttctaaagccccttgatatttgttctagattccatgtttcactgtttgatgactttttactacaggagtccttcttcattttcaagacccagcactgcagttaagtgacttgtactttgtggaacccaagtggctttgtaaaatcatggcacaggttggtgtcttttatttttgtggcacgggggttatggtcaaagcatagaacagatggcgcccagagcattgagcattttagaatttgggtttagttaaggcagaaacttttgtgaatttggaaaactgtggaacatttcacatagaagactacttgaagagcttcatggaagaaggaaagatgtcttgagttcacttccatgacttggttttcaagccacatacagatgtttgtatcactctgccccatgctgctttactagatcctgatgatgtcattggtttggttactgaattagtcaattgaatgatggctttgtggaaatccttggggtaaacacatataagaaaattaggttgctgagcctgtgaaacctctatctagataacatggaggtgagttttgacttaagtgaaatgatctgagctttaaatgcttacgattttgaaaactttggatggccttggttatagctatttttttcttatatttcacatggaaaatgatttttttctccaaatgataatccattaccaatgagtttaattagttataataatccatctctgtagctttgacataaaagaccatttgagcaaaacatactacctcagggcttttcaaccccagcatgatgacattttgggccagataattctttgttgcacattgtaggatgttagcagcatttttggcctttatattcgagacgtaagtagtatcctctagctgtgacaagcaaaaatgtatccagacattgctaaatattgcttggagaatgtgaaaaattaccctagttgagaaacattaagctactgatttgttgatgagtaaaatttatagttttgcatgtggctgcccgagttcctaaaattattatatatttttatgttagaaatatctcttccaattaaaccataaaggtaattaaattcactcaggcagccttgaataattgttcctaaattccatctaaggaaaaaaaggaagctattgtgaagagagaactcagttgaggctaaatcctgtaccatggaactcaagagcatattgaaacattgcaatcagcaattatttgcagtgtgtcagttattactattttggtaggtatttttaaattagattttcagccttctgcacatatgtcatggataatgtgattttactcaattattaaatgataatggagacagtagtgtgacccagagcacttacttgagcatcagcttgacctacgtttcagtctctttaattacttattagctctgtgaaatttcttaatgcattaagcctttgtttacttactttttaaataaggaaaataacaattatcttctatattgcctccctggttcagtgtaagtgaggggtaaatgttagctaattttatattggatctatttggcaatttaaagaatgttaatcaggaaattttaaaaaattcagaactataaagaggtacttacgtagttttggaaagtgtgtcatgtatggggacaaataaaaaagatgtgtaggtagctgcatcctgtacagcaaaggaagttttaaatatatccagcaattttgttgtcctagctggcgcacaatagttatcaggaggtaactcaactccacatagtcaaggaaaagctaaagttgctctctaaagtggtgtgtttccatgtcactatggaacacttgaagttgcacacatgtgaacattaggatgggtatatcttatacagtagaataaggaagaggtttgcatcagaactccccttttaaaaaaatgcagattttcactatgactgcaataaaattcctgaagattctgtggagtaattaagttgaaactccatgaaagttcttctcattagcatagttataaatatgataatttaagtaaaaattaagttaatttgagccactcaaagttacttttaaagacagatttaaaatgtcaataaaatgataatttaaatttccgattaacctaaaaaagaagtgccatcatttttatttatgccaataaattgaaatataatgtcattttatcactaaggtttaaaggaaatgaaatctctaaataatcaagtgaaaccaagagcaacttgtctgacagctattagcaaaaataaataggagtattcaccttcatgaatcaaggcaagggccggaataatttcatggtgcagaagctctaatgagcccacccactctatgcgccccgagctgttaggtcactaaacttattaaaaaaaggtaccattaaggcagggagaagtttacaagactcatttaactgtatgataaaagagatatgaaagagacctattcaattaatcaggtggaacattaaaaagcttacatggcaatttaaccttgataaaaatacatgggagaaatacaaaggaatttggaaaattctctttccttgaataaggcatcagttagctattcaggttatgaggttgaaggaatgttaggagctcttttaaaggtgataaagtcaagataatgttgcagattttattcttatgtaacaaaccccctcgaaacttggaggcttaaaatgtgaacaatttatcatttctcgttcttctgtggcttgactgggctcagctgcgtggttctgctccacatggtattggcaagggttattcacttggcttcattcattaaactgagctggaaagtgcaagaaaggtacatgcatgtttttggagtattggtgcttctccatgtggcctatcatatggctaagttgggcttcctcgtggcacggtgatcacagaataattagacatctttcatggtggctggttaccaagagaaatgaagcagattttttctgtcctcttaaaggctaggccaaggactggcaaaaatattaattctgctacattctagtaaccagagcaaccacaaacctagctcagattaaaggggaaggaaaagagactctatatgaatagcacctatgtatagggatggaaatgatgtgtccatctttggaaacttccactataaatagtggtagcacgctatagatccactaggaaaatcaagcacaaactctttaaaaaataagtgtatcttagtaaaatagattagaataactagataataatggctaacatacatgaggttaatatgtgcttttcaaagattagctcatgtaattctcacagcaacctttccaaatggtactttattagcccctatgatacagatgaagaaattgattgacagagaggttgaataatttatccaacggtacacattcaggaagaggtagagttagaatttcaaaccaagtagtttgactccagggcctatgagtttatacattcatagggctgatattcaaatgagagaagagaagtaataaataaacatataatatgttgagtggtacagagtgctacaaagaaaatatgaagtgcagttggagatgaattgtcaaaaaaggtcttagcacttaaaaaacactaaaacagcaaacaattctctttaccacctaaactgtaagagcgatctggaattgctataaagtacacaacatgggagaagtcttaaacaacagtttttattatttataggcccattgcacactgtcattaaataccaatatgttcaatcaaccatgcattcattgattcaataaatactgtacatacaaaatagaaatacagaaatgggtaagacaagtccttgggcctaaggactttataacctggtatttcactcaactacatgatagcataaataatgtttgcttctgtttaagtattccttaaacattatagatctcccaaagaaaattaaatacaaacctctttttaaagtgaatttgacaaagcaaaataaattggaatatatagataaatatgctaaaatttgtcatatgtactttgcgtactttacatgtgttatttcattctcagggcaatctaagacagtcacttttattatctcattttatagagaagaaagctgtgcagtaaagaaatcaaatacctttcccaaggttacagagctagtagtagagcctggatttgaatctgggttctgactgatttttaactgccatgacaaggatcaaagctcaaagtgtgatctctgtgttagaaacatcggggttgctctttaaaaaagccgattctcaggcctcaacccagacctactgacccagacactgcaagtagaatccatcaaaatgcagtagttactttgagaatcatgaaactctgctacacagtctgtcttcctattcatggaagtcctctcctagtatataaatgtgaagtaatatttctatttcaaacctgtattgataactgtctggaagataattttcctgggaatatattattgatgagactgcaaaacagatgtgaggtattggattgatctttccattgtagctagggaaatactgatgttcattgtttcagtgaagttcaatgatttcctatccgaattaactcccttaatttaacaattttttttttttttttgagagtgaatgcccctctgggcttctaggccacatggttgctagagaaattaggtactgtgttgcacttgaaaacactaaaatctttctgactactttcactgagcaaagagacataaaatgctttaaatttgcaacatttcagaaaataaattttagtgattatttatgactcgaatctttcagattttgacagtgaaagtggaaggttgtccaaaacaccctaagggcattatttcgcgtagagatgtggaaaaatttctttcaaaaaaaaggaaatttccaaagaactacatgtcacagtattttaagctcctagaaaaattccagattgctttgccaataggagaagaatatttgctggttccaagcaggtaaagaaaaccttaaaaaattaattgctacatggaaattcactatctattcttttaattgtcaaactaactgtagtctataatagatgtattaaataaataaatatattttgcttctagtgtaaacctcctactgacatgtatcatttattttggaataaaacattgcatctgacactttaacaatatagtaaatcacttactttatgtgtatagttactagttggcttatcactgttgaaattatttaagaaaggtaaatagtggagattaatgtgtgtgtgtgtctgtgtttgtgtatgtgtgtgttcttaaacaacactgagagagtttattaagcaagttctgagaagatagtgagttttcaacagaattttaaaagcatttatggcatcacaatggatgcctatgttttagcctatactatggaaatttttcctactgctctaagcaactgggaaatttataaagtaatatgatgttgaaatgtgcaaattacattgattgatggatgcagccaattttaaaaataaatatacactttttttctaggacatgtatttttcaggatttatataagattacatttgtctatgcataactaattgtaataatttatgtattagtgcacagggattaccgaaaatatttcatgcatctacatctgagcatgcatttgaattggttattgaccactgaatttttggtgtaggaaaaatatgtagtgaaacaatgttacaaaaagattacaattgtttggaatgattaccttcattgactttaagcagtaaaatcatttgctcaacaaggttgggtgttttgtgaggctgtataaccatagtgtccttttgcctttagtttgtctgaccacaggcctgtgatagagcttccccattgtgagaactctgaaattatcatccgactatatgaaatgccttattttccaatgggattttggtcaagattaatcaatcgattacttgagatttcaccttacatgctttcagggagaggtaagtatctaatgaagacttattagatttttagagactattaatttagacttattaatttttagagaaattagggagatggcatatgaaaagtaatatgccattttctcagagtttacttgtttggaaggcagctgaagaattagaaaataagctcataaaaccttggagtaggcaatctaaagacacacaagcacatataacctcatctaatttgtcaggaagaaaattccttaggtgctcactcagatcttgactgtgattacattgtagggactgtaattatctcttttctgttgcacagccactaagacatttacaaaaaaagagcaaatccggtgtttataatgctaactctttcttctaaaataaatagagacattttggtactccaaagggaaaatatcattttggggattaaaattagctttacacaggtgttactggtttccaaaataaaccttaccttgattggaattaatcaacatataggtagttacattgcattaaaaagttcagaaagttttgcgtttagcatgatcaaaaacttctttttaaaaattatgaggatttatttatgattttctttcttcatctgtcgagcatattaaactgcttaacagcatcaacctgaaatggatcttaatgtgcaggggatttaactctttttattgtaaagttgtggataaaatatttaatagatatggatgaggactcatatcagtaacaacccaatactttatttcaaaatgaatagatctgtattacaatcacttgtgttgtgtgcagtagattttttccctttaacttaggaagcagttaataattaatggctccattttttagaacgagcacttcgcccaaacagaatgtattggcgacaaggcatttacttaaattggtctcctgaagcttattgtctggtaggatctgaagtcttagacaatcatccagagagtttcttaaaaattacagttccttcttgtagaaaaggtaaggaaatcaatttgaatgttttcaattgcaacactaaagaaatttaaacttaaaaaaaaaaaaaactttaccttaaagctttgcgacagtatgaggtttagacaaggtgttgagctctgttttgaatcatgtaggctgtattcttttgggccaagttgtggaccacattgattctctcatggaagaatggtttcctgggttgctggagattgatatttgtggtgaaggagaaactctgttgaagaaatgggcattatatagttttaatgatggtgaagaacatcaaaaaatcttacttgatgacttgatgaagaaagcagaggaaggtatgttttgatacaacttacaaatgcttttaagtgatccttcaatacttatgaagtgacttttaataaatgtaaatattcttatccataagggatgagttgaaaaatagtatattcaattatagggacagttcagaaaactgaattatatttattaccaataaaatcttgtattctagattcagaaaatgttgatttgagggtttgaatgctggcttattgagcaacataacctcatctgtgaaaccggaataccaaccacatctatctcatagaactgttataaagattcaaatagacaatacatggacctaatttaccaacatgtctgccatataataacagctgcagcttcatgaatgtggcaaaagcagagagtagataactttctagtcagatgtctggtagtctgcagcagttcagaattctacaagtgaacgtaggaataagtttttaaaattccaagtagatagatactaagtgaatctttaaaatgttctcaaatttcctagagaaatataggattggttagaaagggagggattagaaattatagaaaatattccattattttttcacatcaaaaccacaaatttatgtatctccttaaatgttgtttttatttaaaaaatgttttattacttctcaggagatctcttagtaaatccagatcaaccaaggctcaccattccaatatctcagattgcccctgacttgattttggctgacctgcctagaaatattatgttgaataatgatgagttggaatttgaacaagctccagagtttctcctaggtaattctttttgttaatttgagaataaaaattaggatgtaattttctccttataatttagaaaatagatttcataattatattgtcatagattttactgtcttcatatatttgttataatttttgtatttggaatgatatattttaaaggaatataatattacagatctggaatttgttttgcacataatcatgtagactaggatcaagatgaggatgagattatcatggaagcagaaatatttatgaaatatatctttgtatttgccttaattgccagggatatgggaggcaaataagacagttttcaggtgagttaagtgaagcagccatattttataaaatgacagaataggtaaaggaagcacacctcagtgtagccatagcaggggttttatgactcagtgtgacaatgctgaattctcatagaaatattcattaaaagccttgaaattaaagtcaaaagtgttacatggtgacatactcaaatacttttttttttttttttgatatgctgaacaatttacatttcttggttccgtgaattcaatcagtgattttcagtagagtatgatggaaatcattgaattcatgtagcatgtttaggtgctcattgagaaaaggtgaagtcatggtaaccatgtttcaatattctcatttgtatcttgacttcctgcacatggatttttgggcctaaaagatgtttttaaaacatgctcatacacttcagaagatgaaaagtgtatgcattataactactttgggaaagaaacagtcaacatatgttactgtatgtcattctgtagattacatgtgtggtttctcatgtctctcagaataaaagctaatgtctttacaagacctgcgatgctgtgatctgtctggctcctcggttatcatttttaaaaaaagatatactttgtacaaatttttttaattgacaagtaaaaattgtatatatttatggtgtacaacatgatgttttgatatatgtatatgttgtggaatggagaagtttagctatttaacatatacattatctcaaatatttatgtggtgagaactattaaaatctactctcatagcaatttacaagtatacagtatgttattattaactgtaggctgacatactcaagttttaaacattcctgagagtcattgggacaactatgaaatgcattagattgatttaatataaagcatttgaagacaattttgaccttactttgtttagtttttgttgttgttgtgtgtatacatttaattttaatcaaattaccccagaaataatgcctaagatctgtcagtcaggacataatattattagcaaaaagttgtccaaaatttgagacatgatatttaaagctaaataaactcctttatacccctcttattggcattgattgggaagtttaggttgaatttaaatgctttggaactcaggaagttaatgtattagtaatagtgggttaacataaaatgctgaattgtccttgctgaatcctacatcttaaccccagacttcaaggtatacaggaaagtaccagacatggtgcatccttcctctgaagaaatcccaaactgtcagacacagatccctaaaatatttctttttcctgcattaaaatgtgtttcagatgaatggacacgttttgagtagtgtatgtggaaacgtcatttacaaagtctgtttagttggccaggtgtagtagctcactcctgtaatcccagcactttgggaggccgaggtgggtgtatcacgaggtcaggagttgaagaccagcctgaccaagatggtgaaacctcatctctactaaaaatacaaaaaaattaactgggtgtggtggtgggcatctgtaatctcagctactcgggaggctgaggcagagaattgcttgaacctgggaggcggaggttgcagtgagccgaggttgtgccactgcactccagcctaggcgacagagcgtctcaaaacaaaacaaaacaaaaaacaaaaaagcaaagtctgtttagctacccatataggaaaatgtttgtgattactctcccttctctagacccatgtcccataaatccataaatcccatgttcatttacagaaagcagtctagataggagtttctcagtctttgagctgttgccattttggcttggataactaactctttcttatcgagggtcatcctgtgcactgcagaatgtttggcagcatctctgtctatccactagatgtcagtagtatctccccttccctcagatgtgacaatcaaaaatgtctccggatgttgccaaagataaggggtggggttgaataccagtgatttaaacaaattaggtgtatccttctaaaaacattttacaggtagcgactccagcatctttatattagagtaatctggagaaggttatgcctctctcaattttccctctttccatttttatttgtagggcagcaatgcattcaggcttttggtaactctttttcccaagatagcagtaactattatgcagtgagtaatacgacccaccttaatagatatgaatagacttgttttgtgaatatattttaaaatataaatgtatgggattctgttcatgcgtctgagaagccacagggtacatttcctctttgtggagctatttatttttctggagagccaagacaggtatttccacttcagtggtgtgatttgaggggttaggaaaatttccttgccttcaattttctttccaacctagatgtcacaaatacataatagtagtccttaactttatttttgttttcagtcacctgaaagacatgacaatccatactccatattaatgcagcggcgattctcaaatagagaagggctttaaaaaattagaaatctctgccgggcgcagtggctcatgcctgtaatctcaacactttgggaggccgagatgggcggatcatgaggtcaggagatcgagaccatcctggctaacacggtgaaaccccatctctactaaaaatacaaaaaattagccaggcgtggtggtgtgggcggctgtagtcccagctactcgggaggctgagtcaggaaaatggcatgaacctgggaggcggagcttgcagtgagccgagatcgcgccactgcactccagcccgggcgacagagcgagactctgtctcaaaaaaaaaaagaaaaaaaaaaagaaaaaaaaaacaactagaagtccctactccaacttgaaatttggatgtatctccctagagtatgtttcttctctatgctgcattgcaatttttctttgttgttgatagttgtccagattgaggggaggcagaacaagatgcatctatatgtttccatctctccgaccgattctctcccttccccctctacttgctttctttctcttttccctcttctgtttacccgattctatttctgattccagtatgtaacagttccctctgaagctctctcaataccaacaatcctaactaatggtttttaaaagtcaaatattaagtactggagggatagaatgagagaataccaagactgataagatgcaaataatacttttaacatatttacaatctaatagaaatacaagacatgctcaaataagttaattattttaatatactctctctgagcataaaatataattatatatgctcattatagacatataaaaaataaataggtagaggctttccatagatgtgtaatttcaccacttgaaaattactatatttccttatagactgttttgtgtgtattcacttatatccatcaagtgactacatttcaaggcactatatgagaaccataaatattgtacaaacaggatttgctaaatgtcggtggagagtaacagtccacggggctgatcatggtcagtttgtgaggcaggcctccaaactccttggggattgagatgatggagtagcagagctcttcaagggtatggaggcctgaaggtacaaagcatgctcaggaaattttggctattgcggtttgtctagagcacttgttctcaaccttacctgctcattactaattctactaagtacagaattaaaagaagaaaaaaatctaatgaccatttcctcctgggactaattagatcaaaatctttgaacccagacattagcgttttaaaaagctcctcagatgtactattcagccaggactggggcagggaaagctactgaactccagccttgagaatgagaagtagaacaagaggagaactttaaaaggatttaggggccactatatgactatggagctgaatttagatttgatttagtaggcaacgcggaataatttgtttctgaacaggagagtgacacaatcaaagtggaatgataggaaaattaattttgcaagagagagagaatgagttggaagtaaggaactcagaaggcctcctgggactcagcagaaagctctgaggccaccaaatgggtgtggtggtagtggaaatggagaagaagggaatgtaaatgaggctacacagtggactgccactgttagccgtggggttagaccacagcaagagttaaaataattcttcaattttaactccagaagggcctcaaaaagactttttgtcttgttatcatcagctatatggaaggtagaataaaaactagttaggagaaaaggtaataaatgtggcttttgataggctgtgattgagttggaagggcataccagtgaaatcaccaacacaaagttggaagtgtaggaaagcacttaggaggtggctataagtgaaaatgtgaaaattctctacattaaagggatagatgaagtcacagaagtggatgacataattgagcagggtatgtgtagagggaagacgggaaggttaaggacaaaatctttacatatatctttcttggagtagaaggaagaggaaatgttaaaggagatttgattcaatgaaacaagtaggtcaggtttctattcaaatttacaacagatataattacaacagatataatttatttagtttttttcgcttggacagcttaatttaagtgctttgtattttcttttcaaaaggtgatggcagttttggatcagtttaccgagcagcctatgaaggagaagaagtggctgtgaagatttttaataaacatacatcactcaggctgttaagacaagtaagaaattcaataatataattatattaaattgcacattattaatctactggaactcttattttgcatacagttgtgaaaatgcaaaataatgaccacatttctacttaagtttaattatgcaatcctagtttgtcttttcgttgtggagtagaaagttttgtgttatttctcctgttgagaaacaaaacactgtatctgagaatccttataatcgtgatacatagtgtgttgtaaaactttttgtaagactcacttacactcctctttttactttagaaccttgctgttcaaaatgtgctccatggacaagcagccaggcattacctaggagattgttagaaatgtagaaacttgggacttttcagtgccatattattgttcctgatactccacagtagtcagactcctagctgcctccacctgcttccagaccttgaagcctagcaagctcctgacttcgccttctgttttcttcagagtatttatcttttacttttctggtctagggagagaatgatttttatttttattgaacatgacttctgtgtgttcagggtgaaagaagaagtttaatgcatgatctcacattgctaatttgattgaaggttagaaatcttaaactaaaactctcactgataagcttgcacctctcttttctggatttatccactttaataagaactgctattgattacttgctacaaagatggagaaagttagcatgcttatcctatttcctactccctgtccctgtccacttcctaaaacttaaaattggttgcattaattttcctgatatagtaacaattataacttggaatgattttcaaaacttttgtttttttagtataccaactctagacagcatggactgactccttgctatgtgagatgaggaaaattaacgctattctttctccttttcccatcaccttctcaagttctttaatttattctattatttttatgtagtgaaagtttataacatttatattctggtctgtactcataattaaattgttcacattttgtctatagtttggttctgagaacaaaaccaataaatgccatttatatatttttttatttgtacagaaccaaaatatttctacttctagataaagaaatgcaaccttctgtcactaacttcttttactaatagaatagtaacattccaaatatcaaagtcaaatggattctctattgttatgtatttatcatcaatttataaaaataaaggcatattttaatttggtcacatttttaccctgatttaaaaaaaaatttgtttttagagatggagtctcattaggttgaccaggctggtctggaactcctggcctcaagtgatcctctcaccttaaccttctgagtaccagtggtgatttattttatgtagctttttgaggttttctgattatatacatatatttttaaaaaacgtacttcaggaaaagatatatattttcatcatgacttcaagtgtttctaagttcttaatcatacagtttgtataacagaatctactttcttcttgaagacattcctcattcagcacatgacttactgctctaaacaggagagatggatttctaggctgcttgtgcagtgattaatctatgagttagtttcctcgccctctttgattactctcaatatttcttggattccatccattctcttggttggattgtccttagtttttgttgaagaatatcttcgagtaatttttttaagaaaaggtgtttgtgaggtaaatgttttcagtccttacatgttaaaaatatcttagttttgccctcccatgtggtggatatgtcatcacactttattttttaggaatctaggcttgaaacaattttcttcaaaatttgaagaaaattccattgatttttagtgcccactgttgctaatgaaaagtctgcagtcagtcagatgtttgctcctatctaggatacctttaatttcattttgaaaactgaaaatttgaccttttgaatttcatttgttttcagtgttctgaacctttacaagtatgtgtttgtgtgtaggttgtttttcattccatctaattcattattttgtgaaaaattgtcttctgtgtattctcttctattatttattatttcctccctaacatttattaatcatttttattgacaactactatgtaccaggttaggtgatgggacatatgatatatatatagtagtaagctaaacccagtcaaggctctgcttctctggagcctatatctagttacttatgattcattattgcttatcattgctccaagagtatatgttagatgacaagccttttgggtctatcatccatgtttgagttccctcttcaagttttatctataatttgtgttacttacttgactgtctcttacaggtttctaatattttttagaattgcatcatctattatttagctttctggtgaattttgttttgataatcatattttccatttccagcaattctttccatcccctctggttgttcctttgtagccatgtttttggataaaatgtccataggtgtttctgttcatgtcaattagaatttttttttgtattacttgcattattgcttttttctctgaggttatttgctctgtgggttcatcttgatctttctcttttatcttgtcagttttccaaattgagtagttttgggtgacttcgtatgaagtaagtactctattgattgttaaagaaggactgtattgattattaaaggtaactagaatgggcattcttcacattcatgtaggtttgcttgttcaagttaccactttctgaacaagaaggttagaccatagacttttaagggctgcatactgcaaagggatactctgttctttaggttacatgggcagggatcactgctgagaccatacctgccaaaggaaggcaggctttgctctctagatgctggacttgaaattgtttcccctctgcttagtgctgcattattttttttgcttcttaatctgctgcagagtatctagatcagggtgtccaatcttttggcttccctgggccgtattggaagaagaattgccttgggccatatataaaatacactaacactaatgatagctgatgagcttaaaaaaattacaaaaaaaaaatctcataatgttttaagaaagtttatgaatttgggttgggccacattcaaagccatcctgggccacatgcgacctgtgggccacaagttggacaagcttgttctagatacttcagactctgttctacatctcttcatagatcaataacttgcagcaatgagtttatcagataaattatgttcacttttcatccataaaaaaagtcatgggaggtactcaccataggattggtttaatccagtcactctggccaattttctttaaaattcctttaaccttggtatattggtttaattccttcagaatggcttttcccattgtgataaactggttccaggcttcacgagtacttattccaagtacagaaggaaagagggtacctcttttgagtacttgtatttcaaaggaatcaaatggcctacataataacccattaaataaatagatgtctctcagccccagtgagtcatctgtgcttttctcaacaagcactatgttcagggcaatgctttgtgctaattggctttaggcctttgttaccaaactgatcactgtggccctgagggtgctgttacttagaatattcccaccttttctgagaggctgatgttggggtcacttccccctgaactaaagtccaggggctgcatgggtgagggttgagtaactcagtactctaaggaggaaaggaaggggaatatacactgttagttaacagtggttattcctgtattctctcttgtttggattctactggggatttctttctttttttgagtctttattgacattaggaatgagagatagaaacagggtgagagaggaagtaaaattaaatgtgaattcttccatcttataccagaactcaactgtatttttggaatctatatatccttacttttcccttgatttattacaaaaaattcttagtggctacactaagtaaattttgtaacctttaaaaaatacatagttataatattttaagtactctgagtaatagaagatttcatgtgagtacaaaatatcctgggggcattttaattattagtaacaacagtcacactgtagttctagaaccaaattgaacattttatatatagaagcttatctgtgaatcaaatctgacataatctcttttaatgtgtaggtaatttcttatataaattgattttttggccttgctgtcagcatgcatttcaaattttacaccatgtgtttggggagctatggtggaaattagtacattaaaaatgtctacagagccaattagtgtataagcagggaggcaaactaagggaatggtggaagaaattaaaaaaaaaggggtgtgcataatgtgcttcttctcttaaaaaaaaaaaaagaaaaagacaacaacaaaaagaaagaaaaatgacatttgacggtcattctaccagtagtcatggggcagatctatattatactgtactattacgctgttttttctttgcaattagtgagttgcttttccaggatagaaaatttggattagacctctgtctgtgcctatgaaaacaagcagagctaacttaactccttctcatcagttctaaccaactgacatgggcattaaaaaaaagattttatctactaagcaaatatgatcacagtctgaagctttgttcttggaaaatcccctctcagggtgttcagcctttcttcttcagcttgcagaattctccatgtttcagtttcctgataaatcagtgggcgccgctactccacatctttgaagctggttgttaagaagcagtgcttctgcagcaatcacagtttaaagcatgaatcaatttaacatcacacaagctatacatttcaacagagttacagtttcagagtaaagtgcaatatacagtataaagcgaatctggaattcaagcccaacaatgtcataaaagaggctgtgaagtctcacatgatgtgggccacagagagggttgttgccattggatcttagctcaaatactaccacatcttcggagtggcctgccatgggccacccttactaaggcaatccctctgtccaagccaaaatgatatctcggactttttttgaattgcagagagattgttgcagccagggattgccttagtaagggtggcccatggcgggcctctctgaggatgtggtaatatttgagataagatctgaatggcaagacttcagccatgtgaagggtggagggatttctagggaaaggggtcagcacaggcaaagaccctatgatgggaagaagctgggcacagcttgggattgaatgaatgccaatgtggctgaagggtggtgattgaagaggagggggagacgagaaggtctggaaggcctggggcatgatcagatcaggtgctgaggccgtggaagtagatgggattttcatctaagggaaatgggaagtcattagagagttttcaggaggggatgatatgtatttttttaaaattgagcattatcctcggtaaacttttgtagtcgttaaaccagagattataagcaggttttacctcatatgccagttgcagctgattagtagtggctatagagaatcctgggctgagaaggatactgtggctaaccagaattcagtagatgagtttgacgtggcctgttagtatgactacactgtgtgcactgtttctgcattaaatgtctgataaaaacagagccaaaggaaaaatagaacttaaaaatttaattctgacagtacagttgacccttgaaaaacataaaggttggggtgctgaccccttgtgcagtcacaaatttgcatataacttttgacctccccaaaaaactgaaccactgatagcccactgttgactggaagctttactgataacataaacacttgattaacacatgttttatatgttatctgtattatatactccattcttaccataaagcaagctagagaaaagagtattttatttaaaaaatcataatgaagagaaatatatttaatcttcgttaagtagaagtggatcattataaaggtcttcaccctcatcatcttcacattgagtgggctgaggagggggaggtagaggaaaggttggtcttgctgtctcaagagtggcagaggtggaagaaaatttatgtatatgtggactcatgcacttcaatcccatgttgtccataggtcaactgtagtttcaaaaccagctttttattactgaaaatacgggaaaaaaaactcagagaagaaatggaaagtttgctatgatccagtcatacagagaaatccatgttcagcctgttgatgcactttaaagaaggagatacgtgggtaaaacctgatgttgaattactcttacatgattttggacttttgcaggagcttgtggtgctttgccacctccaccaccccagtttgatatctttgctggcagctgggattcgtccccggatgttggtgatggagttagcctccaagggttccttggatcgcctgcttcagcaggacaaagccagcctcactagaaccctacagcacaggattgcactccacgtagctgatggtttgaggtaagtaggtcatgttgttttctattcagtgcatgacaagtgtgatccagacttgctctcaggttctgagaacacttcccagtaacactgtgccccagtaacaatttataaacaatttggatgaaaactaccatttccctgatcaaattttgtaatttcagaaaataagagtatggaaaccatgcagaacctcatagcaagtagtaatagactttgaacccacaagttctgctctagaacccatcatcttaaccctgtactgatctgccttctataaaaatgtataagttaggcttcacagtatcaaagtaagtgtcaattacatgattccaatgaggaaagatgagtccatacttctcaaggggactagagtgattcatgttggattcttcggcatgaccatctcacatgtctcagaggcacacctaaccctgcatccagagcaagctttggagagggagcacactggagtggaaaggctgtggtctttgaagacaaaaggcctgggattcatcactattccacacatttagtaactgtgattttatatctctgattcccattttttaaatagtctgtgaaccatgactaatatttaatgcataaaattatgatgacttctgtaataattggagacattccagatgaaactcttgatgtcccctctgccattgctccccaaccccagtcaccctgttacacctgagagtcaccttacattcctttcttcctctctcatttcacagctaatccttcagcaaatcttttcagctctgccaccaaaatatatcttaatgcttctaacaatttctctcactaacgtctaaatctgagccagtatcatctctcattgcctactggtcccctgcttctacctctgtctcatgatagtcccattcctcacccagcctctggagtgatttttctaacatgaaagttggatcaggacttgttcctgttattacccctcccctgccttatttcttgggtacagtgctcagccactcccatccctgaggttccttgcagataccagaggctttatatctgctgttgatttcactcaggaatgtctgactcccagatgtgctctctacttattataaaggattatctgaatctttctgaatcctttcatttaggactctcagcagagaggatgtccgcaacgaccctttgtctctccagcccctataggactattgctgcctaggattctttatgttttcattttttaaaaacttatttattgtctgtcttgccatcagaatctaagtaccatgaaagaagggacttttcgtcttgtttgccattgtatctctagctcctaaaatagtaagccttcagaattactgtgttgacagtaggggaagggggagaaaggaggaaagaaggaaaacagtgcctggggcatagaagccaagcagtgtatgcaactttccttctcttctttctcttctgaaatgctatgaatatgccttttaggtagtatccagaaatgttccttcctgaaagggtccagaaactactgaaaactgtacagattatgaaatgaaacagggtgcagggatttggatttgagttgatgtttctgcttttgaacaccagggggaatcttgggttacattaatctaggtaaagtgcagaatagtctcctgtatttcagtgccctctttccttcatttaactaactctaggttctagtttttccctaattcttccacaaatccccaaagtgtttatttataaagtgaagaattgctattttttaacactgttcgaaacaccttatctctaaaatgacttattctagttctctgaaaccttactttaaataacaaatccagcagtttctgatgaagtaaatgaaatgtcagcatattttaaaataatttgcctaatttgttcttagcataatgccagaaaagctttctggattttgtatcacaaaaggctagtagatttcagtagctatcaatcttctaccagcactaagtatattttaaaaactcagcattaaggtttatttttccaagtatgtttcagcacaggaaataaaatcatgctcctttggagtcccttaaatgctggagctgtttagagtgacatacaagaactttcttcacgttacatgctctctcttcctccatcttgcttttaactgttagcttacttctccaattcaatccacttcgtttgaactctttatcataattctataaaacttatgaaaatacagtcaactgcattttctgtatgtttctgtgtttcaatatcttcaaaatggaatgtactgccttggtacatcacccactatgaatctgttatttctgttatatcccacagttgccaggccaggatacttgtcccatccaggccaaacaccttcccccgaaagcaagtatgcatttgtccaccaggtccttgactctattttacattatctttttagtcaattcatttatttttatgccactcctgctgtcttggttcagtatgtccagggaattatcagaatttcttttctaaaataaaaatctgtttatgcttgcaattccttgacagttctcaattatctgcaaagtgcatccaaacttcttggcatagcatcaaagatctttctgtatgcctcttgcttccctttgcggcccctgccaccccactgcccacactgcattctagccgtgatgacaggcttgaattttcagttatgctcatgtctgtccatcattgtatttgttattcctctctttccaccaagttgtctgcctagagagctcattttccttaagaatttcttcacaaaccatctctactatgaagctcaagtgtgtcatgaagtgttagcttctccaacttgtgtttcttgcagacactctgtgcaagacattgacttaggtgctaaagagggaaagctagatattatattgttcttgaggttgaaagcttacagtctagtaggagagtcaactttgctgtctttacctcagtgtttttctccctctgtgcttccctagcacgtggtacttacatatttctggaatcttgattaaacacctgtttgaggactgtctgagcacaatccttctggattgtgacaccctcaagggagcagagatacaaagatggctttgtatactaaatgactggccctcatagatacctagtacatatttgtcaaataaatgaatgcattctatttttggaataattctattcagaatcagataaagtttactttaagctatgaagaaagaagtctcttagcaactcttacaataatcacaatcaaagaatgactgtttaacttaatataaaccagtttgttttaataaaatatttgacaatagtcatggttacacaatgcataaattatggctaaattattatcaggaaggaaaaatctttacttattatttcaaaagctattttgctagtctattaaaagctattagaactgcacttcttaagattaaattctataattgaacattttaactaaccaagatattatctctttgccactgacattatttcaaattaagcttaactatttctttttagcctttggaaagtattctgaaagagtctgtgttctataaatatacttaaagaggcatgtcttataaaggatttggatactattcaatgatgtatgacttggctttagcttttttattcttaatctctcagcttttctcttcagcaggggaagagtacctaatggcctttcagtaatcccttggtaaatttttctttcaagcccattacttactgtgaaggtcaacttcattagtgtatttatcttatttttttcagcccaaaataggtatattgaaatgaatgggcctaatgtcaaatgtcccgactacatcctggaagagagagaatcttcagctgtattagttgatgcagttaaataatatgtactctccaggccctcatacaattgaaagttcagggtatcgttgctgctctgcttctaatccttccagaagtgattggtgctaggtgatggagtaactattaattgatataatgtgagccaaaaccaacagtcacgaataagcaaaggatttaaatttaactccattaagtcttgtgagaaattattttcaacataggttataacatacctgtgacatcacatgaaatgctgtagtcaatttgacatcatggggcagagaagacagagttggaaatcagaattttatagacatctaatgtgataataacattagtagctgagatgcggtaagctctttgaccatgtttccagaatggataagacctggttgagatgaaaactttacactgtttttttatattaactatcttttactctttgcctgaaatgtccaactctagttgctcgtgattgcgtgggtcagtctccagaaggttggactttaatattacccgtcatcttttccaagacaaaattgtattcattctaactcttagccccaaattttcttttttaaccttaatatctaacatgattaggtttatggtaaattatatactcaaacagaagaagagactaatagcaagcaaaagtcttatattttcatttgttttcatccaaaaagtagaaaatattttccaaacattgggaaacattttagtcagaaaaataaatatcaatgataaatagaatagagaaaaattttaaagctgagctaaacctctatgtggttttaggaaaatcaaaactattaaataaatggcaagtacaacaaaatcccatcaattcttatttaacatacttacattttgaaatagttaaaatattcatatgatcattgagagaattcagaattgcctttaagtaattgttcacatatacaaaagaaaagtctccaaaaattgggtctttgcctgagatagatttgtcttaaaattgaaatcattcacttatcagatttgacccttttttaaagcataactttgctgtgtaatattagacttatatgttttgatttccttctacaatatctcttaactttaagggacaaagtgagcacagaatttttgatgcttgacatagtggacatttatatttaaggaaattaggacaaaaattattataatgtaatcacatttgaataagatttcctgtgcattttctggcagatacctccactcagccatgattatataccgagacctgaaaccccacaatgtgctgcttttcacactgtatcccaatgctgccatcattgcaaagattgctgactacggcattgctcagtactgctgtagaatggggataaaaacatcagagggcacaccaggtaggtgatcaggtctgtctcataattctatcttcaggatggataaccactgacctcagatgtgagttcagaagagtcaaaaggaaaacagagtctatcacattgtgaacagaggtttattttgtgaaaaaatgcaagcatcacattgtgatttttatcattgtattttgtaggaaaaaaacaattgatgtaatttttcagggcaaaaactgaataaaaagaagagaatgtttgatatcaagttatatgttttaaagttagatttgtagattctttagatactctagaggtcataaaaagtaacagcaaaaactttagtctaggtattgttggcacttgtgaggcaaatcaaattcaggtccacaaattctttttcataattctgaaacccaaagaactctgaaaatcccaagattttttaaaaaatgactaatttggtgtcaaaacctaagcaagctgacttgttgcttattacaatctttatttctcatgctcagtgtgaatatgcatacattttgctgcagaaatatatacatgtttgagtacagggggctggccgtgaccctactgagggtttctgtacacatcactgtctaccctgtggaatcttacctccctttcttagttcccaatcctgaaaagcagttatggggccagtgctctgtacagacatgttgtctcagacatcagtttgagcaggaagtaaatcatttaggggttggcatttgtttggagtgtggggaacactctatctttagggaaactttatatagttagttatttgtaagtaaaattacaggtggctatacatcatcttgctgattgcaactcaattaaatcaccgtgcctggcacagaagaaaatatgctacaggatatctcactagggaaaaggttctagttcgtttcctgcgcactcaacttttgtacttagataagcaaatggccccagattccaatgcctggttttatttttgctccaaatacatatatactcttttgttttggatagttacattttagaagtagactgtgtattctcataaacacttcaaagtgtatgttctggctgagagtgtctctgtgttgttcaataataataagactaattatcattttttgagtacctgctgtgcgtcaggcccagtgccacgtatattagagacaagatctcttatcctcatgccagggctggaagttagctattagtttctcatttgccaaatgagaaaactgaggctcagggagattatgtaacttgcagaatatcactcagtaattggccaagataagaattcagtctaaatgagaaccagatccagagatatttggctttaaattctatagtctctcctaaaccatatgcaactctaacatgaagaagcttatttaatcttcactattaaaaaagtcaaaacaaaacaacagagccatgaatagcaaatattgtcaatgagaggtttggaaaaacagtcttaaaggatgaaattccatagacctgatatatttccacctggaaaaagtgggcatgggacagtgattttctcttgaaagatctgctcatttttgtcatgggacatgaaggtggactggaccactcagtttcttctttctgcatctcccaacccagtctttctgttcatggggtgaaaatctgttgttgaagccttgtctgcttaattggacagtggatctctcgggtccctgtgggctgtgcgcttgtacttgagctctgcttcttcactctgtggtctaggccagctagcagccagctgagttcaccttggttcagactcatggcctttcattttcagtatctgacttcctggttttgctgaaaacctgtctaaaatgtaatatccatctgattcttcataccaagccacacaattcttcctgatcccttttaatctccaatattgaatggtggtaacataaatatggagacagatcatgtcagaaacccagggcctaatcttttcttttctgcctactcttctcacaggctgcttagtactttgtaagctttttttttttttctggctgtaacctagattttctctttatcattactctatttattattgttagagcacttctgattatctcagccctaaactctgcctccaattttaaataacaataactcccactcctgctaatactgctactactactaccatcaccaaactttttcttccccaaagcagttctgtttgggaaggaaacagttccctctcatacaatttcagttatcttcttgtcttttccgtttaatgaatcttcctgttaatgttacatcttttaacatggaaacttctagagaaacaaaagacgatggatttgttaaaccttttgggtgtatttttatactaactcttactgcagcgtgtgcattatgagtgtaggtccattacggctgtattaggagcagaaccttccagagcatgagcgatgtgctgggcttgtgcttagctctatccatgagttaagtatctcaatccttaggaccctctgacatatgtgctattattatttctagtctatagatacagagactaaagtttagagaatataaaaaaacatttacaaggtcctatgggacaaaaactgtaggacaaaatgcaaacccaagcagcctgagagcagagctcctggtccagcactgtgatagctggggacgcagagacagaaacaatgcaattattgacagggaccatggtgctgtgtctgtccacattttgaagataattatggtttggatattttcacctttaaataacttggagagtttcaacattaactcagtcagatggatacatttatatcatatcctgctgggagtgacagttaattctgggtcctatggcaattgcacttttgactgagatgaatgctgactgatggctttaacatttaactaatgcgatagtatttaacacacccatataaatactatagtcttcgggtaaataaaatgttaccggctggacatacatgaatatctgatggagattatggaacatactctactcatacttctctgaaagtaaaaaataaaagatatgtttcagtacacaatgtgatatgtactcagacttaattcataaatttctcttatccttcatccgtggatcttttctttatttacttattgcgtttgttaaaatgcaggcttctctgaaaaattatttttaaaaatagtttttagacaatgaatcatattttctcaagtattttaacattgtaatcattatgataattatccaaggggaaattatacttattttttattcatttattcattcatttggcaacaatacattgaacatttactaagcatcaaactggctctaccacttaatagtggcatgatgttcatcaagaaattgttagtgcaatcaagaacactagaaattcattggatgaatttaaagaagcttttagaagggtattatattataattgaggcactttatgaatatataaataatattatgttttcatgctagagatcatgccaatgaagatatttactttgaaaaggagaagattagaagtttaaaagcatttccatattgaagtaaatattcatttccatatcttcacagttatctttctctgagttctctgactcattgtgaaaaaaaatcccaaccttcttcacagctctaccatcttcggattgttgcctagaggggtaaaaactattgtaaaaggatgtgtgcactggatgagaatttagaattagacgaaatgacccctagagtcttttcctgctttaagagcctgtgattccaaattctaacagtacatttatcaagaaaaaatatgctgaacatttaaatagtttttgaatagtacctagatataatagatacctaataaatgtgctcaatgaataataaataactggttaagatttaaataagcctccaaaatctcttccacattctaagaagggaagcataaaggttgttaatgaactagtgactgtgtgggtagctcattatttttaagtactcttgactttgctgttcattatctgtgtggccttaggaaaatacacacatttctgaaaggattatgtcgtttgtaaaatagaaagtccttatctgtctaccacagatgattcttatgcaaatcaaatgaaatgttcaataaggtgtctgtaaaatagtagagagagatgaattaggagctattgtgatttgtttacattatgtcacaggtgcactttattagggatatgttttatcttaattacacaattctttaacttagattttgagaattatattatggttatataggaaaatgcccttattctaaggaaatgtataatatatttaggtctgaaacattgtatctgtaacaatatagtatgtaaattatgctaattcacatgataattatatgtaattatattaatatattactatgtatacaatatatttacatgcatatatgtggggaaatgttatcagttagtgtagtaggggttatcatactcaaattcgatgtctccatccttccaactcttcatgcttttccagcatggtgaggactgctgagctccatcttttgctggtagtctctctgtcaaatagaactgtttccaaattcagtcatttgctccttgaaggctatgaattcatacttcgttatatttttctggctgcatatttaaattactttaacaatcatataagttcattgtaaaaattttggaaataaaaaggaagataaaatgcacagataattttagcaaatgaaataataattatattgggatgtatttcttcctagattttaattatgtacattcccatcaactttttattttgaaaatgtttaagcctaaagaacagttgaaagagtagtacaggctgggtgcagtggctcctgcctgtaatcccaacactttgggaggccgaggtgggtggatcacttgaggtcaggagttcaagaccagcctgaccaacatggtgaaaccctgtcactactaaaaatacaaaaatcagctgggcacggtggtgggcacctgtaatcccagctactcgggaggctgaggcaggagaatcgcttgaacccaggaggcagaggttgcagtaagccaagatcacacccctgcactccagcctgggcaagagagtgagactccatctcaaaaaaaaaaaaaaaaaaaaaaagaaagaaagagtagtacaatatacattcatactcatatacccgacgcataaattcattgattatttactttttgccctacttgttctttcttgctctctttgcgtatgaatgaatcattgaaattaagttgtagacatcatgccatatcacctctgaacagtgtgtatatttctttagaataaggatgtttacttacataatcataataccattatcacagctaagaaaattaattcagttgattttttccacatatttgataactttctgtctatccacgattatgtcttacatattcttttaatttatgtcatagcatatcatcttagaaagtgatccctaagttactgcatggtatacattgtttaaccatttccctttgtgattggatgtctttaggttgattatatttttattattatcacaaatgttgaaatcactctttttttctgaagaatttaaaagtaatttatctgtcttatggaataaaatatttatttccccttaaaagaatttcaggcatgaacccaagagagaaggcttttttttttgttttagttgttgtttttatttttattttttattttttgggtagaaggagcagagagacaagttcaggaaataatgagagtgttagaattttgttcaggttaaagtgagttggagtgaagtttagaaatctcctttctactcatctctcctgtttttaaaacactgtcctggaaatagttaatattaggaacgagaaaaatggtataggttttcctagtacactttatttcttaattatgaaattctacttaataacttaccattgaatgtttatccttattatcattcaaggtaattttattgaagattgaagatatttataataaagattgaaggattttattgtcctgtgtggtcaaccttggggggtgagatgttatgagacaggacaattaattgacttgatcaaggtaccttgttataaaaataacacagcctggtttagaacatctcttcctgactctcttatttggcatatagcctaagtgtatgcctccttggatgtatgagccctgatgttggtcatatttattattttatctgcttactttcagggtttcgtgcacctgaagttgccagaggaaatgtcatttataaccaacaggctgatgtttattcatttggtttactactctatgacattttgacaactggaggtagaatagtagagggtttgaagtttccaaatgagtttgatgaattagaaatacaaggaaaattacctggtaagttctgttttctctacaatgaagattttttttcttaatatcagcagcttcatttttatttaattgtagttgtatgcttaattccttaaacagatgatcattttttttgtttagtgcataaatattcttaaatcttgtgatatattaataaaaatcacctgaaaaaggtagcagttttaggctttttaaaaaatccgcaattaatattggtgtagttaatattatatttagaaacatagagaaggaaattgctgttagaactccacatttggtgatttttaattttcataaagaattactgtgtactcattatcctggaatgttttcgttttcttggagtgaaataatttacatgcaggaatggaagactgaatgatctataataataatttttcataagaatcggtaaatgtgtatttaatgttatcaaagctcatttggaatggttgtctcatgctttcaagaaattagaggactttgtaattcattccttaaccattactttagttctcaccacaaaataacattttaagtttatttagctctttctcatattttctgctttccctttcatttaaaaaatacttttgagtgtacacaatgtgccatgtacaggaaatagagctttatcttttttgggtataacttcaagatcatggcaaaagaaaacttattattaattggataaaccttagatataatctaggttatttcccttattttactagttttctagtgaaaatattcaggtctctgctgggtacagtggcttacgcctgtaatcccagcactttgggaggcccaggcaggcagatcacttgaggccaggagctggagaccagcctggccaacatggtgaaaccctgtctctactaaaaatacaaaaagtagctgggcatggtggcatgtgcgtgtagtcccagctaccaaggaggctgaggcacgagaatagcttgaacctgggaggttgcagtgagccgagattgcgccactgcactccagcctaagcaacaaagtgagactccatcttaaaaaaaaaaattcagttctgtgttctgcatcaaccagaataagctacgcctcttataaaaaacaaatgtgcacaaaccatctgtgaggacataaggattaaatgcttgcttactttgagtattaaaataaaaagtagaagctttattatatgagtaaaagtgtttccaaagtctatttgaaatgcaggtacagaatgaaaatctgttattttattaaatcgttatttgggtctctttttattccataaaaaaaaaatcttttccacatctcttagtggagatcaagttaacaaaattagctttaattttgtgacaagtaaatttacataaatataggattatggagataatatttttctttgcaatgtctggaccttttataaacattgagaggaaatataaccattcttacttatttagtatgctagcatgatgttttttaatgttttagatccagttaaagaatatggttgtgccccatggcctatggttgagaaattaattaaacagtgtttgaaagaaaatcctcaagaaaggcctacttctgcccaggtattcttaaagttttgttaatattttgtacagaacatcatttgcatatatgcatatatatataatcttcaaatatatatacttaaacacataaacacacagagacagaattaaaaatagttataaggcaaacctcctataattttcaccatcccaggcacaaaaaaaggacattgccaaaacctcacatgctcccatatgcctgtctcctcttctcttctttgaaatgcctgcccattattttgcccatttttctgttgactcttttgcctacaaatcaaatcagaaaaaaatttttatatataacatactaatcctttcttggttttatatgttgcaatttctttttcgagctggtggcttgctttttaaatttcttgtagggtgcccgttaatgaatggaatttcttaattttaatatatataaatttaacaattcttctttttccttcttttcctggttattcctatttggtcctgttgtagagcccatctttcttttagagctacaaaaatatttacctgcaatttcttcaaacattttaaaagtttgcttttgacaagattttaatccattggaattgacatttttatctgtatcccattcctttttttaatgtggaagactaattttttcaggttgatttactaaatggcttctccccttttgtcccatagatctgatgtgtccattttgtaatttattaaagataatgtgcatatccacgtgtacactgtcttccactgatcaactcatttatttttcctccagtattaccctgtcttaattcctgtagctttataatgatctcctctccctatttatttttctcatccaggaatattttaaccagtcttaggcttagcttttctatataaaatttagaatcatgctgtcaaatcttatgaaaaaccacattgtcgtttggattggtcttggattgaatatgttgacaatctggagatgatatccttatgatattaagtctttgtattctttttcttatttatttatttatttagaggcagggtctcactctgtcacccaggctggagtgctggagtgcagtggcaggatcacagctcaatgcagctttgacctcctgggctcaagtgatcctgtcgcctcagtctccatcagccaattgtgtgccaccagacctggttaacttttcctttaatttttttgtagagaaagggtctcactctgttgcccaggctggtcttgaactcctggcctcaagcaatcctcccgcctaggcctcccaaagtgcatgagcaactgcacctggccaagtcttcctattctggaatggcatgaattctctctgtttacttaggtcttctcaagcgtctttcaataaagttttgtaatgctacatacaggtcttgcatatcttttgctggattttcttgctgcaaattgctttaaatgcagttcatggcttgagatttgttttttaactgcccagttaacgtaaatctggtctatgaattgtattgacaacaagcttgtgagtagcaatttttcagcaaccttttgctccctctccccgctccctgcacagtcccagaacaactttccttatataccaatgaaggtggaaatgtggacaggttgatttctccttcttgtttatgctgaatatgcagtcctttggggtcccagctttataggtacagtccctttactaagactgtctatcttgggaaggccctagactccaacttctctcccatgggccccacaaagcatccaagagtatacatttatattatctcactttgtcttggcagacaaatgtcttcagggcaagtctggctttaggggtccactgacctctctggtttctgtctctcactgtgatttcggcctgataattccttatggtgtcagatcttcaatgtttttaatacattgtttttaaaaaaatcatttagcattttaaattgtttttagttggaagatttgcccaagtaaccttgtccaccatattatctgaaagagaactcttgtcatgttttacactgatacacattttaataaatgtgggttatctttatgttgtgagctcttgatttggtattataattaattggaaaagttttaactttaagtattctgatcaaaatagtcaagtacaactataatgactttatcaaatattacataatttttcttctacttggtttacttgttttttaatttaggttaccatcaatgttagtcacatgaacttttatatttatgtccacagtaaaaatttttcatagcttgttgtttttctttcttgttttttcattttcaattatacttcacctatacttaacagaatacttaacaaatatgtatatatatgacaatattaaaaagcttagacatacttattttatgtttaaaatataacatatactaggcaagacaggaaaactcatcacttttatgaaatgaggcacagacagagtaatgggctttcttggtgtctcctgagtggcgggcaggtggccatgtcacagctctaatcccagtttcctgacttctggttctgttttcttacggtgccttcacactgtctctccagatcaaaaacagaatctagagatgacttctaaattttgttaccaaagactgaaattcctgttcctttcaactactagaagctcaactaaattgttggcccaagggtttttctctcactggcggtggctctgcaatatagaattgcatgcagagtacctcctgactccgctaaaatcctgtttaattgacccttgagattttcttttcaagttaaaaaaaatactacacataccaaagagtatcaagcacagtttaaaaatacatatttgtcttttcatgtaattttatttgtagtttagattactaatcttggtgatctagttgggttccagtttaacagttttaggttttgcttgacagagctataacacttcagtctatatttgatttttcaagggaaatgagttaactcgataagtactgttttgttatctttaaactttctcaggtctttgacattttgaattcagctgaattagtctgtctgacgagacgcattttattacctaaaaacgtaattgttgaatgcatggttgctacacatcacaacagcaggaatgcaagcatttggctgggctgtgggcacaccgacagaggacagctctcatttcttgacttaaatactgaaggatacacttctgaggtaaatccaaatgctctttaaatctttcataatttaaagcatataccatttggaaagttacttaggaataaattaaataagagccaatgtaggattattattcaattagccttctgttagaacaagagtattcaagagcaaatgtgttttgctttagaatcacagcatatgtcttagctcagggtccctagaaacagagcctgagatgggttatcttgcacaagtgatttaaggaaagagaatcttagagagaagtagaggaagccagaaagggcagaggaaaaagctcagcagaaatgtggtttctgaagaggtccagcctcagtctctgcccacaaggagctctggaatatgaataggagcacagaattttcccactgccaggcaagggagccagtctttcattctcacatattgttcagtcattggctgcaatctgctgggaggtgggggtagtgtaactttcaaggcatttctgggcaagctgcctcctgtcatctgagggtattctgtgataaatagcacatctctgaactatagtagccaacactcagggtagctggggatggcgtacctgatggataaaggagatctggacatggctcctaaaagtggatcaatacattgtgttggcaaatataagataagtttctagacttcaaagacaacctagtattttgactgctgcctgaagataaatattgtgcctcaacattagttctgaggttaaacaatcttttttttttaattgatcattcttgggtgtttctcgcagagggggatttggcagggtcataggacaataatggagggaaggtcagcagataaacaagtgaacaaaggtctctggttttcctaggcagaggaccctgcggccttccgtagtgtttgtgtccctgggtacttgagattagggagtagtgatgactcttaacgagcatgctgccttcaagcatctgtttaacaaagcacatcttgcaccgcccttaatccatttaaccctgagtggacacagcacatgtttcagagagcaccgggttgggggcaaggtcatagatcaacagcatcccaaggcagaagaatttttcttagtacagaacaaaatggagtctcctatgtctacttctttctacacagacacagcaacaatctgatttctgtatcttttccccacatttcccccttttctactcgacaaaaccgccaacgtcatcatggcctgttctcaatgagctgctgggtacacctcccagacggggtggcagccgggcagaggggctcctcacttcccagaaggggcggccgggcagaggcgccccccacctcccagacggggcggcggccgggcgggggctgccccccacctcccggatggggtggctgcccagcggagacgctcctcacttcccagacggggcggctgctgggcggaggggctcctcacttctccgacggggcggctgctgggcggaggggctcctcacttctcagacggggcagctgccaggcaaaggggctcctcacttctcagacggggcggctgccgggcagagggactcctcacttctcagacagggcggccaggcagagatgctcctcacctcccagacagggttgcggccgggcataggctctcctcacatcccagacggggcggcagggcagaggcgctccccacatctcagacaatgggcggccgggcagagccgctcatcacttcctagacgggatggcggccgggaagaggcgctcctcatttcccagactgggcagccgggcagagggggctcctcacatcccagacgatgggcggccaggcagagacgctcctcacttcccagacggggtggcggccgggcagaggctgcaatctcggcactttgggaggccaaggcaggcggctgggaggtggaggttgtaggtagccaagatcacgccactgcactccagcctgggcaactttgagcactgagtgaacgagactccgtctgcaatcccggcacctcgggaggccgaggctggcagatcactcgcggttaggagctggagaccagcccggccaacacagcgaaaccccgtctccaccaaaaaaatatgaaaaccagtcaggcgtggcggcgcacgcctgcaatggcaggcactctgcaggctgaggcaggagaatcaggcagggaggttgcagtgagccgagatggcagcagtacagcccagcttcggctcggcatcagagggagacggtggaaagagagggagagggagaccatggggagagggagacggagagggagagggagaggaacaatcttcttatatggtttgaaggaatgagaattcacactgaaaaataatttttaattttagtttcagatgtcatcttgataggcaaaacttgtctgccaattaactcatttattgctgaaaattaaataaaattggcattgtttttaaaagtaatgcaagaaagcaaaaagagttatgttgataacagaatcctttattctgtacaagttctagttgcttaagcttaaatcaaatcctgctaagtatattttcttttcttaacaggaagttgctgatagtagaatattgtgcttagccttggtgcatcttcctgttgaaaaggaaagctggattgtgtctgggacacagtctggtactctcctggtcatcaataccgaagatgggaaaaagagacataccctagaaaagatgactgattctgtcacttgtttgtattgcaattccttttccaagcaaaggtatggtagtgaatttgatcaatggggaaattacagatcttttaaacgactgaattgtgtgcataattgttattgcatcagcaaagattgttcatttttagcctattttcattggtttgcatatattaaagggaattgtggaaggtcacagagatatttgttgtttttctgaatacagatctagctgagacatttataaaataagtcaaccatttattcaggcctaccagccctgctcctggtattacctcaactgtggctctatctctttacttctcctcagatcaatgaatctttgtagggcctcttcaaggataaattctcattcattcattctttgaaaaaaaaaaaatatatatatatatatatatgaaacccattgtgtgccaggcttaaacataccagttatctaactaccaaattaagaaaaaaattaaataaatgaattaataaattcttaataggtgaaaatgacttagctcttatcaattgcagggttcttgtcccaaagaaatatatctacatagcaaaatttcaggtgtgagttgtaggttggtgactgtaatatttggggcaggatgatttccaggaggcattaagattataccctatatatttctctggtttaagttagtattggaaaaaaagtactagaaaaatgtgaagcctgttttttgtacctgaaatatcaactccactggcagtttcggagttgaaattatttgaatatggtcaaagaaaaatttcaatggatggaattgggcaaggacgactttattcaagcctatcacagcaggggagagagatcagactgaactaaactccactgaaacaaaaggtgggagagttttaagcgcaggggtgagctaatggaaacgtactggagcaccttgttggaaggaagtgggagcagttgtcaatgtgattaggccatctgtgtttgctaattgtcccttattgaaggtaggctcctactctcccacagacactggggaattccttccttccttccatccctccctccctccctccctcccttccttccttccttcttcttttttttttttttgaaggagttttgctcttgttgcccaagctggagtgcaatggcatgatcttggctcactgcaacttccacctcctaagttcaagcgattctctagcctcagcctcctgagtagctgggattacaggcgtgcaccaccaaacctggctaattttttacatttttagtagaaacgggatttcaccatgttagccagactgatctcaatctcctgacctcaggtgatctgcccaccgcagcctcccaaagtgctgggattacaagtgtgagccaccacgccaggcctctgtcttgataattacatttcaaaggaatggctcccaggtccttggaaaagacattcttggggtataaaactgggaagagtctgggaaaaggggcagagaaagaatttataattccaagtcttctaaagtaaatactctaagaaaagggaggttaggaatttatagttgagaagtctatctaaagtttaataaagtggaggagaacattaaggccattttagtcaacatacatgttctttttgtaacaatttcaacatttttccttttagcaaacaaaaaaattttcttttggttggaaccgctgatggcaagttagcaatttttgaagataagactgttaaggtaaatgttgaatgcattctacatctaaatttattttaagtcttttgttttatatatatctcacacccctcttatgggattataaactccctgagagcaagaatcataaattatgctgtatttgtattgcttcataaaatcttgaacacagtagatcctctgaaaatacttgctgattgactgtatattttatatgaatgaactaagaataaaatgataaatgacatctgattgataatattgggaatggaaataattcaatttgtacataactgaggcagataattccttataaatatattgtggaaaaaaaacaaaaatatacttaagttttaaatatggcttgccattaactttttcttaagcattgaagaaatcatttaattttcttttcttcagattcctatttagtcattaaagcattcatttctctatccatctattcatctttggttccatctattcactcaacttcctacccgttcattctcctattgccaaaaagcttattatctgatgagagacagggaagtagagtataacccttaggttatttcttttgtaatttttacatgggaaaaagaatagattgaatgtaacaataatatttcgaatatgacctaaatttttttatgtataatatttgtacatatttatggggtacatgtgatatgttgttacatgcatagaatgtgtaatgatcaagtcagggtatttaggatatccatcaccatgagcatttatttctctgtgctgagaacatttcaagtctcctagttattttgaaatgtttttaactgtagtcactttattgtactattgaacattagaacttattcctcctatctaactgtatgtttgtacccgttaaccagcctcccttcatcctccccttctcccacacacccatatcctcccaagcctctggtaactatcattctactctctacctccatgagatcaacttttttagctcccacatatgagtgagtacatgtgatatttgtctttctgtgcttggcttatttcacttaacataatgacctccagttccatccatgttgctgtatatgacatgatttcattcctttttatggtcaaatagtattccgttatgtaaatacacacattttctttatgcattcattcattcatgggtgcttaggttgattccacttttttttttagctattgtgaatagtgctgcgataaacatggggatataggaatccctttgatatactgattccctttcctttagattagtatcagtagtaacattgttggattgtatggtagttctatttttaatttttttgagaaatcaccattttgttttccgtagtggctatagcaatttacatacacaccaatagcatatgggcattcgtttttttccgcatccttgccagcatgttattttttgtcttttttataatagccattctaattgggtgaagaagatttcattgtggttttcatttgcatttttactgatgattagttaatgttgagcattttttttcatatatccattggccattactatgtcttcttttgcaaatgtctatttagatcctttgccaactttttgttttgttttaagacagggtcttgctttcttacccaggctggctcacagtggcatgatcatagcttgttgcagccttgaccttctgcactcaagtgatcctccaacatcagcttcacgagtagctgggactacaggcgtgtgctaccatacctggctgtttattttttgtagagatgcggctccactatgttgtccagactgatctcaaactcctgggctcaagcaatcctcctgcctcatcttctcaaagtgctgggattacaggcatgagccaccatacccagccctttgcctacttttaaatggagttcttttttttttttcctgttgaattgctttttcgagtttcttgtgtattctggatgaatagtttgcaaatatttcctcacatttaatggatcctctctatattgttgatagtttcctttgctgtgcagaagctttttagtttattatagtcccatttgtctaattttgtttttgttgcctgtgcttttgggatcttaaccataaactctttgtctagaccaatgttctgaaatgtttcccctgtttccttttaatagtttcatagcttctggtcttacatttaagtctttaatccatcttgagttgaattttgtaaatggtgagagagtggggcctactttcatccttctgcatactgatatccagcttttccagcacaatttattgaaggtggtattctttctcccatgtatgcttttggtgcctttgttgaaaattagttggctttaaatatgtgggtttatttctgggtcctctacattggtctacctacctgtgtttttgccaatactgtgctgttttggttactctagccttgtaatatattttcaagtcaggtagtgtgatgcctccagctttgttctttttgctcaggattgttttggctattttggctctttttcggttccactcaagttttagaaatttttttttctatttctgtgagaaatatcattggagctttcatgggaatttcattgaatctgtagattgctttgggtagtatggtcattttaacaatattaattcttccagtctgtgagcatgaatatctttccatttgtttgtgtcctcttcaatttctttcatgtttttcaggtttccttatagagatcgttcatcatctttgttaaatttactcctaggtattttattaattttttgtagctacttcaaatgggattgctttcttgatttttcagctactttgttgttgttgttgtatagatatgctactgatttctgtatgttgattttgaatcctttactatactcatttatcagaactaagagttttttttaatggaatctttaggtttttgagttttaattttaatatctctaatcatttaagatggaaagtagttttttgaaagcacagattttatggagttttgttctgtggatactcaatttgctgagtgtgttttcttttttttttggcaaagcttaaaggagctgctcctttgaagatactaaatataggaaatgtcagtactccattgatgtgtttgagtgaatccacaaattcaacggaaagaaatgtaatgtggggaggatgtggcacaaagattttctccttttctaatgatttcaccattcagaaactcattgagacaagaacaagccaactgtaagttattttttatctgtacaagtaatttatcattatacttttgttttttccttataatcattaataatactgttgataattcataaggaagatcttttaaaatgcataatttattttctatcataaaattaaactttcattataaaaaattttgaaaattccagaaagcagaagggtatttttaagaagtcactcaacctaatcacttttagggataaaatatgtaaactcattgtaatcttagtagtatttatcaatctaaattttttaacaatttttattatctgtgtttcaaattagacatgaaattggaagacaatcaactttgtatttcaccaaattcacggactatacatatgcaatttgggtaacttccattaagtattgattgtaggaaagatagacagcaagtattcttgcttgtccaaagttgtttctagatttgataattatacagatgtctactcacagccaagttagtgataccagtttcaaacaagaataaaataaaatattaatataaacctctttcaagtttgctttttttcagtggtattttaatcaaatctttgcagttggttcttatttatcacattcctcagtgataagcagtataggattgtggataagagcataaatcatagttcagatattgctttgccatctattggttttgtgaacttgggcaataacctttcacatcttcagtcatctcttacctgaggattgtaatattctctatctcaaagagatatttggaggagtaaataagaatgttaatatatggatcttaattaacataatgaccagcacctggtaagctgtcaataaacattagctattattattattattagctttgagtcacaaatccctaccttagggaatatcctggtttcccattatccatcaaatttcccaagattggcacttgggagtaatctttgactcctttgttttttgctccctttatccacttgaccctcctaattgtcatttgaatctttgtacttctcactgttctcagtgctggtaccatgggccagactgccatccattatctgtggccacattaacaagagcatccagttctcaccctctgattatactctcttcaacatattttcagcattgcagacagagggacctttctaaaatgtacatcaatctgatgcaattttcctgcttaaaacccttcagtggtatcccattgtcctttatatgaagtccaaattccttaagacagcctactgggcccttcataattcagtgcttgcttacctgtctagattcatattttgcaagctttttgccatctgtgctttacccaaactgaaattgactcagatctctaagacaacctgttattacctttcacccccaacctttgaatgtggtcttctccttacctggatgactattatgccccctgcctatttcagtccaagcaccacttgctctgagtggcaggttaggtgactttgtgcttccattgcatctaatgttttccttcacagtagctataattgtatttgttaaagtagtttctcaataccactaaatctactggctttcaacattggctgtgcatttagaaaccactaggtagctgaaaataatatgatacctgggccctacctcagaccaattaaatcagaccagttaagcctgggatggggatcagattttttttttcaggttctcaagtgattctaaagtatatttgaggttaagatatactgcggagtgcagtgtattataagttcccatgaatgaggatttttatttctgtctttacatatttatttactagtatgtggttaacatttggatcaactcattctcattctgtaatacccacattttaaaaaatgaatgtaaaaatgtcttttattatttttatttttcaaatttaattttagattccaggaatacatgtgcaggtttgttacaaaagtatagtgcgtgatgctgaggtttggaatacaactgaactcacaacccagaaagtgggcatagtgcttgataggtagtttttcatctttgctccccttcctgtaatttccacttttaacccaattatacaagcctgaaaacctttaaaaagaaagggcctccagtttatttttttatttcatagcacattttatgggattatggatatcagttaactctttaaagttccatataagatttggagcatagatgctttactagagagcatccataaagatcaagctctcaaagatgctcatctcccaaaagagattgggacctagatgcataaacacttaaatataaatatttgctctcttctgaacaagtatctcctgtggccttggtctctaccccacaaaacagacatcacatcactaatcaggggttgcctcatcatcagtaccctcatcatcatcagtacacaccgactgagaggcatgttgggtaatgaaagatgactgcctttgaagccggaagactccataggacttttggagttctaggtctgcaacatgtttttagtcctaggtcggcaagcatgatgttagtcataggaccttgagcaaattatttagcatttgtacatgtttctttctactattaaaaacattgagatttatcatattttatgtttttttattaaggatcaagcaagataacacacaaaagtattttataaaatacggaaattccatgcaaaactttgtcctaattggaactattttctattaaatacagcaaatatccaagaaggaattacctaaagcgtagtggctctctgacaacacatcatatttttacctccttttccagaatagaaagaaaagggggaggaaaaaaaatcttcctactctaggatatactaatgattgttaaatctttatggtattttcatgttatctatctgatttaaatgcaattttgactatttttacatattcctcgttgttcattcatactgtagtgccttcttctattcccccacttaacagactgcttgattatatcagaggtgcttatctgtgcaactgtttactggacgaggggtatgtagaaaatacattgtcctcatccttatgaaattacactcataatctagtgtgagggatgcactaataaagacaattttatatttaataaggtctataatatgacagtgacaccagtggggaaaagggactggttggtctattttgataggtcagggaagaaatccagaggagccgacatttaagttcatcctcaaaggccaagtaggagtttgccatgctgatgtggcccaaggtagccaatctgtttgtgaaatatgtacaatgccagatgtcttaggttgaaagggaaatattttaaggtgttcgtaatttttctttatgtttaaaaggggaaaatggcaaatattttactttctgtttatgtttggatgatgtggatttttgttttctataatttgactggcttaactgcaaagatatcccttgctttaaaatttgaagacactgcaactaaattttatttcagcattttatattttataactctaggtataaaaggctaacacttaattttctgagcattcatgaaacaaagttttgcaagaacattcaaaagttacagatataatatttccttcagaaatttagatatagtacaaaattctacaaagagccacatagaattgaaactaaaagtaagaccaaagtaaacattggacataatctttattttattatcacaagaaattaatataaagtaaccaaaagtaagtaaagtaccaaagcatgttatatattcaattcagaatggttagggaagaatatgaaataattgcaatagtctagcttgtttagttttcaaaatagtgtttttacattaagaactaatataaggttgtattacacgtagaaattttaagaagaaaacaaatagtgatgactttctatttttttttctctgtaggttttcttatgcagctttcagtgattccaacatcataacagtggtggtagacactgctctctatattgctaagcaaaatagccctgttgtggaagtgtgggataagaaaactgaaaaactctgtggactaatagactgcgtgcactttttaaggtaaattctgtggtttttaattttattcccaaaagaattatctttgcacttcatgtgtcacagaggaaggatttttcttcctttctgcctctgaatagagaatttttttaaaatgcagaaaaaaatttgtaatgcttctcagcaccatcttttcagatcaagaaaattttgtcttcagaacataaaagaataggcacataatgtgcatagttttctcatggtattacaaagaatgttctcgaatgaaaatactacattattgaaaatgagcatattggagtctctgctagctttgacatagttctgtcacagtgtcaaatatactatttataattaaattatgggccccaggattatctgctctaaagaaaaagagtcacaaaataatagacaaatatggggggaaatgcaatggactgaccgaggcgctaaggagtggggatcaagaccccagaatgagagcatagtgcttagtctgatgcagcctgtgagtgacaaatccatagcaagcacattctttctgtgctggtgctgagaaacaggaccattttcaagcttatttgctagccactttatatttttattttgttttgattttaccatatagatctatgatactcttgagaacattttagattacacactatatctgtaaaaggatacttcaaagtttcctgtcttagattcatctgacagtttttctatggattgtgagaagggctcacagtttatgttcagaagggccaacaggtctccttgataaagggttccttacttcctgaagtaccaaaacgattaggattcttttatttctggacacttcatttttgtcatgaattagactattcactggttctgggaaaaaattcagtggtttgtatcgatatcttttacatgtgaatgactataattttatgttcctttgtaacattgagacttcatgtaaaacttttgactctaacttttttttttctttatcctgggcacatgtatgctatttttactgaattagatagctttggtatttataaaaattgtatccctcttattcataatttcctgaaaatgaagggctattgttatctttgataatttatgcttcaagtaaagaagtgtggctctttggcatctgtatttagcaaaatttgctttgtataattttaatgatgcataatggtggtggtgtcatgttttaataatttaaaatgttgtttatgttatcatatgtaaatagcatttatctcttaattggtggtaaaattattaatgtatactttatggttctagggaggtaatggtaaaagaaaacaaggaatcaaaacacaaaatgtcttattctgggagagtgaaaaccctctgccttcagaagaacactgctctttggataggaactggaggaggccatattttactcctggatctttcaactcgtcgacttatacgtgtaatttacaacttttgtaattcggtcagagtcatgatgacagcacagctaggcaagtttctttcctttagatatttttcatattctctaagtcttataaaatatgcctttattttacgtttacattttctctgaactttccagtgtcatatggatggtcttggagggtcacacagtgaaacataagactggtataaattgtgaatagggtcattacagaagtggagggagtaaatgctctcagtcccacaagagaagcagattactgcagctgaacactcagtttgggtcttacttgcttttttcctttttacctaaggcaaaaatgggaaatacatggtattgaatatattttactttttgagcaaagaaaataaagaaaatgtttgttttaatcatagtctagcctcccagcttgttaaagaatctcatttggtttttcattctataacaaatcttttttcttgcagcaatacatgctgaactgcacaacctacaaatattgacaaatcatattttactcaaactttgtctttttttgcttctatttttatatttaaatatgataaaattgtgatagcacataaaatatattttctgcataaatatatttgcgtcttcctttgataataatttgttttagaaaataacaataatagcatatatacaaaagtttacaaaaacgacactatggggtttaattctgaaaaaaactagaatttatgtaactttagcaaataatgaatgttttgaacatggtgaagaaaatatattcattgcaagtatatgtgaaagaggaacatgtgtttttctagcaccttcacctatttttcatttatagactttagagttgcacaggagttacaattagatgctcttaatgactgtaaactattaagatacatgtccacacaagcagagcagtaggtctctcaataggttgtctcagtagtcttattctaccaaagttgttgcattctctagttgaattgtatgtactttgggacccaaatagcttgcttataactgaagttatagtggaatgtctatgggttatagtttgattttaaaataaagatcaattggaggatagcctacaaggtgctgcatgagctggcttcactgtacctctcctgcctccatcatctaccacattcctaccagatcttgcttgtctagatgaacatccagttcttctcaattactatgctatattttgcctcagggatttgcacatgctgtttatttctttgcttagttaacatagctttttttcatgcttatttaactcatatgctttgaaatgttagctcctgtgtcaaaacctctgagaagccaacactgattaggtcaaagttcccgctttgggttcccataacagctttcttgcatagttttgatcatggtcatatttttttttcattaatgctagtctcttcactagaatataaactccaagacggttgggttagtgtgtttttgtttaccccttttttcccaggatctagcctagggcctacatagaagacttttgatgcaaatttgttgaataaattagtgaatgatttgaaaagaaaatatgatattttgacatagtatcagtatatccatccatctaagtgtccatctaaatactcatatttgtactaaatactcatatttgtaccttaccatatccaaagaacttttcacacacattacctcgtttaacattgtaactttgggaagggtaatgtataaatactgagcctattttatagaaaggttaagctgttttctcagactcacataattaagaattgcagcaaggagtggatcacagattttgttattttttaaaaaaatgctggtctttattcaatataattgaagggtcacctagaaaatagaattgtgaattcagttccaaggtatttgtgtcttaaactatgaacaactttacttttttttcaggccagtttaatatatagttttaacagaaaacttacatattttgtttttgtaaaggaagccttaaaaatgtcatgctggtattgggctacaaccggaaaaatactgaaggtacacaaaagcagaaaggtaacatttagaaggatactgttttccaaacagggcaatgatgtgaatgatggtaacatattatgtgtttcataaatttgtagaaaatattacatatggtataatcaggaattttaattggtagtttatagtgtaaagaacttagacataaattttcaaaattacaagtgatatgaagtgttaaatatttatattttcagctgaagtagaggtgtcaatcactagctcaaccttaaacgaaatgtgaatattttttacaacttatctatatctacataatgtctaattttgaacagtgtttgaaaaagcttttatttcttttagaatatgaaatgttaatttattaaatgttgatactctatttgaaatttaatagtttctataatgtattataaaacttttccaagtatagttttttataaataataatttagtacattagttatagctgtgtttatatttacatttatctaagtcaactaaaaatacatgagccaaactgaaataaaataagaatgttttatgatggatctttgaaacatgatttcatttttttctttttctagagatacaatcttgcttgaccgtttgggacatcaatcttccacatgaagtgcaaaatttagaaaaacacattgaagtgagaaaagaattagctgaaaaaatgagacgaacatctgttgagtaagagagaaataggaattgtctttggataggaaaattattctctcctcttgtaaatatttattttaaaaatgttcacatggaaagggtactcacattttttgaaatagctcgtgtgtatgaaggaatgttattatttttaatttaaatatatgtaaaaatacttaccagtaaatgtgtattttaaagaactatttaaaacacaatgttatatttcttataaataccagttactttcgttcattaattaatgaaaataaatctgtgaagtacctaatttaagtactcatactaaaatttataaggccgataattttttgttttcttgtctgtaatggaggtaaactttattttaaattctgtgcttaagacaggactattgcttgtcgatttttctagaaatctgcacggtataatgaaaatattaagacagtttcccatgtaatgtattccttcttagattgcatcgaaatgcactatcatatatgcttgtaaatattcaaatgaatttgcactaataaagtcctttgttggtatgtgaattctctttgttgctgttgcaaacagtgcatcttacacaacttcactcaattcaaaagaaaactccattaaaagtactaatgaaaaaacatgacatactgtcaaagtcctcatatctaggaaagacacagaaactctctttgtcacagaaactctctgtgtctttcctagacataatagagttgtttttcaactctatgtttgaatgtggataccctgaattttgtataattagtgtaaatacagtgttcagtccttcaagtgatatttttatttttttattcataccactagctacttgttttctaatctgcttcattctaatgcttatattcatcttttccctaaatttgtgatgctgcagatcctacatcattcagatagaaacctttttttttttcagaattatagaattccacagctcctaccaagaccatgaggataaatatctaacacttttcagttgctgaaggagaaaggagctttagttatgatggataaaaatatctgccaccctaggcttccaaattatacttaaattgtttacatagcttaccacaataggagtatcagggccaaatacctatgtaataatttgaggtcatttctgctttaggaaaagtactttcggtaaattctttggccctgaccagtattcattatttcagataattccctgtgataggacaactagtacatttaatattctcagaacttatggcattttactatgtgaaaactttaaatttatttatattaagggtaatcaaattcttaaagatgaaagattttctgtattttaaaggaagctatgctttaacttgttatgtaattaacaaaaaaatcatatataatagagctctttgttccagtgttatctctttcattgttactttgtatttgcaattttttttaccaaagacaaattaaaaaaatgaataccatatttaaatggaataataaaggttttttaaaaactttaa

SEQ ID NO: 930 - DNA, 107093 bp, Homo sapiens
actccagtctagctcgcattgcggctcccgcccgggcgagttctcgcccccgcgcggccgttgccgaggagacggcgcatgtcccgccgcgcgttgccccctctgcagtacccccgcccctcttctcccaccacaatgagatcctaagatggcggtggctgcggcggttggcgctgcgtagctgaggtcgaaaaggcggccactggggccgaggcagccaggaaacgtgtgggcctctctgctgcggtctccgagggccgaccgctgccggcggcgggtcgtgggggctgactgtcgctctgcctttgacaggagaggctgcttcttgtagaggtaatgcctgcgcgtccccagcccttggcaacctagggcggcgcgccccagaggcgggagagtaacggctccgggacactcggccctgttgggtctggccacgggcccacgcctcctctgtaggttcccgggtcttcctgccccgggcttcccgtgccctaggcggtcagtccgcccgctccctcaggactgatcgccgggatccccgggtgagcacctcgcgacgcgttggtgattgcaggactcccttcttgcctcctcgcccctcctgctggccctgtcggggaggctgttctgcgtcccggtggctccggctataccccttgcgggcggaggaagcggagcggggactctggtttgggtgctaggggcactgggtcgagttcttagagaaacaggccttggtggccatagttcttccccgcgttccctctgtggaactctcggtgtccagagtttggggtgtagaagggcggatgaggagcgacgcgactctgaagagttgcagttgggctgtgagctgcaggatttccgccgtctctggtgctgtgggagccgatgggccgggggaggcgttcctgggaaggttaatggagtaattattgccccttctttctcccttcctacctatctagttagaattgggcctagaaccgggaaagactaaatgccaagtgggactgggggaaacgttgtttggtttacagaaactggcgtttggggattaggccccgccagggaggctgggcgcgccaactttgcatccctcagcctactccccaggaactcgcctggtttaattttttttgttttgttttgtttttttgagcgagttgaggtctgtattgtgtgtcttacgggtgacggttcgtgtttgggcgctggaaggagcgggctttctgggcgcccctaccacccccgccccataaccgctttccagactccgcctgctggtgttctctggttaccggagtgggtgttgcagagcctcgggtgcacctgctcctttctttccctagcaccttcctggtgaggacccctgaacaccaatataatacagagtttttgaattgaaggtaaacctggtatttatgtagtgacgaggttattttattatgaagtacagtagcttttaaatgagcaaacatttttaaaatcatcggatatacgaggttgttacatagtttgagtaacaggaagctcgatcaatcagaggagtaaactttggcatagactattaaaggatagttagggctaaccatctttgttacactgttccgaaatagatatcactttgctgtttggtaagatttcagaagtttaggggatttaagcatttatgcatatcacactattttccaaaagaattgaggtaacttaaatttaaaatatgaataagttatatttttccccttcttttgatctttctaaacatactttagaccaaaactgaagtattttttattctgtatttcatagcgtaagtaatttacttaagtgatacatatttttaatcctaattaggaaacagctttgaagtgtggagcgggaaaggagcagtttctgagctgcaaaaactagtttctaaacaggtaatttgacattattatctgtattatcctttgtattagagttggagaagactttatggtggacactgctgtcacagttacagtgcatgactgaggatcctctctgcttagtaaacaaactttctgggttcaccgccctgtttgctctgcttttcggcgtgctgctttggcctgccggtatatctttgttcggaaaggccctgtcattcctaattattaattactagaatggtttatgcagtaccgtttgaaatttatttgtcttcacagaattttttcaacctgtttgaatttgtcctataactggatagcctctctttccaaatccatttaatctcaagttctctcctacaacattcctattaattggctgttcatgaactctacttgtcgaacttgttataccttgaccgaaatttagttgtctaaaattactttattattattttttgtacttcgatctccctttcctggtataaagttacttgaaacattacttttagcgcatagtacattgtcacatgcaagtgacataaaggtattctctgtccagcagaataaagtcagtgttgtagaatgtaagttcactaggagaagttcaataattgtttgcaaagggcagtttggaaaaatggctaaaagataattagaagtttgttaaaagctttttagaaataattgctcttcagaaaaaaacctcagaaataaataacctaaatttaattctactcttaaaattttaagaaagttcattttgaaagttttgtagaaattggctgggcgcagtggctcacgcctgtaatcccagcactttgggaggccgaggtgggcggatgacgaggtcaggagatcaagaccatccggctaacatggtgaaaccccatctctactaaaaatacaaaaaagattagccaggcgtggtggcgggcacctgtagtcccagctactctggaggcagaggcaggagaatggcgtgaacctgggagcaggaggttgcagtgagccaagattgtgccactgcaccccagcctaggcaacagagtgtgactccgtctcaaaaaaaaagaaacttttgtagaaatcaatatatattcttgctttctacaaaagcagacagatttttattttatagctctcctatgaggacctgaaatgagactgtcatgagaaaatacgaataggtagttgatgtatatcttaattataattctcagtgggtttttttttttttaaactggaagactaacaaaacagggcaagaaaaatggaactcaagggaaaggtcacatgtgaatgtgtgtgttagagttgttaatactacagtgattgctgtatggtgggctttagtaaaataaacaataattacaaaattagttataagattttccttttagcacattggggaagatgatggataagacgaataaaaataaagggtaattgagttaacttaaattggaagacctgggttttttcaataggagatttggccatttttttctgaaggaggaaagtggatttgagacttggagaaactagtaaggctgtgagattcacagtacagaactaagaagacaaccagaaatacctatcagtactttcatttttacggatttgagtgctaggcaacgtgctatgtaatgactactacagataaaacagtgtgcaaaacagacagggtgcctttcttcatggagtaaatttacattttaaaagtatctatgtgtatgtagagtgtagtatatcttaatagtgatcacaggcaatgccattttatgatcatttccccactttttgacagcttgagaatagtagcagagaaaacagacagtggagtttagccagaattgagtcgacacagtacgcaagtaggtgaggaagtgaaggatgctagctagcaaggcatttttgcaatgacttagttgggtttgggtttgagtaaagaatcaagggattgatggatttagggagagagaaacgatcaaggggctggtagtattcaggaaggctaagagcagtttcagcaggaatcaagtgagagaagtagaatgcaaaaacttatgatcagaaagaggaacttcagaagttcaggatcctgaacaaattatcagttcagtattggaatagagaagatgagatggatattggaattgaggccagagtcctagaaaagtcattgcaagtgtttagttcatgcaagcagggaatgaagtagaaagtgaaaccatgcgccagttactgtcaggaaaagtacaggcatatcttggatattttcagaggtgattatgagtaatttaatgccatttgagaaaaaaataatttttttcgttactgatcactttgatttttttttttttttttttggagacagagtcttgctctgttgtccaggctggagtgcagtggcattatcttggcttactgcatccctctcctcccgagttcaagcaattgattctccttactcagcctaccaaacagctgggattacaggaacgccccaccacacgtggctaatatttgcgtttttagtagaggcggagtttcgccatgttgaccaggcgaatcaagtgatccgcctgcctcagcttcccaaagtggtgggatcacaagtgtgagccactgcacccagcctgattatttgattactttgaatttcttctttaccttatattcttatttcaaaggtaaactgtagtcataggtattttcatggtaattaatactgtgatattctactgtaatatgtctctatagttagaatcctgcaacgggatgttcttttttttggcgatggagtcttgctctggcacccactggagtgcagcagcgcagtcttggctcactgcaacctctgcctcccaggttcaagtgattctcctgcctcagcctccctagtagctgggattacagacgcgtgccaccacgtccgactaatttttgtatttttaatatagatggggttttaacatgttgatcaggctagtcttcaactcctgacctcgtgatccgcccgcctcagcttccctaagtcctgggattacaagcgtgagccaccgcgcccagcctaacaggattttcttaaaaaaaaaaaaaaaaaaaagtcattgaaagtagcttaaaattgccatagtatattttcatttttgtgtctttgtaaaaaaaaaaaaaaaaccactaaggctgttaaaaatagctaaatgaaacttgaaagtaacagtttcaacttcgtttagtaaggcatagcatgagtagaagtgcgtgtttaaagtagaaggattttatttttatccccgttcagctacccgtagtactgtcatcaatcacttctaccaattgttttcctacagtttcaactttcttatcttactgtctttctgtttaacttgcatggcaaaatttcaaccttgggtggattcagtggagtgtttatattgagggatatgagcactgctggaaaaaaatatctgtagtatgtgttatatgagtgaatagtctctcgtttccctgagtccgtagtgctgcccacggtcattctccattccctacttttctacgctctctcagacactgctgtctcaccctcacatttaatgtacagtccttcctacttcacaacacttaggaacacctttggtttcctaccaccacatctgctaagcagcctccaacccattccatcctttcttggtttttttcaattaaagagatgttcttcttcctctctaaagctaatcatttgtcttttgctctagaccccaatggcccccgctttctcagagcccacatgctagttgcttatctcctttctcttctgcatttttagtatctccctcttttttttttttttttttttttttttttaaagtgaggcggagtttctctcttgttgcccaggctgagtgcaatggcactatctccgctcactgtaacctctgcctcccgggttcaaacgattctcctgcctcagcctctcttgtagctgggattacaggcatgtgccaccatacctggctaatttttgtatttttagtggaaacagggtttcgcagtttggaacaggctggtctcaaactcctgaccttagatgactcacccacctcagcctcccacagtgctggtattacaggcgtgagccaccgcacccgaccagtatctccctccttaccaacaaattgtaaacgtactcaagatacttctattttaataaaactttccttatgaccgtctgtgcttgcttctcatcataggctgattccttaaaaatattagctaatgactttctttattttttccctcttccttccaataatacattccagttatggaattgaccctcactacccctgctgaaatttctcaccaaagtcaacagtaaccttgttgctaaatctaggaggatacttctcagtacttctcttatctggcaaggtaactgtttggtttcttatcacattctacttgatacacttttccccttttggcaggctctcctggtttccctcctgtctttctgtaccttattagtgtattagcgtgtccttttcctctgcctctctatttaataccagtgtatttaagatctggtcttctcttactctttatcgtctccctgagtcctctgtcccactttttgagtggatgactctccagcccagatttctctgttgagagatagatcgctatttgtcaaccggacaattttattgggtgtattataggcacatcaaactctccatttctaaaacttgaactcatcatcatcctctctcaacaaagaaaacttgtttcttttctgatcagtttaactgtgtgtcacatacccagtttctagcaacctttatcctttatcttttaactctactatcctttaactcttctgcttctttatcgcccgtgttgtaatacagtagtctgccctattctgtgtgggataccttccagagacccccagtgcatgcctgaaactgtgggtagtaccaaactctatgtgtatgttatttcctgtatgtatgtaactgtgataaagtttaatttatagattaggctcagtaagagattaacaataactaataagacagaatagtcacaacagtatactgtaataaaagttacaagaatgtggtctctgtcgctcaaaataacgtactttactcaccagtttcctgaccatggttgactatggggaactataatcctgtaacacaaaactgcagataaggtggggactatagtcaccaactcctattgatcctgcacagcagttttgcttgaattggtattctgtacatccttagtcttttcgttattggaatacttccttttttttttttttttttttgagacagagtctcgctcttccgcccaggccggagtgcagtggtgttatctgggttcactacaagctccgcctcctgggttcacaccattctgcctcagcctcccgagtagctgggactacaggtgcccgccaccacgcctggctaattttttgtatttttagtagaggtgacagggtttcaccgtgttagccaggatggtctcgatctcctgacctcgtgatccgcctgccttggcctcccaaaatgctgggattacaggcgtgagccactgcgcctgaccgttactggaatactttctgtacttgtaagtactagtttatattaatgtgtttacagaataaaatttagaaggcagagattctgtatttgtaatggtgacatttaggtggttaaagaggttgacatgaagagaaataacatgccattactcttatgagggagatacttagtatttttgggaaatgttgtgaatgtggccgggtgcggtggctcacgcctgtaatcccagcactttgggaggccgaggcgggcggatcacgaggtcaggagatggagaccatcctggctaacatggtgaaaccctgtctctactaaagatacaacaaaaattagccaggcgtggtggcgggtgcctgtagtcccagctattggggaggctgaggcaggagaatgacgtgaacctgggaggcggagcttgtagtgagcccagatggcgccactgcactccagcctgggtgacagagcaagactctgtctccaaaaaaaaaaaagaattcatccatatgcaattatttctttagcttcatactaatagttttactttttaaaggcatactaatgctgtgccttttaaacacatttggtgtcatcattaagttacaaagtattctaccccctatggcaatcacagtgtaacagtggatgaaattgttcattttgccaacctgatagattagactttagtaaattttgttttaaaaaatactaaaaaaatcatctgtttttcccaaactaattagagtgtacagttttaaaattgttttagaaacttattttagtagtgttcaaagtcgttagccagaaataggtctttggaacaagctctgcattttagggggaatttattgtgatagggaaatagaatgcgtaaaacattctttctccagatatattcttttttttttttgagatggagtcttgctcttgcccaggctggagtgcagtggcgtgatctcagcacactgcaacctctgcctcccgggttcaattgattcttctgcttcagcctcctgagtaactaggactacaggcgtgtgccaccatggctggctagtttttgtatttttagtagagataggatttcgttatgttggccaggctggtattgaattcctgaccttgtggtaacgccgaccttggcccagatatattcttaatacatttatcttactttactattacttcattattctattaatagaaagtattgctaacatactcttttaagataaaaatgatatgtaataattttgacttaaatatcttaattttcccttccaatttacgtttcaaaacaattgcttttagtacttttaaatatggcatcacttctgttgcctggctgttttattcttcagtattacaaattatgtcagtatatgtagaatacagtagttgcaaaatgttttatttaaatgagtcattttggttcactggatatacttctatgggtattattttttaaagttttaaaatatatttctagtataaataattacgtaaactgttcctgaaaatatgagacagaaaaaaagaagaaaaatcaccagtgcctaccctgtaaccaataattgcttttgtgaaagcactttaataaagtttcttagcttttgtttaaaaaaatttatgtataatttttcatactgcttttttacttttttatattactttttccatgatacaccgacaggttatattgtccaggcttcataattacatattttgaagggtacttagtattctacccagcaagtgtagtacagtttgcctaatagcattgattttgtcatttgacatttagtgttgttttttaatttatcacaattatagcgtaataaacaacttcattatagttctttccaccatatttaaggttgttttcttagattgcatatagagaggtagaattactgcgtcaaaaattcagttttagttcttgatacagtattgccaaaatgctttccagaaatgttatactggtttatattctcaatgtagtgtctgagaattccattttccttttactgtcattaggattagataatatgtaatttatatgaaagttagcaaatttaatagtttcttattttaatttgcagctggactttatatattcgtatttttttttgcaaactacttgttttgcttatatttctccggttttatttttttaaaacaaattctctgtataacaaaggtattaactatacttagtatttctttgagatttttttttctcccaagctctcatttactattctcagcacacttaggaatttacttttatgtgaataaaatctgttgaactttttattttttatttctttgtgttctaaatttagtaagttctctgtttttaaaaaccattcaattttcttgtctttttaaaatcttaattgatgtttaaaattctgttttaatctttgactattttgatagtatgatataaggcagcctttctcagttgggagagaattaagctccaataccctaaggcatctgttgtttactgtgaattaactttttttctgtgtgtctgggatggatggtactggatatgtaccatccttgggagaattgagaaagtagtgactcaaacgatttttcccctcttctatgattgaggtgaagaataccacttaaggaagactgttaaagctctaaatgtatctttttcaaatctgttagcaaattgttgtatcagtgctcactcctacatcatagaattgttgtgaggctttaatgacataatggacgtgaaatattttagcatggtgtttggcatgtggtaagcaaaataaaatgcgttagctgttactagtttttcttactacatttttctgattacatgtatttgagggtttttgttcctgagctagtactgatttaaccatatagacagcattgttgaaaccatatagacagctaatttggattagcattctaacctcctgacctctgttgctatccttgcttttattttacagatggtaacttttttttccgatatgtttattcttccagataaattttagaattattttgtcaagttctaaggagaatcccagtgggatcttaactggaattacattaagccaatctacatttagaaaaagtggttggttgtaatatttagtatcccatcatggaagatagtttttctacttattcacattttttctcccatattgttttatagagtttaatagtgcttcttgacatagagccaaattattactcctagttattttatatatttgtcactattataagtagcatcgtttaagtggtattggtgatattttgacgttctctagatttttaaaaaatacctactctttaagaataccaccttttctcttttcagtggtaatatttctgtttcatatttgtctgcttgatagaatttctgaaagaatgccaagtaactgatatgtagcattcttattttggtctttattggagatgtccttcatgtcttattttaagcataatgttgactgcttgtttatacttactttcaactctttagagaattattaaagtaatatatgctcattaaaaaaagagtgaaatataacaggaagggtcaatgtatttgtgatttttaagatttttaaaattaatacttcgttgaattttatcatttttattttgagataaaatttaatttgctatataatttgttaaagtaatatgttattctaatagatattctagcatcaaaacatctgtgggacaaattctactttttcagagttgataatccttttgatattttttctctagtgaatgggatgagttagggtcttagaattaaagcaacttggatttttatcattattactatttatttaatttttaatcttttttttttttgagatggttttttgctagtcacccaggctggagtgcagtggtgcagtctcggctcactgcaaccttggcttcctctgttgaagccatactcctgcctcagcctcccgagtagctgggattacaggcacctgccaccacacccggctaattttgtatttttagtagagatggggttttaccatgttggccaggctggtcttgaactcctgacctcaagtgatccgcttacctcagcttctcaaagtgctgggattacaggcgtgagccactgcacccagcctattaatatttttttattgccatttttagctgaatgaccttggccaaactgtctcttttgaatgtcagtgcttttgtgtgtagtttaatgacttttcatgtcccttgaattttagataaaattatctcaacctctcctctttcagctagcaccctttcaacctgtacaattccacagctagtggaaatccaaagtcttctgcaagattatgcagaaatcttactttctgatgatcatctctgcctttgaacctctacttccaccattgctgctgctttttctcatctctttgacccaggtaggaaattcagtccctttcttgattttcacatgtacaagcaaaaaccccatttttatggggaggattagagtttggtagtctttaccaagatttagagaaagcactaatacaaattaaactagggtagtaagcatcactattcttaaaatgtcttctagccactgcacttttggatgttttggccctagtcctgcttctctttccctaccttcttatcatcttgctattgtaccttcctgttaaaaccaaaattttcttcttgtttcttgcagagcagttctcccgtctttgactctttggcatacaactaatgcctgtgttttcagggtatcatcttcatcccaagtccattgtcagaacagagatactttctttcctgggagaagttctgggtctagctgtttatgacacttttcctactttattgttctaccctttggaactgtgttgaattaagtaagtaatcttcaagcatgcagactggtgctcacaaggtatattcaggggttttcctttccttctctgtcattccaactacctagctcattttaatcataatatgcctgtcacagctaaatcaatttgtctgtgatgtggttgacagtgcctcattttagttcataaaaatcagtgcttcaaagattgtattgctaaacttcatggaatgatttgaaaattgaatttgtttttatgtgttataaagctcagttcttaacttgtttcgcagagagttaattgttaaatccagtatggccacaggaggaggtccctttgaagatggcatgaatgatcaggatttaccaaactggagtaatgagaatgttgatgacaggctcaacaatatggtatgattccttactcttcatggtgtgttgttggctattaatgttaaaatgcagttttccccctgaccaaatttaactcactgatgctctttgtatacacttgctggccaagacattaagggaccctgggccgtttattatattaattgaagacacaaatcaaattgagtttttaagccccaaagcagatttactgttacataaagatgtaaaagtgttttttttatggaaaccatgtttaagacatgcagctgggttttaggaagggatttggagaaggaattgggaaattatcaagaattacgttttcaccaccctaactctgcttttgagtgcatctgcctaacacacctttctctttacagaccagttttctctcctctggtccatgtgatatactgtggctgtcccattgttctaaaccttttagttatgggtgcagttatgtactgactagttacctcttagttccaatttgaaattttgtagtatgattatcctaatttggattagatatgtgtttcttttttcagtcttctgtggcgagggtggggtgaggtgtaagtagtgtaacaggttggcaggaatattcactcatagattgggtggaaggacagttcataaagaagggggttttgttaaaataaggaaaatatcccaagtggtttactatactagtactaaaagaattttccagttggataaagtgggaatttacagacctttttgttaatgaattaggttatgtgagtttaactaagtaaataaaaatgttttctatttgaaactataagcactttttgtaattccatattagctgttaccatgtacatttttacctataaaaataatagctgtctttattgcttactaaatgctaggtactaattagttttaatcctattttgaaggtgacactattttagagattaggaaactgagactataggaagcaaaataaatagcctagggtcacacagtggagtgttttttcagaaaacagtaattaggtttagaacctaggttgatttgatttcagatctctttttgatacgtactgactttataggagatcggtaaaggtatctgtaatttatttcactatttataatagaaaatcacaatgtaaaaaaatcctcttggaaatattcagattgattttagggttggcatttgaggatttgtatttgttagtgatcttgataagaaaataatctcttttcagaaggatgggctataaaattaaggtagatgtaatgaggggaaaatgggttaatagaagtaaatatttgtctctaggagtataagtctgtcaaaaatgtcttgtcttttttaattttaaaactgaccaaaactttttaattataccaatctattttcctggtttgatacaggccatgttaatttttgcttttacttttttaaaggattggggtgcccaacagaagaaagcaaatagatcatcagaaaagaataagaaaaagtttggtgtagaaagtgataaaagagtaaccaatgatatttctccggagtcgtcaccaggagttggaaggcgaagaacaaagactccacatacgttcccacacagtagatacatgagtcagatgtctgtcccagagcaggcagaattagagaaactgaaacagcggataaacttcagtgatttagatcaggtttgtgaattatttttaaaaatgaagctattactgtgagaaatacttgaaatggattaaataatttgtcttaggaataaaaaattgagctgtttatgtaatttttaaaaaaagtttctgtgcctatggaaagaattttaatcactggggatggtcctgtcttctttagaaggaaatgaagtcccatttctaaacttgctaaagacatgcatttctggactttatactatgttatatgactaactcaagtgattttactatacaactaaattttgcattttggtaactgaataaaatggtattaagtaatggaaagttccagtttagtatatatatcattggctaagtgtgggatgtgctgggttacctcaagtttagaatgaaactattttctgtttataatcaccaaaataaagtttagatctaaaaacaagtagaaatgataataaattcttgagagatattttactcttagatctatatgtcatagagacacacacatttccaaaaatgtagaaaggtagattcaagtctgataatgatgttggtaatgatcatgtatcatttatttatatctatttatcaattattgaacacttaactgtatatcaggcactgagctgaatactttttcagacagttcttcatgtagacacaactttaattacattgattcattgggtccaaagcgtataaaaatactataagcaagtaataaaaagcaatatgagttaaagtgtgatccatggtcctaggacacgttgagcatccctaatacgaaaatccgaaatgctccaaaatccaaaactttttaagtgccaacatgagtggaaaatttaacacctgaccttgtgtgatggtctgcagtgaaaacgcgtcaaaactttgtttcgtgcacaaaattattaaaaatattgtataagattaccttcagattatgtgtataaggtgcacatgaaacataaatgaattttatgtttagactccggtctctttcctaagatatatctcatgtttatgcatatattccaaaatttgaaaaaaaatgaaactcctaacacttcttgtctgaaatattttggataaggggtactcaagctgtacttcatttagacttaccttgttcatattcgtcagttgaattgtctcagcaaagtgaagtctagaaaatgctaatcaaattttcatattgtagtgaaagactgttacagagccaaagctctttcaggtcttagtgcaaagctctttgtgtgcaccttctgaatcaatatctgatggcgaaactaagaacattggggttaaaacaaaattttgtcataaggttaatgtttgtgtgatttgatttctttttcatatatagagaagcattggaagtgattcccaaggtagagcaacagctgctaacaacaaacgtcagcttagtgaaaaccgaaagcccttcaactttttgcctatgcagattaatactaacaagagcaaagatgcatctacaaaccccccaaacagagaaacgattggatcagcacagtgtaaagagttgtttgcttctgctttaagtaatgacctcttgcaaaactgtcaggtgtctgaagaagatgggaggggagaacctgcaatggagagcagccaggtgataacgtttgtttcttttgctcattctttacacaaacctcaaaataccaacagtaaggtttagaaaattaggttacgcacacaggaattttagttgggtggaattaaagtgcttcactgacctcctttgttaatctgccagatttacttaaaatagagtaaatttctgtttatccaaaaatattttagaaatggcatattcaggttagttaaaggcttctgtttatttacaaaatagcatattgccagtttttagtaaagggggattggaaggaaagtgattaatagatttttgtaggaattttttaaaatggcaaatattcttttgaaaagttgtaaaactataatacatttaattaatttataaacattaggaaaatttatataaaaaattgtatgcagttgtagaagtaaaatttttcagatactgtagattaaaattttgaaatgtatttttgaattgacagtgattggagtttttagtattaccaattatgtcttgattaaaatctaagctggattcagattttttgcatgtgttaattcacacaataatccaagtgtctttggttatcttcgaaataaaaatttgtaaaactgttgctattgaactaattatccttagttttatatattgtgtactttcatgctttttttaaaaaaaatatttcccctgcagattgtaagcaggcttgttcaaattcgcgattatattactaaagctagttccatgcgggaagatcttgtagagaaaaatgagagatctgctaatgttgagcgccttactcatctaatagatcaccttaaagaacaagagaagtcatatatgaaatttcttaaaaaaatccttgtaagtattcgacttttaaaataacatattatttttgtagtatctcagtgtgtatttactgatgacattctgatgccaccccagaggagttaacatattttcaaaaaatcatgccatccattataacaatttattgcccattttaatagttgtatgatttataccgctaaaatatttcaggctagagaaaatgaggaggaggatgttcggactatagattcagctgtgggatctggttctgtagctgagagcacatcgctaaacatagatgtgcagtctgaggcttcagataccacggtaagcggctttttggtaattaaagtgctggaaatgaaggtttaaatttttctcccagttttcaagatgttatttttataggcgttccttaatgaaaagtgtattccagggaagaacccctcaaattgttaatgctgtatgtgttcttctgtatttaaacacggaagttaagttttatttattaacactaaaaatagttttaatggttaatttgaaaatgtaatttttgatcttcagtttatagaaacattgtttttgtagtttgttttgttaagcaaagcttcactaattttaagaagcatcgaggaagttaaaatggatggtggaattaagggcaataggcaacattagtgattacttagcatgtagtcttttggaaataaccaagttcatttgtcactgaggacacgttaaggatattagaatttttcattttttgggctctatcctagtactggagcaaaaccagatgactgaaaaatcgagagaaagactagtaaatgggacaggatagcatttacattgtgacttattcacaatgagaaaaatgctgtaattgctgacttggcaaaatggaatttgttgaagtactgtttttctgaagaatagtaatttacagaactttgaggaaagatttctaaaacttagtgtggttcaatgctagggtgtttttaggcattttaaacaggcgtgcctataaccatgcattattaagcttttaacacctattacaggctagtaaagcttttgttttgagaggataagcatatatctcttcgggttttgaggtgttcaaaatgccattcagcattaggaatttgaaggtttgtttcctattagtattgacctgcataattcttacctgcctcctttctcttcccggaccttcctaatttgaagaggtgatttggatttcttttctctacattattttcaacaggagatacttagagagcctgatccaaacagttgttgaagaatggattttactgtggggaaattctttttctatttacagtggtgcgaggcataatttcttccttaggttccagcagaaatggaagggttaggacgatgtgggtaaaggaattctgttggggaggagtgggaacttgtatagatttattgtaatttatataaagtattcattgtgatggcaatttctttcataatataaaatgacggtatgaaagttgactaataacatgtagcagagtaaatgttaaaaatgtgctttaacaactgtgtggtatggtaattccgcaggatgtggtacttgcttagttacagtaagcaacagtctagtctacagaaaacttaaaagactaaatatactgctgcttggagggggatgtggattgatttttgtttttttttttttttaaaaaaaaggtggactggtactttttaaattgttttacaaggctggcttatatgttaaacaggagtttgtgttaagaatttaatatgctacactatttaataaaggaggaggcatcttttattctgagaattcggccgtgcattgaggacaaactagggaattcagcttcacaagaacaggtttcagacattgacgttactacaagtccaaaagggaaaggtgacagacctcagaatgacagggaactgaggcctaataggaaatatagccaaaaacgtggatttccctcaaaggtatactttacaatattaacttgggaagtctctaaatgagcacttcttctgttcatatttcctcttctttatttgcttttctgttgttgctattactcttacatattaattgttaatatagttgtcatactgtaatttgctttagtaaaattctgtcccttactgttttttttctactttgttatatacctctccatggattatagcttacagctgtttttaatttatattaacaaaggttttgaaatgtaatttattcccttttttataaattgcgagtataatttataacacgttcttaaaccttgaccatcagtcagttgccctttgtttctgatatttgtgtttattaatttagatggggccaggcgtggtaattctagcactttggaagactgaggtgggcggatcacctgaggtcaggggtttgggaccatcctggccaacatggcgaaaccctgtctctactaaaaatacaaaaattagctgggcacggtggcgcacgcctgtaatcccagctactcaggaggctgaggcaggagaatcgcttcaacctaggaggtgtaggttgccgtgagccactgcactccagcatgggtgacagagtgagactgcgtctcaaaaaaaaaataatgaaataaaaataaataaatttagatggtagtttgtcagattttttggtttatatttttatttttggaaacccctttcatttgctttttttagaaaaattatccagttgacttggttgcctctttttttgctggttttttctgcagtgtttaattggttttttaattttccatgatttgcataatggcattccagatagagttaaagacaactatttgtagttccacataaaaagagtttgaataggccgggcacggtggctcacgcctgtaatcccagcactttgggaggccgaggcaggcggatcacgaggtcaggagatcgagaccagtctggccaacatagtgaaaccctgtctttactaaaaatacacgaaaaattagccaggtgtggtagtatgcacctgtaatctcagctactcaggaggctgaggcaggagaattgcttgaaccctggaggcggaggttgcagcgagccgagatcctgccactgtactccagcttgggtgacagaacgagactctgtctcaaaaaaaaaaaaaaaagagtttgaataaaaataccatttataaaagtgcatgtatctgttggcaggagcaaagtactattttagtaattgagtataggtaagactaatttcatatgttttattactggtttattacctaggactacactttcccattttgtggctattttatgggtttgttgtattttttttttttttttggtgtgtgtggctatttacaaatggtaaaacttcacctctagtattttggcagtttttttattttttctggttcctacaagaatttgagagcacagtttgaaattagttatgggaatcttattatatcaaatatcaagtaaaatgtgccccagttcaccagtagagtgaataaagtagctgattattttaaaaactagtggcattggagaagagcaaataaacatgaagcataataggtaaccattggaattttattctctttaatccttctgaatagtgacaagcgaaatttaagagttaacagttaatgcagtatctgccagttctttttttcttaaggcattacatataatttaaaaaccactttgctgtttttaggtttctttgaataatatccttataagtgattattattcttttttgaattctcttcttggcatttatttcattttgactttcttgattcttaaggctgtctcgttgttctgttagtattctatttgtaaaaacattttaatttcttcaggggaaaaaatcttaattctcaccacctgtgtttatttttttctctactctgcaggaactgtcattcttaccaccccacccctgtttcctccttagaatcttttcaaaatgtagtattctgttagaatagtggaaaacacagttgagggtcttacatgcgattcaaggttgaaagcaaccttgagacttaacgcatgatatgaaatgattgatattctagagctgcctaccaagggcacattccactttatgaaatattttaagacatgatgacatcttgtataagatgtcagaagaaggcaaaagaaagccttctacgagtagccatgcgttcattgttttcctatactcatggcccccaacttaatctcacctcttaaaatttataagctttctttgtaccttgtacctgtgttttgccattattttcatcattgctagttatttcgtgtgagattgccctgtcttttaaaccagctatggttcttcagacatgatgtcttatacttctgtatttagaacccagcacataatttggagcagatagtatgacgtaaagaagactagagcctaagaacctgatttcccttaactgtgacactggataagtcacaactttatcttctctaggcttatagttcctcaaccttcacatgaagaaattgaagtacataattatctgaagctgtcaaaatacattaggatccattaataattactaggagaacctcagttgagtagaggaaaggaagattgagggttctctgaaattggactactacatatttacaactcagggtttgatgcctaagttatttttttaatctgtaaactaaaaatatagttggtgaaagtgactttttcaaaaaaagtttaaagaaaaatatgtgtttgaagaattaatatacacctagcatcctttttggatttctattccaggtgccatcttcctggtatgttattactcctacctagatatttttattttctcccttctgtatatttcatcataggctgtactcccatcttttggctcagtttttttgagcatcagtctgaaatgttgtttatatgaatgtgaaagttattaagtagtaatatttcactaattttgaaaattgagaattcatttttagattagtgagaaatctgaagataattgtgtttaatagcttagaattctttatgattaggttatcacagttttgtgactaataaggattaaagaactttttagaaagtacgcttttttctcatttgcatatttttttctcctaattataatttatgctttgctagaggagtatttgatcaacctagagagattttgttttaccccttccattgatatctgtacctatttgatttggttttacattttaccgttgactttgatgaaatcattataaaattatttttgctgcattctgagagggctagctattgataattatccctacccttcaaagttgtttttttcctaatgatgtaaactgtctggaaataagccagactaggatgaatttccacggaaatggatgtaaatatttacaaggtaactccccttatataggataggagagaactgagtaaacagtacttaatttgttaaaagtttcagtttattagaggttcaagacaacagaaaaacctctaataaatattggcttaccaagatccaggtaggctatttgtttcccatgctcatgaagtctagagatagtctaggatagagaggcactgactaggcacctctgatgtttacatgaaataatctaattatagccaacttcctatttgatcataactttcttgaatatttaactctttgccatgtacttatttgtttacttattaattttatggatttccaagtcacagtgtaaaatattaccacagttactcatgctcattcacaatactgatgagttctacttggggaggtaaagaaatttttatatagtattgtaaaggatgtcacccagaagggagtttctcttgagcccatctgcatgctccataatttctctgggaatcaaatgtacatagcaagtgtagatcagtgcatttttactttcaaaagaaatctttgaacttctttgctctctttagtcatttatttgaaatttacataacccgacaaaaatttgttagcagtacaaatttaaaattgactaagtgaaacaaaagtgaaatattttatgtaaatattaggtaaaatcgttcaacttttaaaataaaagactttttaaaaggtaaatcggtgatgaaaaatacaattacggtatacgtttcgatgtataatttagcttgtaatatattgtttccaggttgtatttaaatttgtctctgctttgcttttccattttcttgttggattacattttgaatagttttaagattaacacttaaaatttcatcattttttgtaagtgccacttatttaatccatccctctacttttagactagatgataacctcctagcattttcggggaatttggaagtagttacttccattttatgtcatcagactcagatgaatgagcataatttaagaggaaaataatgatgcctttgatgacgaatataaaattcgttattttcttagatgtctgataatatgatgtgattaaatgaaaatctttttacataagattatcaaataaaaaatgtatttttaaaatttcagtcctttgttagaaatagtaggtgtgcctactttctaggttttgttgttgtttttaaatattacttctagtcttttttttttccttttttcttttttctttgagacggggtctcgctctgtcacccaggctggagtgcaatggtgcagtctcagctcactgcaatctctacctcctgagttcaagcgattctcttgcctcagcctcctgagtagctgggataacaggcgcacaccgccacacccggctaatttttgtatttttagtagagatggggtttcatatgttggtcaggctggtctcaaactcctgaccttgtgatctgcccacctcggcctcccgaagtgctaggattacaagactttcaggtcattaacccagtataatgtgctccttttctgtaggggcctagattcttcagtgtgtgtgtgtgtgtgtgtgtgtgtgtgtgtgtgtgtgtccatgtgtccgtgtccctcttggccttttatgttttgtatatctttttcttttccttttgttcattcctcttcctgctgagccattgattatgtagctttttactgtgaaattacctcttaagtggcaggctatatatatatctctgtgtcatcattctgttcttactcttttttcttgatgtctactaaaactatatttagggttgtatatttaataatttgttatcaatgtgtatactttgccattgataattgaaaccgcaacatggattttaatagtcagatacaagtattgttggtcttattttccaggccagagatcctcagcaggagcctatggaagagatagaaaatttgaagaaacaacatgatttattaaaaagaatgttacaacagcaggagcaactaagagctctacagggacggcaggctgcacttctagctctgcaacataaagcagagcaagctattgcagtgatggatgattctggtatgtcacagtctgagaatattctttttgtaaggaagactcatacataattgtattgcagggtggatgctgattattacataatcagatcttgattgttgtctagtttagaaaccttcatatgaggcttatactttcctgtgcttttctctggttatgcagaaaaggttgcagggacaactggccatcatactataccatgcagatagccagatctctctccttttcatcagagagtacccttaagaggtaaaagagacaggctgtagttctgtttttgtacctcagactgataaggctcatgatgcgtttatttcctttttttctattttattcagctaggattgtcattctttgcttgcctcccaagaaagggttaaaaccttaagtgaggcagtgagtaaatttataaagtgtctttaaccttcaaggttagtagtagctagtagctgttattttaattaggtatccttttgtatatgctagctccttggaactatatttatagtgtatacattcttcgtaagactcagaaattttcttcctcctttcctcatagccatgtgtgaattagatgaaagttgtgttgaatttcttagtattgagtctaattttgtacgtttatcatcaccttcaaacttattttagtttctcgttaaattgcaaaaaaagatgattagttattaaaagtcaacaaaactaagttatgttttctaatagtctatcccccactgtctgcttttagtaataatttctcttctttgagcgctttgtttttgcgagtgagttaggttctcactgaggctaccctgttgtgaatcagtttattctgctgtccaaacctagcccactggctcacctgtctaatccctgttatacctaatttaagtttgcattttcacaaggaacgttatgactttcaaataacctctttttttttttttttttttttttttttggagacagagttttgctctgttgcccaggctggagtgcaatggcatgttctcggctcactgcaacctctgcctcccaggttcaagtgattctcctgcctcagcctcctgagtagctgggattacaggtgcgcaccaccatgcctggctaatttttgtatttttagtagagtcggggtttcaccatattggtcaggctggtcttgaactcctgaccttgtgatctgcccgccttggcctcccaaagtgctgggattacaggcgtcagccaccgtgcctggtcaataacttactcttttgtagtaatgatatagctgtatagagtactgtatacagtaataattacaaagatttttgtccccatttctccattgtaaaatttaaagtaccattagcttttatatttaggaaacagataatttaggaaaagataattaaaatgctttaacataatgactagtactagtttggttaatgactaaccttttaaatatttttcgagtttggaatatcagatttaaaagctttcctttggtagttaatattaatctctaaacttgcataatctcctttgatcatcagagatttctaggttagtcagagctttaattcttatttctgttttatagagaaggaactctacagagtttgtggcttgcctagatttatatagaattttagcagaattacatttcttgaattgtaggtcaggggtcttgtttctttttctgaatatgaacttttgaaagtaagcagataatttctttttaaaaaatactattatgagtcagagaataggagtataatgcacatgagtttgaacttcatactatttcaaaaagaattttagcttagtaattttaaaacaaatttagtcttgtatttatgagattttgcaggggcatgctaatgaaaagccatggaaagctacaattacagtatttaatctagtatatgagacattatcttgggataattatgttacctcaaagagtgtccctttcaccatttaactaacaagttacatataattactgtaatttctttcttctcagcatagagttttgactagacatataggattctatatagccttgaaattctcagttctcagtggaaaaaaggtagtgttttcctttaaaacagaagcaatttataactaattgtcttttttctttatcttttttttttttttgagacaggatcttgctctgtcacccaggctggaatacagtgggcgtgatcttggctcactgcagcctctgcctcgcaggttcaagtgattctctcaccccagcctcctgaatagctaggaatacaggcgtgctgtaccacgccgggctaatttttgtagttttgtagagatggggtctcactgtggtgcccaggctggtcttgaactcctgcgctcaagtgatctgcccaccttggccttccaaagtgttggaattacaggtgtgagacactgtacctggccaccaatgtctgttttagagttggagagttagaagtcaggttaaggatggagttatttgttagtagaacagtgactatcatgaaaattgttgtcacaaaactgctttatgaatatgggggcattttttttaaattaagaagataaaaaccacagtcttttagtatgacttgtatcacaaacagccacttcaataaattatccattttactgcaggggtcagcaaactatggtcagctgagtttggctcattgcctgaaataaagttttagggaacacagccatgcccttttgtttacattgtctgtggttgcttttaccttgtaaaagcagagttgggtggtcgagacaaaaactgtatttcccacaaagtttaacatatttactatttcaacctttaagcaaagtttgccagcccctctaccggagaattgattctattcaagaacatggagattgaaacctgtcagaatcagctgtgcttttttacactatcactttccctttcactcctcactgatcttagacctgctccactgagtcactactattaattggaatgtaatagtaaccctccttgtatgttgggacaggaaaagatgaaccactttaccagagttttgtgagcatccctttatttttaagttaggtggtaacttctaataaaatgattgttggcagatagatcggattgttaactagtttcaagttacgtatgtgagctttttaaattctttttttaaatttatttttagcttctcagagattaaaaaaggtgtttgattatttacattaatcagtagttactaatttctttccagttgttgcagaaactgcaggtagcttatctggcgtcagtatcacatctgaactaaatgaagaattgaatgacttaattcagcgttttcataatcagcttcgtgattctcaggtaacctagatgttttagtatagttgagtttaaaaaatcacattaattagaacagtgattcagaaacttcagtgagcatacatatcacctggcatgattgttgagcagtgtaggtttctgattggtggggtcccccccaccttcaaaattacgattcatggatttggggtgggcttctccacgtctcagtccaatgctggtggcctggggactatactttaagaatcactaaattagaggagagtttactttgaaggaagtgattaatgaagtttttctttgtatgctactggatgacgtattcttttttcctctaaaagacttaatggtcacaacgattaagactttgctttaaatctgtgtccttcgactagatacatgggattctatacagccttggaattctcatttgaaggaatattttactaacaattttaagaaagttcttaatttgagagttagcaagtgttataatttgatgcactttgtaagtgatataaatgcagattttcaatatgggggccttgggtaagaaaggatgaattaatgcctctccattggaagtgagtatgattgaagatgcagtgtctcttgtcttcttgctgaccaagtgaaaatgagagaatatggcccaaccactttggagagttatatagcagtacctagtaaatttcttctggtagacctggggcctactttagagaaactctcacatgttcagaaggaggtagatggaagaatattcatggcaactctgtgttaatagcaaataaccagaaacagcccaaatgtccatcaacagaaatgggctaatgaattcttacatagagtgaaattctttatagcagttacagtaaataagccattgctaatgaatacaaaattcaagtttaagaaggatcccacttaccttattttaaaaaaagtctacatttttaatgtatgtatacataggcattagaaaataaaaacatgtagagaatggtagatgcctgattccaggttggggttacctttggagtgggtaatgacattggaaagggtacaaacagagctttagttaaatctgtaatgttatatttttcttaaaataattgatgcaaatatgggaaaatcttaaaatttgactaagcataatgggagatattcattatatgatttcctaagccctagtggattcttgcaaagtttcataattaaaaaaaatttaaaaaaaggccaggtgcggtggcttatgcctgtaatcccagcactttgggaggccgaggcgggtggatcacttgaggtcaggtgtttgagaccagcctggccaacatggtgaaaccctgtctcaactaaaaatgcaaaaatgagccaggtgtggaggcatgcacctgtaatctcagctgcttgagaggctgaggcaggagaatcgcttgaacccaggaggcggaggtttcagtgagttgagatcacgccactgcactctagcctgggccacagagtgagactttgtctcaaaaataaataaataaataaataaataaataaaaaataaaggaacatgagagagaagtggtgggaaaaattgataggttaagaagttaaagtttacagtggtagttctagaaagaaggcaagagagagaatgagatttttgaaggtttattttatgtaacgtggcattgttattacttttgattcaattactgatgtctagtgaatccaagacctctgtgtggtcatgtgtctctaaaactatgtagagtcagctctcagtatctgtgggttccacatccatggattcaaccaaccatggatcaggaatattttggggggagaaataacacaacaatttttaaaatgcaaatttaaaaatataacagctatttacatagtgtttatattgtattaggtattataagtagtctagagctgatctgaagtatataggaggatgtgtgtagattatgtgcagatactacaccattttatataagggatttgggtatctgttgtttttggtgtccccaggggtccttgaaccaatccctcatggatactgagggatgacttcatatgttaatagtggcatatcaggaaaccgtatttaatttgggaatagtaagggtatatacttacctaccagcacagcctagcaaatatttctttctctttataaagaatatttatgcatttaaaaaatgagaatgcatttaattgcgttagtcttaattcttcttttttgttgtttttttttaataagcctccagctgttccagacaatagaagacaggcagaaagtctttcattaactagggaggtttcccagagcaggaaaccatcagcttcagaacgtttacctgatgagaaagtcgaactttttagcaaaatgagagtgctacaggaaaagaaacaaaaaatggacaaattgcttggagaacttcatacacttcgagatcagcatcttaacaattcatcatgtgagtaaatctggttcagcagtattgggtataagacacacaagtatatatactgtcacataataaatttagtatttggtgaatgaacacatagctcctcaaaaatatttgtagggacttaagacttgcatatgaaaagtttctaagttgcaagccaatatatatgaaagccaaataggtgataaatcagttttataattcagaaaagggaaagaataaagttggaccttgaaaaattagtaggattttaataagggaaaggtagaagagaaggcaactgtttgatacgtggacatattaatactttgtttcttaacattcaaaattttcccttaaagaaaagttaatccagttagtactttgatttaaaaacccaaaactgtgaaacatagtgtgtattaaaaaaaacaaaaaacaaaactatgaaaaacttttatatatggtttagtctagagagcccagaacttccaactgctggatttatattcatttttaaaaaatatataaataatcatctcaagcaggtataactgcgggagttatcttttttgctccacacgtgtttaaccttctttgtctaaatcagatctagtcttcagttcctatcctaataccttttcaaacatggcccctgtctcatatccaaatagtaatagaggctcaagcattagaaattgaagtcagtagggacaacttccaactagtctttaaacattctagctgctgtctaattaaagaaaagatgagggatttaaaaataacaaaaccattgtctctggagcctctggtccttattctccacctatctccttttccttttccacccacaaaagaaccttaatattcctgtcctaaaacatactcctttcttttctctgacttctgctagtctctttctcctctagagtataatcccagtttttatcctttacaaacacatgaatacaactaagatgtgtggctgggtgtggtggctcacgcctgtaatcccagcaccttgggaggctgaggcgggtggatcacctgaggtcgggagttcgagaccagcctgaccaacatggagaaaccccgtctctactaaaagtacaaaagtagccaggtgtggtggtacatgcctgtaatctcagctactccggaggctgaggtaggagaatcgcttgaatctgggaggcggaggttgtggtgagccaagatcgtgccattgcactccagcctgggcaacaaaagtgaaactccatctcaaaaaaaaaaaaaaagaaaagaaaaaaacaacttaacatgtgaaagttgcgcttaagtccttgtcgtcagttttgtatgcataaagtagcactccgtatactgatgactcttaaagcctatttttttcctcactgggaagcagtgtgagagcagcagcaaaaggtagactcgtcaaggaatagaatgaggagactgctggaaaccacctacaggaattgtggtactaaagtgagcaacaaataatgatggttcctttgagaaagatactggtaaatgacagcacctttgaaatggtaggaggtagagaagtgcaaagattcttaatctttaattcctcttgaaagcatgatttatatttgatagtaacagaagttaaatagaaagtaattaaatttagttcaaggaccatagaggattagccattatctaaatagcaggtttttattgctgtttaatatttcatggtttgaggtaccacagtcacttttaacacttttctttctctcctggagcaagaaaagttccttcttggtgtccagatgtgacatccccctgatctgtgggtatgaaaaactgatgaagacctaatcagctacagctaccctgtaaagattacagattgagtactgcacatgattcatagtggccctgtttaacttaacctagaaccaagtttatcaagttagttaccaagtttactcgttagttaaaactaactagagtacttctctagttagttttccaaggtagaatatcattattcttgtcaatttccatcttttttctttcctttctgttttaacccagtggttatattgtaaaggtgatagaacctgtggaagaaagaggtaaacaagtctttgtacattttgatgtgtttaattgtggagtaagttaataaacaattttctgaaatttaaatctgcagaaattaagttgttaatttttactttttagttttcaatatccaagccaactgtatgtgtttgtttatggtaactggtgattaaaaaaaattttttgttgttgtgccttcttcagcctctccacaaaggagtgtcgatcagagaagtacttcagctccctctgcttctgtaggcttggcaccggttgtcaatggagaatccaatagcctcacatcatctgttccttatcctactgcttctctagtatctcagaatgagagtgaaaacgaaggccacctcaatccatctgaaaaactccagtaaaacatttataatcattgtttacatgaagttaaataatagggataaattctgtttttttttttatgttgaaaattctgcaaaacgagatttatttaatattgttgtaaacattcttaagggataggtagaagaggcgtgtgtgtgttgtgtgggcataatttgagttgtctaagagatgtgatgtaacatagtttctgtgaactgatgttactttcttgtttttcaaataaaggatcaaaaataagattacagttaaaatatttctatattcagatggtttagagaccaggctgtagaatcagacagccctgaaattgtatcacacaaggctgtgttaccctgtacaaataacttagccttactaagcctgtatttcctcatctgcaaaatagggatgataatatacctgttgataaatatgttttcattaaaaaacgttggcgcagttcctggcacttacagtaagaactcagctaacttaatttttatttttggtaaacgtagtatgtagtgtatagatctcatatgtgcagacaaatcaagaaccttccatacatgctcagtaatgtctgtatacctgattttcctgagaggtagtatttagtagtacttcacacttttgatacttgagaaactagaaatctttttgacatcaggttttctgctattaacatttacacctgcttaaaatgaacaattaaattgaaattggttttcttacacttttgtccctaaaacagcataagaaaataatgtgagattttgagtaagctgtacttggcattaacctcattattttacagtcataccccctggagagttcactaggtggatattccattaggtctaaattttgtttctgttagctgctatgatatgaaaataatgtctgtattattttgctaaaatgggtgtaaatcgtatacataaattttttgtttatcaggaagttaaatgaagttcgaaagagattgaatgagctaagagaattagttcattattatgaacaaacgtcagacatgatgacagatgctgtgaatgaaaacaggaaagatgaagaaactgaagagtcagaatatgattctgagcatgaaaattccgagcctgttactaacattcggtaagaacttttctggggatgtttttccagcatattcattctgtcttgatacttataatgtgggaacaaaaatacttcgttgtagtatttactatttgccttttatttaagctttctactattttggtcagtgtaatcatctctgccctgtgaagaaagatgaatagggaagtatggagtacaatagttcagtaaatttgccctttgttagactgaattcgagtaaatcatgagatgtatctaacttagcattttgctgtctttttctttttaggcgtaattttcattttttcagatgtttttctacttaaatagcacatatgcagaagttaatgaaaagcaggagtcgattattcaatttgaatttaaatggaatagccaacaatgtgcttggtttggtgttattttattagcagttctaaacttggatttctttctctctttttttgtgccttaaatgacttcaggctgttttctttcttctagaaatccacaagtagcttccacttggaatgaagtaaatagtcatagtaatgcacagtgtgtttctaataatagagatgggcgaacagttaattctaattgtgaaattaacaacagatctgctgccaacataagggctctaaacatgcctccttctttaggtatgactgactgtatttacatataattttgctgtgttattcttacaaagtgggttttcgttcatgtgtgctctttcctttaaaagttactggttttaattatacatgttttcagcagattgtcgatataatagagaaggggaacaggagattcatgttgcacaaggtgaagatgatgaggaggaggaggaagaagcagaagaggagggagtcagtggagcttcattatctagtcacaggagcagtctggttgatgagcatccagaagatgctgaatttgaacagaagatcaaccgacttatggctgcaaaacagaaacttagacagttacaagatcttgttgctatggtacaggtaaatattgcttggtcttttaaaaacctatttgtcaaatagtacagtcttaagtaaaatttgtgtatgataattactttggtttaattatactaatacacatttatgtatcatatgtgaggtttaaatttttagcactttacatgctgtatgtcagaggtcagcaacctttttaaattaagagtgagttggttagatagttgcggctttgtggcgatatagtatctgtcacaatttcacaatgcaaaagcagccatacataatacataaatgagaatgattatttgccaatatagctttattttattataaacaatatagctgtttttatttacaaaaacagaagaggttttgttgtttttgttgttttgctgacaactctggccttatattatgtacaacttgcagcatctcaatgaggtagacattaaataggttaaagagatcttaattgccgaagtttatatgactgtccaatccagaattcagacttcctgataccagagcctgcgatcttaacctactgtatataaaagaaaaaccatatgttatcttattcagtaaggttaaagttagaactattaatcataaattttaaaaagcagtttatacatattttgtattatagttacacaattaactataatgtacaattgtatatttatacaaatgtaaaaatatacaattatagttacataactattaacacaaaatatgcctacacttataattgtataaatatgtaattaactataattgtattaccgtgtaactattaacacatttataaaggtgttgtgtatatatatataaaaatcatataaaatggtttttgtgagtgaaaaacctcaagttttattaacagtttcttttgaaatgctatgtactttgaattactcaagtaaaaggtgagcgtgctctctcggttcaaaaaaagtacgtatttgtatttatttattttttggggacaaggtcttgctctgtcacccaggttggagtgcagtggcatgattttggctcactgcaagctccatctcccgggttcaagcgattcttctgcctcagcctcccgagtagctggaattacagatgtgtaccaccacacctggctaatgtttgtatttttagtacagatggggtttcaccatattggccaggctggtcttgaactcctggcctcaggcagttcacccaccttggcttcccaaagtgctcagattgcaggcacaaaaagtacatattactaataaactctgtctttacctccattaataatcctattcttcttcactgaagttgctaggccttttctctgcagttaggtacatcactatgcacctatttttaaaaaaatacatgacgttttgtggtatgtttctttgtttttacaaactgtatatataatacactaagtattattttatagctttccttttttccccactccacattgtctcagagaactttcatgtcagtatagttctatataattataagtaattaagaaacacaaatatgataattataaaatataaataatactgcatatatatatatacacacagtacatagttatttgtagctgcagtacagttttcagtatatcgatggactttagttaatgtataatagcatccagttactatatacttgttttcaatctttcgctatttagaaacaatgcaccaaagaatatacttgcacaagcttttgtgcatttgtgttttttaagaaggatttggagaagtggaactactatgtcagttggtgtacattttaaaggacacaacttaattggtctctagagagcaattttctatatgtatttccgtatgtatttatatttctatatgtatagaatttttgatatgtattcatatttttctatatgtattttttatattttaagcagtggtatgtgagagttcgtttctccacacccttgattgtgttttattttattgatataccgtagcttgtttaaccattactggaattggccttttccaaatttcccaattataagaagagttattgaggtgagataaacatgtatgcaaatacaaacgtgtgtaaacaaatatatattgaacacgtgtacacatgtatacaaacgtgctttctttactgctttaatctttttatgtaaattttacagactagtggtatttactaaggtatgaattggataatgtcttgaggtatcaagattgttttaatgtaatgatgctctttcaggatgatgatgcagctcaaggagttatctctgccagtgcatcaaatttggatgatttctacccagcagaagaagacaccaagcaaaattcaaataacactagaggaaatgccaataaaacacagaaagatactggagtaaatgaaaaggcaaggtatgttaagcttttggccttcatttaatataataaaaatttagtgcctgttttggagaaggtgctcagctaggtactgtgttatgttgtgcctaatgcttcatcacattttattggagtccataaatataatgtcaatttaattgtagagagaaattttatgaggctaaactacagcagcaacagagagagctaaaacaattgcaggaagaaagaaagaaactgattgacattcaggagaaaattcaagcattgcaaacggcatgccctgacttacaggtaattatgaaatttatttctaattgtctgaaaaaagatgtttaaaaccttaggtcaactgaaagtactcttttttgtttttgtttttctttttttttgaggcagagtctcactctgttgcccaggctgaagtgcagtggcgtgatcttggctcactgcaagctctgcctcttaggttcacgccattcttctgcctcagcctcctgagtagctgggacttcaggcacccgccaccatgcctggctaattttttgtatttttggtagagacagggtttcacagtgttagccaggatggtttcgatctcctgacctcgtgattcgcccgtctcagcctcccaaagtgctgggattacaggcgcgagaaactactcttttttttctagtattaaggtgacagaattatatctagtaattttgtgattaatgaagtggatgaactaatgaagagttggggttatacgtttacagtgtaaaagacagcacataggaattgactcattattttcattcttactgggctggctggccatagattcagaacatgtgtactcataactgtttattatgttaaaatattctgatttgacttttgcagttatggaccagcatttccatcttttactggcctgaaataatataataaaatctttaagccaccataagatatctaaggaaaataactgtatgtggtttaaagagtaagttgtatatacttttgcttattaactaggatcttatacatgggtcttgagattgaacagaaaataagatatctttggtgatatcaaataatcagttaataatatgggaaggggataataattccttctgatattttcccagagtttattggctagcttttttttttttttttttttttttgagacggagtctcgctctgtggcccaggtgggagtgcagtggtgcaatctcggctcactgcaagctccacctcctgggttcacgccattctcctgcctcagcctcccgagtagctgggactacaggtgcccgccaccacgcccggctaatttttttgtatttttagtagagacggggtttcaccgtgttagccaagatggtctcagtctcctgccgtcgtgatccgcccgcctcggcctcctgaagtgttgggattacaggcgtgagccaccgctcccggcctattggctagctttatcttcagttaggttgtgttttcaaagaaaggaaaacagggcaactgtgttcattttctaaacccttgcctttcctactgtatctaatcctttttctctccttatctccaatctaaataatgtctagagaaatatgttgcaaaggtgggttaagtatacaaaattttccattatgttttatccctgttgtttctgttgtttctgagggcttgtgtttgttaacctcagcttgtgttttcatctttgttttcttatttcatgttatcttcggatgatgatggaagtcagggtctgatagcagattaaatatggcactagagccttagtgccatatttaaagtaactgcttttatgaaattaatataattgctttaattcctcataacgttttttgtgaattcctttttagctgtcagctgctagtgtgggtaactgtcccaccaaaaaatatatgccagctgttacttcaaccccaactgttaatcaacacgagaccagtacaagcaaatctgtttttgagcctgaagattcttcaatagtagataatgaggtattgtaaattgtactctcttgttcctgagttagtcttttgttttcctttttttttcttcaataaggcacatctcaagaaaggaaactgaatatccttgaaacatgtttgtaaatagtagtctgctttgtgccttttttagtagacacaaaaatgtaatagattataataatataagaaagataaaacattttaatttttaaactttaattgaaaagttttaaataattttttctaaaaagtaattatcttttaaaaatatccatgttctttgttagtaaatatttggcagaaatatataggggggtagttgcagcaaatagtaatcatttcagttagaaagacctatcctttgacattttatttatatgtggtttgtagaaaatataatttttcctaaataatttctgaagtatatttgagttctacttgtttctattaataggccatgtgcggtgactcacacctataatcccagcactttgggaggctgaggtgggcagatcatgaggtcaggtattcaagaccagcctggtcaacgtggtgaaaccctatctctactaaaaaatacaaaaaaaattagctaggtgtagtggtgggcgcctgtaatcccagctactcaggaggctgaggcaggataatcacttgaacctgggaggcagaggttgcagtgagccgagatcacaccactgcactccagcccagatgacagagtgagactctgtctcaaaaaaaaaaaaaaattggctgatttttttgtaatcataactatattattattttaaccttcatggacatgttagtgtgaaaaggagagaatgagaatagaaacctttgttgatactgacaatactagtagtcttttactcttttaggctacagcaaatccaaatatttatttaactctggtttcttaaaaaaaatagttgtggtcagaaatgagaagacatgaaatgttgagggaggagctgcgacagagaagaaagcagcttgaagctctgatggctgaacatcagaggaggcaaggtctagctgaaactgcatctccagtggctgtgtcattgagaagtgatggatctgagaacctatgtactcctcagcaaagtagaacagaaaagtaagagagctgcataaatcacttttctaaaaatgtcacctgccgaagattgacctgtaggctaggcagccacatttctcctctacatcacagcacaaatctgctatttcagtgaggctactgtttaactaccacctttgtgacccagtttaattgaatccagccactttctgttctgacttctcgtagcatcagctttctcttttgtcttaaattactatggcacttgatcaaatggtgatacagattttcttatgtgtataagccttattagttaagtttataaaaagaaaatgcttgatattttgtagtgcttttctgtcaggccagaaataggcccttttttgcttaaattgagtatctgctgtttgtaaggttcttaaggatcttaaaacattttattataatcatttagtttttaggatttcagtttaaaatgtccatatttagaatatttctaaaagagttggtcatctataagatcagtgaattatttagctatatagtagtaaccatatcaaaaattttgaaatatagatttgtttatgaccttcccttttgatatcctcagatggcatttctggaatttctggagttttgcaccaagccctactctcttctcagatgaacttctattcttggggtcccaatatgcattttactgatcagactatatctacaatattttattctgttctgggtactacacgtctgttcttctacagagttcttcagatagttttgatgagcatctggtttcagaatcattggtctggatttttgctgtccagtatggcagccactagatataggtggttatttaaatttcaatcaaatgaaattaaaaatttattttctcagtcatattagctgcattttaagtgctcagtagccatgtgtacctagtgtctactgtattggatagcacagatacagatgattgccgtaattatagaaagttctgctgaactgcactgatcttgaaaactccctcaagcaaatgttaagggtagtttagctttgggaagtagtcccaggggatatgatgattatttaaatgtatttgaagaattgttttgaggaaggcaaactaaacatattctgtatataacagcaatagggagagtgccacccgtagcatagttattgtgattaaatgaaattttatatacagacatgtatatgtatgtttgaaacaatgtctggcacatagtaggtggcagagtatttaacttatctccagaatgacatctgttttatgtctcttaatcactagaacgatggcaacttggggagggtctacccagtgtgcactagatgaagaaggagatgaagacggttacctttctgaaggaattgttcggacagatgaagaggaggaagaagagcaagatgccagttccaatgataacttttctgtgtgtccttctaacagtgtgaatcataactcctacaatggaaaggaaactaaaaataggttagtttcagtattttaattttgtgcttaatttaagaggctcaggtctttttgactgacagcaagcacttctgcagttctccaagccaactgaatgtcctacaactcaattcaatttttacactaactactcagagttagtgcagacccctcaagttaaggggctcagttcagtaagactgccctcacctcagacttcaatttcaactgcttggtccccacgttacccacacttctgtgcaacatggctagaaatttgggagttcttacaatccccttcaggtttatttgctagaacaactcacgaaatacaggaaaagacttacttacgtttcctcatttcttataaaggattctgaactgccaaatggaagaggtgtgttaggacagtgtgtgggttggggaggtgtgcagagcttccatggtttcctctgtgtgtcccaccctccccagcactttgatgtgttcagtgacccagaagctgcctgaattctgtttacggttttttaggagatttcattgcttaagcgcaattgataaaattgttgactgttggtgattgttctcattagcaaaaattcacatctggttgaaaggggcttgttacggataacaaaagacattatcacttgggagattccaagggttttaggagctctgtgctaggaaccaggcacaaagaacagatagatattttattataccacaagaatgttgttccagtagatccaggtaaactggatcagtcttcactcctgctgttgagaattaagcaaaaataacaaattgtagatagtgaaaagagtctgccaacaaagatgttattacattgttactaataattataactgaaaatttcttcatgaataacagatggtgaagtagatacagtagctccacttgatgaaatactatgtggttgaacttaaagcgtgaagaatggaaaactacttgtgacataataaatatttttattttgcagaatacttaattatatggacactgctgtgtaaaaacatacatgaaaaagactggagactaatgaaaactaataattgtacaaagctaaagatctggacttctcccccctctatattttttaatactttgtatgttcttttaatttaaaacagaatattggcccataggcctgagtatcagagtttattgctgtattttaaaaaccaaattattatgtatgatgacttaatgctttcaatcttgtgttaggtggaagaacaattgccctttttcggcagatgaaaattatcgtcctttagccaagacaaggcaacagaatatcagcatgcaacggcaagaaaaccttcgttgggtgtcagagctctcttacgtagaagagaaagaacaatggcaagaacaaatcaatcagctaaagaaacagcttgattttagtgtcagtatttgtcagactttgatgcaagaccagcaggtaaaatttgctatgaaagtatatttttcgtctatttttataacttctgaagcaatacaaatttttctcaagtcatcagtaactattaacaaacattttctttcaatagactctatcttgtctgctacaaactcttctcacgggtccttacagtgttatgcccagcaatgttgcatctcctcaagtacacttcataatgcaccagttgaaccagtgctatactcagctaacatggcaacagaataatgttcagaggtaatctgtttcttagaagtattgagactgtataagagctaacattgagcagaggttttacagttagcttctgggagaaaagagcaagaccaaattgcatatttggacattctctttcccttgagaattttataagtggtgatttacctaatgtttccttttaataccatggatttctgtttttataaatttatgttattgaattttacttatattttggcagattttatggtgtgtaaattgtaccacagtgaagctataaacaaacaaaaaagtgattttcttacagttttaccgactgtcggacagaagtactaagttcatttcttgttccagagggaaagttattgaattaagccttatagagcaagcacgtatttgttacagtatcagagcagtttgtctgcatgcttttgaatcatttttttacatgtattcttcctgaatgtactttatatatatggcaatataactgattcttagattactgacttaaatctttgtaggttgaaacaaatgctaaatgaacttatgcgccagcaaaatcagcatccagaaaaacctggaggcaaggaaagaggcagtagtgcatcgcaccctccttctcccagtttattttgtcctttcagctttccaacacagcctgtaaatctcttcaatatacctggatttactaacttttcatcatttgcaccaggtaggtgacttaacctaaagagaaaataaataaaagcaaagtgtttggaacaacgtaatttgtctattgcctagatgttttaacattttcttttggagtggggtaggaaatgtttgcaaagaaagttacaaactcttttttttttttttctttttgaggcggagttttactcttcttgtccaggctggaatgcagtgacatgatcttggctcacggcagcctccacctcccaggttcaagggattctcctgcctcagcttcctaagtagctgggattacaggcatgtgccaccgtgcccagctaattttgtatttttagtagagatggggtttctccatgttggtcaggctggtctccaactcccgacctcaggtgatccacctgccttggcctcccatggtgctgggattacaggcatgagccaccgtgcccagcctacgttgttccttttaaaccaaactttaataatacggttgctaatgaaattaagtaaactacttaggaatgattgcttcaactatttattaagaggaaagagaacctgttcaatggctgctgtatactaggcactgtgtaaaacgctgggagagtaaagatgaataagacagtgctctcctaaaggagtaccatgtcttgttagggggatgctaatagactaaaggagagcacatttagcttaagcttttctttggatggttttttctgcactcattatgtaccagacactatgtaagttactgggatctaaagatgagtgacactgatcctttaaggaattcagggtctagtgaggatgctgttaatgaatgcttatagtacagtgccacgggtgccataacagtagtgcaaatgctgggaagtgtcagcaaatcagttccgccgccaaaaaaaaaaaaaagagttgatatttaagctaaagaatgaatagaatttatttccagagagattagaaatgaaagggctttctaatagaaccacttagagttataaagcaatgaaatagtacatcactcagggaatttagaggtatttaagtgtggctagtatttaggggaagagtaattgatgtggttgaagagtggcagagagattttatgatgtgcaaacaagcttaggttttatattgcagacgagggtgccattgaaggactttgagcaagggataacatgaaatttatattttagaaagattacactggtgaaagtgttcgggagaagttggaggaaaggagtgaagatttagctggtgaacagaaggctgtcataataatatggaaagaatgatagcttggccttaggccttgtcagtagggatcaagaaaaaggagtaactgaaagacattatagtgatagagtgaataagttaagtgaccgattatatgaggtgaatcatgaggaggagttaaaggtgttggcagggaatataggaggagaaaaaaggttgagagggctttgtgaatatatatatatataatcacaatatatatgtactcaatacttcttacatacatatattacagtgttatgcccagcaatgtgtatatatatggatgtatatatgtgtgtgtgtgtgtgtgtgtgtgtgtgtgtgtatatatatatatatacacaccacagtgttttttctttataggattttcaagacagtggcataaaaaatttaagagactttttagttcttgggtgtcaattaatattggcagcaaacatcacatgagtagacttttaagtaataagaaattgcaaatgctcttcctttttactaaaatatacttcatacccacaccaactctatataaaggctcttcattcttcttaacagtacaatttttgtgaaaccttcccagtctctttccccacacgttgttagtagcctcttgcaaatagctctgatacataacagtatttggtaagtatttaattatattctactttcccaataaaaatagagtagaaacaacataagcgtaggagtcatacagacctgagatctaatcatctttttcatttattagacgtttgatttctaaccgtatttgctcactggtaaaatgaatgcagtatctattttataagttacttggttttaagtattaaaccaagtaacatgtaaagtgcctgcagtagagtgtgtcacccagtaattgataaatgtcaggtaccattatttctaacttttagctcttaagggagtggggattattaattgtctttgaccaatgcctaaaacatagtggcctaagctgtgaacagtgattggataaatattagcttttttttttaattaacagttttttgttttggtggatttgaatgacatgtttaattaaaactgtcttttaatttcattttaaagctaaagacatttatttatttttctcttacccattgcttttactgattaggtatgaatttcagccctttatttccttctaattttggagatttttctcagaatatctctacacccagtgaacagcagcaacccttagcccagaattcttcaggaaaaacagaatatatggcttttccaaaaccttttgaaagcagttcctctattggagcagagaaaccaaggtactgattgtaaacagtcttttattgcttaaacattcacttttgtgattacatctaattatgtgtaatttgaaaacacaactagggaggacgtttgtgatgatttggcttgatgatgttggaaatatgaaactttgacgtatcagtagatgagatgccagatacttcctggtaaccctggtacattaaaagttgtttggaaggatgtggcgtaactcataggatttgttttgtctctaatttgatacctgtctttacggttaaagcagtttgctgttcaatgacttagggctggaaactaatattaactgctagaagatagttgttaagtgatgatccctttttttgattcctagctcttgattagaatcacttcctaaagcctattcaaatataatgttgagtactattagattataaaaacaacttttgtctcataagttttgaggatgcatggtattaatgatatttaggatttcttctgaaacagagtttttgactcagtgtgaaaggttggctccgttgaacctagtctgtcagatgtatctctctgattgtctttcctactccataaaaatatatataattcacattatatttctctttagctatgtgattaggaaggtctcaggctcttatattagcattttgacactgtttaattactgagtcattaactgggatttttttttttttttactcgattaaccaataactctgagaattccaactttgtattcaccactaggagtgctatgattaacatccgttactttgttgactccttttttttggttgttctatctttttcctgttaaatctcatgttgctctataaaggtattctgttgtcagaagcctaacacagtgttagttcacagttgccattcagaaatgattgttgaatgaatatccatcacgagcagtaaacatttattcaaagcttcggtgaatagactttcctattagaatgtccctacttcattattttcatataattgatagtaaaaaattactctggttttaaattatttatatcatttttaggatggatctgaatgtctaatattattttagatatttggcctacttcagattagacctcatttcccaaaatctcaactattgtaatttcatggaattaaatgactagagataaaaagtcagataaaatcctgtagtcttattcaggggtcagaaaacttttcctataaaagactagatagtattttaggccttgctggccatatagtgtttatcatagccattcatctgtgacagttttgcacaagagcaaccataggcaatatgtaaacatgagtatggctgtgttctgcaataacactttatttatgggcacagaaattttattttcatataattttcatttgtcacaaacttttaactttttttcttccaactatttaagaatataaaagccattcttagctctcaggtcatatggaaacaggcagcaggctgaatttggtctgtaagttacaggtttctaacccttgtcttgagttaaatcctgtaggtcactgtctcccagactattaggagcagtgttgttgttcacgctaggttctgtgataaagttttggacttgttgcccactaccacttttaagagatttataaagcacattggcatattaaaagttgtgagatattttacagacctgtttaactttgttttatgtgttttctccccaacctagacgaccgatgagtacctattaaatattaagggatgctagtgttcagcagataaaatttgagaaatgacagtagactaatagaactacggacttaaggagtggagaaataaattgctaattgaatgaccaattgtattcaccaaattcttgttctacttgaactgctttaggtgaacacaaatccatgtatgttcccaagccctctgctatagctctttttgagccattcttccaacttttgggtcttgtatatcccatcctcccttgatttttctttttgttgttttttctagaggcagggtctcactttgttacccaggcaggagtacagttgataacgatcatagctcactgcctccttgaattcctgggctcaagggatcctcctgcctcagccccctgagtgtctaggactggaggcacatgccactgtgcctggctcatttttaaaattttttttagagacggggtctcaccaacttgtctgggctggtcttgaactcctgggctcaagcattcctcctgcctccgccttccaaagtgctggagttacaggcatgagccactgcagctagcctgatttttctttcccactgttttccattgctaatgctagatctttgataaggaacttttgccagtaaaagtggtttagtgagatgggtccagaattaaaactaatttactaccttagcttatgtgatatttgcatatttaatgtgtatttttgtgaaaacatttttatagcctgttgacaattttattcacctaaatctactcgagtagactataaattcagtgtatttggagtttttgtaaactatagttgttaacttataaaaacttgttttcattggtaaggaataaaaaactgcctgaagaggaggtggaaagcagtaggacaccatggttatatgaacaagaaggtgaagtagagaaaccatttatcaagactggattttcagtgtctgtagaaaaatctacaagtagtaaccgcaaaaatcaattagatacaaacggaagaagacgccagtttgatgaagaatcactggaaagctttagcagtatgcctgatccagtagatccaacaacagtgactaaaacattcaagacaagaaaagcgtctgcacaggccagcctggcatctaaagataaaactcccaagtcaaaaagtaagaagaggaattctactcagctgaaaagcagagttaaaaacatcagtaagtgttgaaatttgttgaatgttgatcagtgtaaattttggtaatcttactttgacatgttgacatagatatagtttcagtaaggctagatgtgcaggtgctgttctagacttagttgaacagtcatttttagttacctttatatatataatttttttttacaaaataatattcgaaatagggtttaattttctggattaatgttgtaaaacatggcatttattttttgtacttcttaaagcttcagttttgtagattattgaaaaattgccaaatgcccacgtttactattttttttcttttgctattgtatcagatcctgcatccaactctttggtcatgacttttagatggattcttgattgattagtttaaagaatagtgggcttctaaatacattgcagtttttgaatatcatatgataaaaccagttttaaaacaggctggcttaagtccttctggaagtaaactcatattttactcagtcttgccattgaatgtcatattaaagttgtttaaaaaatttttttaaaattttctttatggtgttagtcatacctcttacaaaaataggttttctgtgatttttgaattatttactgaagtgtagtactaggttaaaaatagtttcattagctaaaatctgcagtgttacagctgaaggatattctttttatgtttgcaaaggatgggctatggccttgaaaggttgttctgagtttaaggagatagtatttggtgcctaaggctagttgcggtggctcatgcctgtaatcccagcactttgggaggctgaggcaggtggatcacctgagagcaggagtttgagaccagcctgaccaacatggtgaaaccccatctctactaaaagtacaaaaattagccgggcatggtgggcgtgcctgtaatccagctactaaggaggctgagacacaagaatcgcttgaacctgggaggcagaggttgcagtgagccaacatcatgccactgtactcccagcctgcgtgacagagcaagtctctgtcagaaaaaaaaaaaaaaaattggtgtttaagaacaaagtattctaggcttataatcaggaaagtttgaaatgcattgcacactgctaactccctttcttggaagttcacaacacatacaagtatagtaaatgccctgagaaatcctgtagtaagaaaatacacttgtaaactttggcaaccttcatcttaatcacttttggataatgaaaccttagaaaaatctaatgaaaaccacagatacaagagaatattggcacatttttaaaaatttcagtaattcatctatccttgaagtccttggctcctaccttgaaccccatgtgaagaatctgacggatggtttaaaaagcaagtttgaacaggagtgaaagaggtgacatttttcttagcatacacattatcagccttgaagtaattttctggttataaaggtttaggagaagctggtttatttagtaaattaattggtaatctgaagctattcagaaagttactgcgcttttccaagattactgttggtgctaccagagaagatttaagtagataatggccatttagagacagggccgttaggcaactcagaactttctatttcctagtgctttgccctcacagagatgctctttgtcatataaataaatgaagaaaagctgacattttaaatttcagcattgtctcattcagatagttaatttgaatctgatagggcaatacttcataaacttgagtttcacatgaatctccttaggaatacagttttaagtgcagattctgattcatttgacttggaagggacttgagagtctgccttcctaacagactctcttgtgttgccagtattggtctgtggactacacttcaagtagcagattttacaggaaccttagctaatttatggctatgaccacctaaccctagaaatattggtatgttttaatttttctgaaacccctttattctcgggaattacttttccaaatatataattcagccttttaacttcaagacaaagattgacattctgatctttgtgctcttgtccttcatattgaagtataaaaatacctgctgtttgaaatgtacagtcacatttgctcaacaagcattcaagaccatctgtcagtgagtgccccactttaaggcacacacacacacacacacacacacacacacacacaaataaaaggcttgatagcagaatcaaactatacatagcagagccgaagtaatatggggtaaaatcaaattagctcaatccttgctattcaaactctgaactgtggacaagcagcattacatcatctgggatattattagaaatgcgtgcttttgggcctcaccttatgccaactaaatcagtatgtatttttcttcagtatgcattttggcaagatttttggtatgaagatatgtacgtgaaagtctgaaaagtactgaactagaacactggtttatgtggtttttgttccttttgtgctataggaatggtcaagatttgttagaaaaaaggatttttactgtatctttaacctccacctcccgggttcaaacaattctcctgtctcatcctcccgagtagctgggattacaggcatgtgccaccacacccggctaattttgtatttttagtagagacggggtttctccacgttggtcaggctagtcttgaactcccgatctcaggtgatccacccccattggcctccggaagtggtgggattacaggtgtgagccacagcgcccgaccaatttttattatatcttaaaggaagtggtaaatagaggtgggtggggaaaagtttagaaagcctttcaaattgttactacagtaagaaaagtatagagtggggaacaagcaggatgagaggaattgggaacggatatgacagatatttcagcatagtgggaattacactgctgtcttgagagatatggtacagccagttatactgtcccatacttactagactgatccaaatatatatgtgttttttgtgcatgttgacattctttcagaagtagcttgataaatctcatataactttgtttcccatgatggtaatgtgttttaatccttagaaggtctttatatatgaaaatagatattgcatatgaggtaagaatatataaattatgtaataatcgtattttaaacttgagttcagacttagaccttatgagttgaaggtgatttcctgccttactgagtttttctgttatcagacctataatttgtttacactatactcttctgatattattagtagtagccaagattttcttcactcttttcttggaaaattggatagaactgttaaggtacagccttctgggttcttactgtccttgaatcttttcatttcttccttcctccctttcctgttgcacactaatgaagatggacatgaaatggacgtgaaacattaggcaaggcaaggcctgacagatttggctggtaaacaactagtcaactttttgaatttagacagttattaattacttaggcagagaaaaaagtagtccaaggtgccatttctctgtgccccttgtctcacacttgaaaagagtgacaccgaaataaaaggggctagctaacgattgtcccttgaatggtgggacaccctgttgctgaggaatcattgttatactgcagctaagcctgtttagtctgcaaatgtaccctacaaggttgaggaagaaaggtctcatgtttcattagaacctgagaggagatgggaaactctcctgacagaagcatcctggggcaagagagaggtgagtggaaaacgtccatccatatagcaacttctcacaagcctctcttgtccatgttccaggatgattccatggccttctgccaagacagcttgcactgtgattcagaccttaacctctctgcgctctttggacatgtgcaaggtctccagagtgccatggctgatctctttcccttcagtggaggctcaagtagaagtactgtttcttctactaatgtcaccccctcatgctgagaaaaacagaatgagaaagggaaagagtggtgaagtggcataggcgataacatccttatctctcatcagtcacacattagtaccttaactttggaaatctagcctttgatgtttttaatttgggactcatatataaaaccagttttttttttttctcttttcgtagcatcttaataattatagcctacttctcttcacagtttcagctattttggaggatgactgtatgtattcctttttaaagtacctattgggactccccactgagaatttcgtatatgccacattaagtgcattttaattttgattaaaatttattcatcacttttcatgtgatacagtaacagcatttaaatgtttaatttcacttatataaatgttcatgttagaataacatacttaaaatctttttctttagatcattgtatgttattaaatgagcaatagtactaccagtcatgtcattttacatattgcttttggcactcatactctttattgctggttttatattaagatcaataataatcaagaggtctctcttttcagtaaatttcatgcagactcggtggcagaggctaaactttagtttgagagaccagtgaaaaaacctggaacctaaagttgagatgatgaagtcttacataatggccttggaaatagagagggagggctgaatctagatgggatatcacagataataaattgacaatatttgggaaaattatttgttgttagtagacctgtgcggtgatctggaagatgcaagcaaggctttagggtctgctggctttttcctagagtgtcaggagcatggtcagatctccatgattcttggagaaagctatgttggaggagatccttgcaattcctcctgttattaacccttccccttacccccaagagtagcagtgttttgctactgcaagctactagttggcagaaaggttattgagtaagtaggtggcagtcttccttaaccctgtacatgggagagcattagtctttgcagctgaagagactaagcagtagagaagattcctctcattgtcttgatgagggactgacagcttgctagcgaaaatgttgcttgaccacaggaatgagacttccatgcaccctcatcttgccattattaaagctatccagcatttgggtccagccttaagagaaggtgagagtcatgactaggccagtgaatataacagtgcatataaaagggacctagttaccagggagaaaacagaagtagaccactgaaagaggcaaaacctagtgaaaatagaattattgaacaaaatattgaacaaatacacttgaacaaaataataagggcacataagcagattgaattataacaaattctttagagctagaaaaaaatgacattaagttttaatgtttagattatttaaaaaagaggacacgtgctattaagttccaaattacaggcctagaaaatcagggggaagaattatgtcattaaatggaatgaaagtactaacagataaaatcaagagaagacgattagagacttacaagaagttctgaaggggaaaataaaaaaccaggtggacaagcaataactaaataatagatgggatgaagaaagacttgagactgcagatcagaacagctggctgttgtctagccaggagagaagtgagggaaacacacaaacacctatgcagagtctggcaaaatccctgaattccaaggaaaaagtaaaaatcctctaagcttccatatgaaagaccaagttgcatacaaagaaaaagaaccaaaccgacaccaggcaatcttccttaccacacaagcagaagtagaaaaaagtggaatgacgctacacagttgacaaagaactgcaactcaggaaccttgtactcagccaaaggaccctccacatgtcagaatgaaaaggagatactagtttatcctatctgaggaaaactaaagaaacaacctgtgaatcaaaatagagacctttatacaggggaagataaagaagacagagaacagtttaataaagaaaacagtagatcagtctcactaatataaattcaaaagtaaaaataaaatattagcaaattgaatctgccattgtatcaaaagaattctagactatcaacactagagtttatttcagacatgtaatgatgatttgttaccaggaaatctgtcaacataatttattctatcaaagggacaaataatcatagaagctattctcatgagaatttgaagtaaaatgggtataagaaggcagttatgcctgtaatcccagcactttgggagggcgaggcagttggattgcttgagcctggtaggtggagtttgcaatgagccaagactgtgtcactgtacttgagcctgggcaacagaatgagactcagtctcaaaagaaaagaaaaaaaaaaaaaaagcagttatttgagtgtaataaagactgttagccagtgtacatcattgtaaatgaaagtactccagagatatttctatctcagttaggaactaaacagggattccttctgtcccaccatcattatttaccattatttgggaagcattaggtcaaataattggaattataatggtagtaaatattggaaaaggaaggaagcaagttttatgtgttcttttctagtggcatttttgtatactaagaaagcccaagagatactggaaagtagctcctagagttacaaggtaaactgttaaagtggctggttatggaataagtgtgtgaatatttttctctgttgtaatatccagtagcatgaaagtggagaggaacgctcttctcatagtagtactctaagtgtttgagtggggggtatgaaatgtaaggaacaaatttaacaaggaaagtactaggtctataaaaagctataaagtatttttgaagaacatcagaaagattgaacaaatataaaaacataaccatgttcttaagatggaaaagatggaaatgcataagattattaaataccatttctcctgagattaatacatacttttaatttgattccattttgagtccccagagattgtttttaaaattaaaaacaaaaaacaacaaagcttatgtggaaggacagatgcccaagaatagtcaagaaaaaagtgaagctagtgggacttgccttagcagatatttgatcatcctgtataacttgtgtttctaaatgaataaaaatggcattggaatagctaagttgaacacataaatgtccaaaagtaaaaccccaaatattggaatttaatatattgaccgatgtgtattttaattcagtggaaagagggtaggtatagccacctatccatgtggaacaaaaaaaaaaaaggaatttctaccttgtatatataccaaaatattttaaaaacttgaaaattttatagaatatatgtataacctatcagtgggtaagaccttttaaaccaagtcatgtcacataaaagataacaataagaaaggcaaatgtatttgactactctccctctataatggatatttgtatatatcggatgtgattcttatgtctcctaatattaaaaattgctaacttggaattctagtagagatttggggtcatgtaaggtctgccatatacttcgaattggaatatactcattaagatgagtatcaaagaacagtgaaggttagatttattactgttagctcatgcttccaaagggtattgcaaagatacctccaagacatatttactgttttgtattctatttataccaggccttcctagcattgtaaattgagttacctgtactgttacacaatggaaaccgatttcccttttagtttgagttagttgcaactgataacagttgtcactttttttactcaagggtatgaaagtgccagtatgtctagcacatgtgaaccttgcaaaagtaggaacagacattcagcccagactgaagagcctgttcaagcaaaagtattcagcagaaagaatcatgagcaactggaaaaaataataaaatgtaataggtctacagaaatatcttcaggtatgttcttttttggtttgcattaatataaggaggttttcagcttagatttgaaaagctataataaagcaggtgttaaaattggtgtttcacacgtatctatcatgtggaaggttttatagtggaaattatagtacacattccttgatactgaaaaataaaaactgaaaatattttgtgttatactatttaatagttttggacacattttaataaaattctaaacaaaggatagttacaattgtggaactcttcaaattctgaaaatcttatctgattaagaattagatatgaaatcatgtcatctcctgcttcaatcctttggcttactgtgcctacaggataaagtctgaatgccttcatggaacgtacatggccatcagggatttggttccttcctgcctctccagactcatttctcaacacactctgccttgaacttttttctttctgtggcactgaactggagtttttgtatagctatcacattctttcttaccttggtagctgtttttctatctcaagtcctttctgccttttttgtaagttcgtttctctgctggactcttaatacaattttaattctgaaactccattctaatccaagctaggatagtttcccctttctcctgttttccttgtagcttgtgtaaacctattttgttgccttaatcacattattatagtatttccctgtttgtcacttttttgagtcccttggcagcagataaaagcaccagtagtttcctaatttgtaaagagcatctcaaagaaatatggagagagagaggcaataacatgacattagactatagtggatagaccttaatctagtagctttcattgacattagtataaaatgcatgcgttttttgtttaaaaatgataacagcagctatcttttgtaccatgctccattattttcaaattaccaacaaatctcatttgagcctcataatgctgagttggttttatttccatttttcggaggaaacatggtcaaagagggaacttttttttgttttgtttttcagtactcataaaggctcagtaatgtaaactggtacaactttcctggaaagcttcagaagtcatgcccttaatccagtaattgtacttgtagtaatccatcctaagaagacaaaaggggaaaaaaaaaaaagacattaagatttagtgttgtctcaacagtatggtttcaactatgtataaacaaaaatttgaaagcaaaaaggccggaagaaaatgcatcaaaatgttaatagtggttttatcatctttaaactcataatgagcatttatcattttgtaatcagaaaagaaacatcacatttgtttgcattttgaaatgaatttctcaagcttacattgctaggaaatggtaaagctgaacttagaagctgggcttctgttaagtctgtgttcctttctgcaaaaatatcaatcctattcttctgaacccagaattttactaaaattttataattttcatctccttttactctctaccaaatagtgatatcttcaaaaaataaacagtccggtagaggtcgaagaaggacactaaactgaaagtcttaataaactgagtatcaattacttaaataataattggacatagtacttcaggccctattactgttacttagtgaaatataatgattgaattttggtgaattaaaaaatgtttgaatatataaatatacacaagtttacatatttacattctgaaaagattaaaaaaaaaatttttttttgagaccgagtctcgctctgtcatccaggctggagtgcagtggtgcgacctcggctcactgcaacctctgcctcccgggttcgagcgattctcctgcctcagcccactgagtagctgggactacaggtgcgtgccaccacgcccggctaattttttgtatttttagtagagacagggtttcactgtgttagccaggatggtctcaatctcctgacctcgtgatccgcccgcctcggcctcccaaagtgctgggattgcaggcatgagccaccatgcccagccctgaaaagatttatttttagttttaatcattaccctaaaattccttatagcatgtaaggcatgttactttttgtaactgtactcataacatatgattattagagtatagcataataggactgctagtattaaattacgcagtcttcttctcccgtgggtgttgtgggaggttcaccttgatgtgtatgcttctaaaaatgaatgatagaagtttattatgatagtcatcatcggtcgccttaatatacgtttatagcaaaccttttgagattttttttcttgagattatttttaagtagagcgtaagccttagttcaggcaaacaattttaaagaaattcgcttatttctttttttcattcacttattcatgttatagaccctgtctttactactcatacacattttatgttcatccttatgtctgccctttcctacagcacatgctaggagaatactacagcagtctaacagaaatgcatgcaatgaagcgccaggtaacaatctgcgtagttttggtgtccactttttgttaattttttcccattggtcctaaaggttttattgtcctgatttttttcttttttaaatttagctgagagtatatatgttatgtgactattgtaaaagataatttatattcataaaattctgaacccattcatttataattcttggtaaaatttgctgcttttgttttcatattctgttagtgtatgtaacctaacacattcataagggtaacagaaaccttttttacggtttagtacttgatttgaggttattttgtacttcttcaaagcattagtatttcttagacctagaaatatagttacttttatagtttatctttccatttcagtcagcatcttagaaaagtcatcaaacaaaacaatgattacatgcaaagacgtgataaataaagatcatggaaattacaaagattcccaaatactattttagtctctaatataagtattctcattaaatgtggttctttgtgatttagagttgtaaatatttttttaactcctcttgcagctttacatgaatgaaaagtaaaagccagtttgaatggaacctttaggggaatctaaagatacaaaacaaggatccagaactgacaaagctgaatatatcagtggcactttgaaaataaggaactctgaaaataggatataaaaacaagatggaattagagaaacctgattaagattagggatttttccagccaaagctaataaatttcagttcaggaggagaaactggcataaactttccacctcttgactgcagaagtggtgggggaatgaagcttgtgtttaaatggcatattcattatttgagaataatttaatttttaatgatacgcaatttagattgataattttatcacatacagaggtattaaatatgtcattaaacagttatagctttgaaatgaattttttaaattaagtatgattaaactgcaatatagtatataagataaaagtttgcatatcaaaattctttttacctggatttttcccattagaagagattgcttacagagataattttggttcctgcttattataataagtgtcatttttgtgatagttcataccttaaaactacgagaactttagtgtatcacttgattttatacctgtaactgaggcaaaatagggaagttgcatatttattgttacatataattaatatatttttctattgatatcttatattagtaatgttattatttcatgcttgtggaaattgagacctgaagatattaaattattagccaagtagtggaaaatttttctattagagcacattctttttccattttcttattcctctcacaaaaatgagtttttatgatcttgtatacttctttgaaagcgcaatgtattaagatactcaacattttaaatggatacctttgagtgtaataattttgtgttatcaacaagtaaatttagccgaattgtagctaaataatagagtgatgcctagattctgtgaaactgaaaacttcagttggatcacttgcctgctccaatatacactgagtatgtaaataagacacaatggtgaaattgacctattatgttaggttacagatttggttactcatcatcacagcacttttctgtgtgatgtatgagatttgataattagtagactatactggatagaccttaatctagtagctttcattggcagcattcagtttattctttttaacattaacaaaatatacaaacttccttttctgtaatgaagtccatattagcaaaagcaaaaaagaaattagcacttagcttatttctaagtgttgaaagattttcactgatttttcctataaaatgtataatattttctgtatattttatatgatcagaaataaacatggttcttagtaatgctaggtaatgttattcattaaagtttcatttttagtataaaatgcatatcttgatattttaagattttatttatcttggtaatattaagcttcttttctactttaaaagctctgaaatagaattgtctaaaatagaatttttagataatttaaagctgagagtaatgatactagctaataaaagttgtcatgaaggtacttcatcaatattaactttctggtcttttatgtattccagaaactgggagtgatttttccatgtttgaagctttgcgagatactatttattctgaagtagctacattaatttctcaaaatgaatctcgtccacattttcttattgaactcttccatgagctgcagctactaaacacagactacttgagacagagggctttatatgcattgcaggtatctggtacctaacataatttttcctaccctattatcaccttcttcatgattatctctggttgctgtcttagactgaagcatgtgccatatgaattttcatctgttctctatgtgctttcttgacattttatttaaaatttttgtatagcttaagtagcattaaagtattttttttgagtactttttcagtgttttgtctacttcctcacacttaacctgtgagggtagaaacagtacatttttccttccatctgcttttatttttgaatctgtaatataaatgaatgattaagcatgtatgttttatataaatgatgatcttattttcttatttaggacatagtatccagacatatttctgagagccatgaaaaaggagaaaatgtaaagtcagtaaactctggtacttggatagcatcaaactcagaacttactcctagtgagagccttgctactactgatgatgtaagctgataatgattagtgaattgtagatataattttagtatgcagtaaataaaagttaaatagattattgtcaaattgtaggtagacctaatatatttgattttcagctttttttaaaacttgggtataatgtgttattttattttgagggcgagatataatatgcaatcaaaatatggtagcaaacaccaaaaattatgtatgtatgatagattatgaggtctgagatagccatatttatgttgttattacccagtataggggctgactcttaaaagacatttacaaatgtatgttgtatttatttaagacattcagtaaaacaggtatcagattacagtaaaaacacttgaatgaataaatacaggataaatcaggtctttgggttaaaaaaaaaaaaaaaagcctagacaaaagtcttccaggaaaaaaattgtaatttaatgtattctaattcatggagaaaattttgaatagagtaaaaaggacctggaaatggagaagagtgctaaggagaatggtataaattcagtaagctgtgtcctccaaatagcacttagcacatcgttgattgaataacagtgacagaactgctagtatattgaggagataatgtgctaggtgtttgggaatcacctatttcaaggttcaggccttgattttattgtaaaatatttcatgtggtcgtgggatagcaaatacattcctttttttatgacaactctagcacctagagatacatgggtaagagtttcgtagttgattagcaaatatcagctataggtagagagttggaatttactgtttctgccttttgttgaagtgttaatactaagttttttctgaagccagtgttttctcaaaggattgtctttccttttcagatacagtaatttctgagtttttctgaatttttgctctttaacttctactcgtgtttaaaataataacttccccagctcatcttttctgtttaaaatgttttcccactggactctgactcctttagtactataacataaacctgtgtctaaaaactacatggttttaattaactttgcaatgtgaaatgtaaattagtgtcagtcagtgtttgctcctttggattgttataactaattgaaaattgtgtattcctttttgtgggaaatgaaatgcgacctgcttgaatacattaaaaatagatgttaaattatattaaggtttattgggcactgaaacaacttgagagagaatgaacagtctccattcctagacgtatttttcaataattttatatccttaattccagtgctttcacttttatccaagtttcatacaggcagcattacttccatttattttaagagattggagcacattggtttgcaccatcgatagcacattttgaaagttgagctacagtttaggataaagttaacctaagaaggttttaaagttaaatgaaatttaaagatgctgtactacttgatacgtaaggacttgggatagtaattgtatttagtattacttttaattaagtaactaaatcagttctttgatatttcttccaaaacttaaattcagcattaaggtcaacatcttccctttactaatgccatttaatcagcagcaccacaatatccagtgttgatactcacagatctgaagcagcagtgtccagtagaactttctatagtgatggaattgttttatgtctgcattgtctaatgctgtagccattagctacatgtggctagcaagtacttgaagtatagctattgtaactgaggaactaaattttaaattttatttaaatagccatatggtgttttttgtattggacagattcagagcctcattctctagatgcttctatgcttcttgagcttcatttttggagcttttacaaacgtatattaagatgtgtaagagatacctctcttgcctagggaagagagaaatgaaagtgaaactgggaatctgggagctgtaagtcaaggaggatggagtggagacactgaggtttaggaagaagaaaacacactttgtgtctcctgctcccgatgataataaaatggtaaaagcacatctgtcttgaagacttgaagcacatcaagtcttacttgaaacagtaaaaaaaatggtttccctattcctaaaatacgttccttaatgtctaaatttcctttaatcagggacaaatgtttgatttcataattgaagataggaaactttaaaaagatcattagttaagggaaagaacacaactgtaaaatgtcataatcaaagtgtaagtgagacaccctaccaccatcacactatacacaaaattaatttgaaatgacctaaagtcgtgtaaaagccaacactattaaaacttttaaaagaaaatgggaaaaaattatgaccttgacataggctaagttttcttaggacagagaaagcactaactataaaagaaaaaattaagaaattagacttaacaaaaataggaattttctgcttttcaaaagatactgttatgggaaaataatcccagtatatatatctgacaactgtctgatatatagactgtataaagcttacaactcagttgtaagacaactcagtaaaaactgggcaagagatttgaacaggcacttaatgaaagaagatatatgaatggctaatatgcaaattaaagccacagaaaataccacttcacatcaagaatggctaaaatgaaaagattgacaataagaagtgttggtgagaatgtggaacagttggaactctcacagtccttatgagaatgtaaaattgcacaaccacttggaaagcagtttggcagttgcttataaacataaacgtggcatgtgacccagcaatttctcttctaggtattcatccaagagaaatgaaaatatgcatcacaaaaacacttgcacattaatgttcatagcatctttagtcatgatagcctcaaactgaagcatcaagagataaatggataaacaaactgtggtatatctatacagtggaatactgtgcagccattaaaaaataatttctgaacttctgaaacacaaaacatggattcatttcagaaacatactaagtgaaaagtcagacaatgaagagtgtatattggctggttccatttgtatgaagttctacaaccagcagaactgatctacagtgatagaaatcatgagtagggtgtggtggagattgactgtagagggttgtgaagaaacgtcctgggccagtggaaatggtctttatctttagggaatctggttacatgagtgtatacatttgtcaaaactcatcaaactgtacatttaaagtgagtgcattgtatattaattatatttcaataaagtttattttttaaaaatgcaaatgatgttgtgatgttttcttttctgatgtgagacaaccaggtagagtaagctactagacattgttagcatttggagataggagaatgtccctgagagtatagaaataatgtaaaatgttaactttgccaaattagaatttaatcagtagctgtctttgtgtgtgtttatctacataataaatattctgcaaggctacttatatcactgttctctgtgactctgtattcagcgtttaataactttggttatattatcatcttgtttggacagaatactgaggaaacttatgaatatcttttaagtgtacaattttatgtaaatacttagttatctctgttagattattaatatgaaattcttagaagtattagtgatttttgtttgttttactgtaacttaggaaacttttgagaagaactttgaaagagaaacccataaaataagtgagcaaaatgatgctgataatgctagtgtcctgtctgtatcatcaaattttgagccttttgcaacagatgatctaggtaagcagaattgtttataatcttagaaacaactttaagttgatctggtccagtctttgaattggcgttgataaggaaacaagtctagaaaggcgaagtgtgtgtggttgaaagaatgtggacttaattatctatcagtctaaaatcaagaatcttctgactcttaaccctgtgagcaaatcatccaacatttttgactctgcatatactaaggaaatgggaattttaacctaccttgctatgttcttgtgaaaatataatgtaacttacttgcttgagttcagaaaatgttaatttccttttccttaaaggaaaggtcatcgtttaaggtcatctagttaattcatgggaacaattcaggcctcatctaatcatatttttaataaaaatattaactttgtaatttgagttaagcagtcagttttcttaaataacctgtagtgaaaacctcaagtaattctcaggcatagcaaatggttttggttgtttttttttgtttgtttgggtttttttttttttccccctctcccatcagctgtaaaacaaaagaggtttagagggttgcctggctgcagtggagaaaaaattcgagtcctagacttggaaaggaaatttaaggaaaagaaaaatatgtagatacttgatacgtttctagactgtggccaatcaaaagagaacctgagaattcagtcatttgccatccagggtgcttagttgataaaataatgtaatgtcctgttactctagtgtttgttcacgtgatgaagagaagacttagattatttcaaaggtatttttccactataaagaaaaggacttagccttgccctatcattacattcctactgttcgccaaaacaaaagtcttccttttgcttattgtaattattgaggactcagccttagctgacctctaagtaaatgcttatttgggtctgcattgagttcatcccattacagagaaaaattactgtgtggcctgccaaccctcaccccttaggttgtccctctctttctgagttgccagaatacttcgactcctacgtattttctttcatttactggtatttttttttttttcttacaaacctgcaccagtagctgtgtctgaagtagacatagaattgggaaatttcattgataggcctttttcttacctaatttgcttgttttaggttgcgttgttttcatcagaatttgcatgacattttggaattcacttgtattgtttaaatgaaacaacaaaatgaaataaatatgggcttcagagtttgataactaagtttaaatccttgttcctacattgaactgtctgtgaaagcttgagcaagttacttaaattttctgcaaatgaaagtaatgtcatctactatataggattattttaaggattaaataagtgtgacaatgtatatgaagtgctcaagtagtatagtgtgtagaacttgttaaagctaattttcctcccttttgtttggacatttttttattaatgcattttgaggaatatatgaaaaagttcacttttacatactcaaaaaatatttttgttccaaatgtaggtaacaccgtgattcacttagatcaagcattagccagaatgagagaatatgagcgtatgaagactgaggctgaaagtaactcaaatatgagatgcacctgcaggattattgaggatggagatggtgctggtgcaggtactacagttaataatttagaaggtatatatttttgttttcggtaggtttttggagaacaggtggtgtttggttacatgaataagttctttagtggtgatttctgagattttggtgcacccatcgcctgagcagtatacactgtacccagtgtgtattgtttgatccctcacccccttcccaccctttcccctgaaaccccaaagtccactgtatcctgcttatgtctttgcatactcatagcttagctaccacttatgagtgagaacatgcaacgtttggttttccattcctaagttacatcacttagattaacggtctccaactctacccagatggctgcaaatgccattactttgttcctttttatggctaagtagtatgctgtggtgtataaataaataaacaaatatatctgtctatctacacatatatacatataccacattttctttatccgctcgttgattgatggacatttggactggttccatattttgcaactgcagattgtgctgctataaacatgcacgtgcaagtatctttttcatataatgacttcttttcttctgggcagatacctagtagtgagattgttggatcaaatggtggatctactttcagttgtttaaggaatcttcatactgttttccatagtggttgtactagttagtttacatgcccaccagcagtgtaaaattgttccctttttaccacatccacactaacatctattattttttgatttttaaattacggccattcttgcaggagtaggatggtatcacattgtagtttgtgctttgatttgcattttcctgataattagtgatgttagagcattttttcactcaacatcaccaaaaagttttttggccatttgtgtgtcttcttttgagaggagttgtctatatccttagcctactactactacttttttttttttttttttttaatttgagcacagtcttgctctgttgcccaggctgcaatgcagtggcacaatctcagctcactgcatcctctgcctgccaggctcaagtgattctcatgcctcagcctcccgagtagcaggcattgtaggcatgtgccaccatgtccagctaagttttgtatttttagtagagatgggatttcagcatattgtccaggctggccttgaactcctggtctcaagtgatctgcccacctcagcctcccaatgtgctgggattacaactgtgagacaccacacttggccttagcccactttttgatggttttttttttttttttttcctgatttgtttgagttctttgtagattctgggtattagtcctttgtcagatgcgtagtttacaaagactttctcacactctgtgggttgtctgtttactcagatgattatttcttttgccgtgcagaaactttttagtttaagttccatctgtttatctttgtttttgttgcatttgcttttgggttcttggtcatgaagtctttgcctaagccagtgtctataagggtgtctccaatgttatcttctagaatttttgtggtttcaggtattagattttgaaggtatattttttattgattacaagtaataataattctatgtaaaaaatttaaatatgtgatatctaatggtggttttattactactttattttaattgataggggtgcttaaactacaaacatgtttctttgtattatgttagcataaaatcatcaaatttaatatttttcaaatttcaacataaaggcatatatgtatatataataggctttgttaggctaatgtattttctttttaaaaattagaaactcccgttattgaaaatcgtagttcacaacaacctgtaagtgaagtttctaccatcccatgtcctagaattgatactcagcagctggaccggcaaattaaagcaattatgaaagaagtcattccttttttgaaggtaagcaattattttaaaaaataaacgaaaccttctatgttttgttttttaattcatacagaagaccttattgtgataaagttcaacggtataggtaaacaacaacaaaaaaactatcacccataattttttcaccctaccaacattctctgaacctttcagtaatattttatacacatgtgcatattctgcctttttcatttactatatcataaacttctttctagatcattatttttctgctgcattttttcaggatttatcacctttatttttagttttagtttttgtgagtgtatagtaggtgtgtatatttatggggtacatgaaatagtttgatacaggcatgcaatatgtaataatcacatcatggtaaatggggtatccatcccctcaagcatttaacctttgtgttacaaacaatccagttatactcttttagttattttaaaatgtataattaaattattgactgtagtcaccctgttgtgctgttaaataatagatcttattcattcattctgactactttttgtacccattaaccatcttccctattccctactacctttcatagcctctggtaaccatccttatacagtttatctccatgagttaaattgttttaatttttagctcccacaagtaagtgagaacatatgaagtttgtctttctgtgcctggctaacttcacttaacataatgacctccagttccatccatgttgttgcagatgacaaggtctcattattttttatggctgaatagtactccattgtgtgtctgtaccacattttctttatctgttcatctgttgatggacacttaggttgcttccaaatcttggttgttgtgaacagtactgcaacaaacatgagtgtgcagatagccctttaatacactgatgtcttttcttttctgtatatacccagcagtgggattgctggatcatatggtagctcttgctgtattttcagttttttgagcaacttccaaactgttctccagaggggttgtactaatttacattcccaccagcagtgtatgaaagttcccttttctccacatcctcgccagcatttattattgcctgtctttgggataagtgccattttaacagaggtgagatgatttctcgttgtagttttgattgtcatttccgtgatcatgttgagcaccttttatgtgcctgtttgccatttgtatgtcgtcttttgagaagtgtgtcttcagatcttctgcacattttaaaattagattattagattttttcctatagagtttgaactctttatatatgctggttattaatcccttgtcggatggtttgcacatattttctctcattctgtgggttgtctcttcactttgttgtttgtttcttttcttgtgcagaagctttttaacttgatgtgatcccatttgtctgcttttgctttggttgccagtgcttgtggggtatcactcaagaaatttttgcccagaccaatgtcctgcagagtttccccactgttttcatataatagtttcatagtatgaggtcttagatttatgtctttaatccattttgatttgacttttgtatatggtgagagatagaggtctagtttcattcctctgcatatggatatccagttaccccagcaccatttattgtgaagagactgtcttttccccactgtatgttcttggcacctttgttgaaaatgagtttattgtaggtatgtggatttgtttctgggttctctgttctgttctatcggtctgtgtttctgggttctctgttctgttctgtcggtctgtgtttctgttgtttgtatgccagtaccacgctgttttggttactatagctctgtggtataatttgaaggcaggttaatgtgattcttccagttttgttctttttgctcaagatagctttggctgttctgagctttttttgtggttcctataaattttaggattcttttttctctgtgaagaatgtcattggtattttgatcacaattgtattgaatctgtagattgcttcggggagtacagacattttaacaatattgatttttccaatccatgaacatggaatatctttccctttttgtgtctttttaaatttctttcatcagtgttttatagttttcattgtagagatctttcacttatttggttaattcttaggtatttaattttatttgtgtctgttgtaaatgagattactggtggcatatagaaatgctactgatttttgtgtgttgactttgtatcctgcaactttactgaatttgttgatcagttctaatagtattcttgtggagtctttaggcttttccaagtataagattatatatatatcatatacaaacaaggataatttgattcttcctttccagtttggatcccctctatttctttctcttgtctgattactctagctaggacttccagtactatgttgaataacagtggtgaaagtggacatccttgttgtgttccagatcacaaaggaatggctttcagtgtttccccatttagtatgatactagctgtgggtctgttgtatatggcttctagtatgttgaggtatgtttcttctatacccagttttttgagggcttttatcatgaaaggatgttgaattttatcaaatggtttttcagcatcagttaaaatgatcatatgggttttgtccttcattctgttgatatgatgtattacattgattgatttacctatgttgaaccatccttgcatccctgggataaatcccacttggtcacgatggatcatctttttaatgtgttgttgaattccgaggtatcggttgtaatgtctcctttttcatctctgatattatttgggttttttgtctttttttcttagtctggttaatggtttgccaattttatgtatcttttaaaataccaactttttgtttcgttgctcttttgtattttatttcaatttcatttatttctgctttgatctttattatttcttctattttgggtttggtttgctcatgcttttcttgttttttaacatccattgttttcgtatctgttatatgtatgtttttggatttcaggttaccatgaggattgcaaatactgtcttataactcagtattttaaaccgataacactgattgcataaacaaacaagcaaacaaaatgaaaacttatgcaaatgttaactttgtttccctgctttttaactctttgttgtttctctttatatcttactgtaccatgtcttgaaaagttgttgtagctactatttttggttggttcatcattttgtctttccacttaagagtagtttacacaccacaattacagtgttataatattctgtgtactttctattactggtgaattttgtaccttcagacgatatcttactgctcattaatgtcttcttttagatggaaataaagtatttagtatttcttgtcagacaggtctggtgttgatgaaatccctcagcttttgtctgggaaagtatttctccttcgtgtttgaaggatatttttgctggatgtactattctagggtaaaagttttcttccttcagcacttgaaacatgtcatgacactctctcctgacctgtaaggattctagtgacaagtctactgccagatatattggaaccccattatatgttatttgtttcttttctcttgctgcttttagggtcctttctttatccttgatgtttggcagtttgattattaaatgccttgagatagtcttatttggattaaactatcctggttttctgtaaccttcttgtacttgaatgttgttaagcttactacctctgtctctctctaccccctctttaaggccaataacttagatttgtcctgttgaggttattttgcagatcctgtaggtgtgctttattgtgttttactttttttttcttttgtctcctcaagttgtgtgttttcaaagagcctgtcttcaagctaattctttagcttgatcaattctattgagagattgatgcattctttagtatgtcagttgcgtttttcaactctagaatttctgcttgattcttttaaattatctcaatctgtttattaaatttatctatgaatatagaattctgaattcccggccaggtgctatggctcacacctgtgatcccagcactttgggaggctggggcgggtgatcacttgaggtcaggagtttgagaccagcctggccaacacggtgaaaccccgcctctactacaacatacaaaaaaaaaaaaaaagtagctggacatggtggtgcgcacctataatgacagctacttgggaggccgaggcaggagaatcgcttgaacccgggaggcggaggttgcagtgagccgagattgtgccaccacactctagcctgggtgacagagcaaggctccgtctgaaaaaaaaaaaaaaaaattctgaattcccttcctgtgttatcttgaatttgtttgagtttcctcaagacagctattttgaattctctgtctgaaaggtcacatatctctctccaggattggccactggtgccttatttggtccctttgttgaggtcatgatttttggtccctttgttgaggtcgtgattttctgtatggtcttgatgtttgtggatgtttgttggtgtctgggcattgaagagttatatataggccttgtatcttgtaggcctcacagtctgggcttgtttgtgcccattcttcttgggaaagctttccaggtattcaaagggacttgggtcccaagcccaaaaacactgtgctttttgcagactcatagcggtataccactttggtgattttggataagatccagaagaattctctgaattaccaggtggagacttctgttctcttcctttactttctttcaaataaatggaatctctgtgttgaaatgcctggagctggatggagatggggtgatggaggcacccctttggtgacttaccactgtgactgtgctgggtcatacctaaagccagcacagcacagcactggggcttgcccaagaccctctgtaaccactacctgactaccgcctaaatttgcctaaattcgctcaaggccctagggttcctactattagcaggtggggaagccagccaggtttgtgtctttcccttcagggcagtgagttcccccaggtccctaatgggtccacagatactgtccttgagcttagaaatctacctggtattctgtcctactgtggctaagctggcctttaaaccacaagacaaagtccttcccacttttacctctgctttccataagcaaaggagtctctcctggtggctaccactgtgaccaccggcccatgagttctgctaatattcatttaaagcccaagggctttttagtcagcttgtggtgaatgctgccaggcctgggactcacccttcagggcagtgggctctcctctggcccagggcaggtccagaaatgctgtccaggagccaggttctcgaattgcggatcccaggagcctgcttggtgctctaccccactgtgatcgctctggtacttaaggtgcaagacaaagtcccctttttcctctacttttctcaagcagaaggaatctttcaccatagccatcacagctcagtatacgttggatctcacctgaagccagaacatctctgagtctcacccaaggcccatggcatactacatgggtatcactgtcagttattcaaggttcaagggctctttagtcagcaggttaagattaagccaagattaatccttccaggactgggtctttccctttaaggcagtgggtttccttctgggccagagtgtatctaaaaatgtcatcttggagctggggcctggaatggcgacctcacgactctgccggtgccctgttgtagctgtggctgagctggtatccaagatacaacacaaagtcctttttactccttgctctcgtctcctcaagcagaaggagtcacttgcattgctgcagtcagtgctgcctggggttgggggaggggtggcgtcagcaattcaagatggtctttcctaccctcagtgtccctttcagcaatacaaagttaaaagcaggtaccatgattgctcacctggtttttattcttataatggtgctttttttgtgtgtagttgttaaaatttggtgttccagaaggggaagatgattggtggaggcttctgttctgccatcttgctccacccctgcctttttttttaatggatccacaacattcattccaaaatatttataaaatgcctacttaatgccaggtttggcagacctagcagtgaacaaggcctttgttctcatggagcttgcatgctagagtgggaatacactctgaaataacataagtaaataaaagacatataagtaactgtttatcagttaatgatacaggccatgctcagaattaaaatttggtgatatgatggtgtctgttttatattggatgatcagggaaagcttctaatgagggaacatttaagtagagatgtgactaaggagccagtgtaaaccaggattgttctagacagtgcactggccttaaggtgagaattagcttcgcgtgttgaaggaactagagggaaagtctatatggttggaggatatttgtatgagactaagttgaaagggaggcaagggctaattgtataaaatattacaggccatggttagaagtttggactttgctcaaagtttgaagggaaactcctagaagattttaagcagagaaaaaaagtctggcttgtttttagaaaattgattataagggggtcaggagtgcagtgagatcagaagagaaatgatagtggcttagataagggtggtgataaagaaatacgtaattgggatatagttaggaaatcagtaggtcctactaatgggtagagtgtcgagagagagagaaaactggctaggaggaaatacgatttaccaaaatgaagaaggcttgggagaagggggagatgaagagctctgttttttttgaggggggtggggtttgagacagaggctcactcttatcacccaggcgggaatgcagtggcgcgatctcggctcactgcaacccttgccttctgggttcaagcgattctcccacctcagcctcccaagtatctgggactacaggtgcctgtcaccatgcctggcttgctttttgtatttttagtagagatggtgtttccctatgttgaccacgctgacctcaagtgatgcacccgcctgggcctcccaaagtgctgggattataggctcgagccactgtgccagccaagagttttattttgtactttaaaattgaactgtcttttagacaatcgtagagaggtcaagtagtcatttggttactcagctaattccaggcacagctggagatagacataaggtagattatagcatatagctgctgcctaaagccagggcatttgatttgagaatagaaaggggccttgcaactgtgatgtgggaccaggtgattcagcatttgtaagttgtacaaaagcggagccagggttgaccaagaaggactgcaaggagttagttatgttgatggctgctatgaggtcaagtagtcataaaatacaattttctattaattattttttcagtccctgttgttaaatatttgtgtttattctggtttcttttccactattacaaacacttattgaatgattgaaggtaatctgtttacttttgtttctctagaaacaatttttagacataaaatttttagttcaaaggtcataaacatttttaaagctttttagacaagctgattgtccttcagagaaactaaccagtttatattcccatcaacattgatagtatcagactggtaagcagtactattaatttcatttaacaacattgatcagggcagatggagacatgtgcaacaaatggaataggaagacaggacttctttctgagatggcattcattacattctaatttaaaatggaagttttaacaattagaagtgaaaagtaattgttttcttttcatctagatatggtaaactacaaaatacattgtcactgggctagtttcttatattgtactcatacttttctttgtaagacatgtaccacagagaattgcttccattgtgctcatatttcttccctcagcagaagtaattgcttttttttggaatgttttgagagaagagagatctttgagaaagcacctgtagaaactgctttctctgtatctgactttacagctgagaggaaaaagtcagctgatcgtgtccagattattccatgtaaaaacagaaacacgtagccttgttctgggcaattgcaacagttcctaaatggccttactatccttttgccgctgcttctaacctttcttttttttttttttttttttttttttttttttttttttttgtggagagatctgttaaattttttttttctttttttttttttcttttttttattatactctaagttatagggtacatgtgcacattgtgcaggttagttacatatgtatacatgtgccatgctggtgcgctgcacccactaatgtgtcatctagcattaggtatatctcccaatgctatccctcccccctcccccgaccccaccacagtccccagagtgtgatattccccttcctgtgtccatgtgatctcattgttcaattcccacctatgagtgagaatatgcggtgtttggttttttgttcttgcgatagtttactgagaatgatggtttccaatttcatccatgtccctacaaaggatatgaactcatcattttttatggctgcatagtattccatggtgtatatgtgccacattttcttaatccagtctatcattgttggacatttgggttggttccaagtctttgctattgtgaatagtgccgcaataaacatacgtgtgcatgtgtctttatagcagcatgatttatactcatttgggtatatacccagtaatgggatggctgggtcaaatggtatttctagttctagatccctgaggaatcgccacactgacttccacaatggttgaactagttgacagtcccaccaacagtgtaaaagtgttcctatttctccgcatcctctccagcacctgttgtttcctgactttttaatgattgccattctaactggtgtgagatgatatctcatagtggttttgatttgcatttctctgatggtcagtgatgatgagcatttcttcatgtgttttttggctgcataaatgtcttcttttgagaagtgtctgttcatgtccttcgcccactttttgacctttcaactctcctactagagttgttagcacttctgaggccttggcacttgctaatacttctgcctggaatgctcttccttcacatacctacctgcatggcttgttttcttgaactcaactgtttggtcaaatgttaacttttgctgagtaaacctctgccttatcctttacctgcttagtgcttgcacgccacctttaacctatgtaatatttgtctgcctctccatgctaaaatacaagatccatgacatctgagatgttaatctcttttggtcactgtccaaaaatagtacatgcacattgtagacactcagtaaacattaatgaattaataaatgactggaatcttcaaccctcaactgtagttgagctctttagacgctctaagtgtgaaaacaactggcccataggataaagaccaggttcattgtcactcataaaaccttttacagcttggtctggcctcttaagccttgtgtcctacttgacattattgaaaaaggcacattgcccacattatgtcctttacctagaatgaccttctcctctttctctgtcagtttctcctgtttttcaggagccagcccaaatgttattgcatgtgtttacaggcagaattccttcctctcttcactgttcctgagatactggattcatgccttcattatagcacttatgacaaaggatcataattatttgtatctcccccctagaatagtatctcatagtacctacagccaagaagcacttaagatactggataaaaagaatttgagggataaggcataaatacatcagttttaccaagtgttttgtgaatttatttcctgttacttataaatatatgtatatatttaccttccataaaagaatatacttataaattttaagaatatagattttttatatagatatttatctcagagcttgaaaccattgcctcaagtgaattggtttaaattttcttagttaatgcttgctttcatcttaggcctaaagtattgcctttttgcttttatacttttattttagcattaatagtacaataaatatttgtcaacatgtcttttaaaaactaataggtatgcttgtagtaatatttatttgatatgtacagttactttataagggttaaaaaaaaagcctaaatgatctatccttatgcttagggagtgcagccttcagttaggaaattgattgtttttacttttttgtgtctgatttgatggaagaattatgtaagttacatgctatctgctcagaaactgttatacaataaaatatttaatacttgagcgaaatagaagtcaccttgagtctgtgaaatgtttaaaaagtcttgaatttaaaagaattacattttttaaagtgatttttcttaaatgtctaagatattaggaaatatcaatggtattttagttggctaaagtggctagtgacactcatttaataggttttccatttgaccttttaagcgctactagcatatctagagttacctaaatcacaacacttatcttgtcaccttgtgtaaaatctaaattgttccttctcactttacctgtgtagccctgatttaagtgatttcatttcatgaggaaatgaaataataaatactaatttagcatttcaaaaagtgtctgaggccagtaaagagtagaactaataatctgattttaattatttatgatgtctcatttcacttcagatcttgactttttttgtaggactgtagaacttctttgttaattatgcccaggcagcattacacccagtcacctgagttagacttcttgactctctttatgtcatcactagtgagtcaaaaatgtattctcctccttagagtcatcaatttgacttcactttcttctttctagtagcatgaccttaattcatattcttaccttttgcttagactacctgtcgtaataggcatgaagtgcatttttactaagccgtgtcctacccaaactccttagtcttcaagtggcttcactgctggatctggtgtgctttccccctctagctactctccatctaggtacattcacttcacattattcaacattttccatatctactgttactttttcacgtattagctgtttgtacaagttgtcttgtctatccaagaggtaaaatactttcactcttttctgcctggctgaaatatttcttcagaaatatttgttgttgcctccagtatgctcctacagctccttagagcacctagtgggtgctttttaaaaatatttatttattcagtaagtaatgtctcctgtgagccactgtattttgtgataaataagaatacctgcagttaaaaaagtgttatctaccagacagcacggagcttatagtgattatttatatacgtatctgactcctgcatagtatttgactctctgaagacagggacagttgtgttgttgttgttgtttttttttttttttaaatcgcctgtcttgacacatacattattttaaatgagcttaagtctgagaggggaccttgaacatctagtttggcaccctcattttatagatatgtattggtgggggggactgaactgagaaaaggtttaggatttgcttaaatggatttagtagaataagaaggattagaaccttgagattacttgatatcgatgatttatggactcaacctcagaaagttaaccatgattcatattattttgtagctcacacatgcttctcaaggaagtttaagaagagacacttgactgaagtgatttgttaagaaagttagggggtgatgttaaccctcaagacatttcagaatgtctaaaggtatttttagttgtcgaggtggtgtagggaggaggtgttactggcatctagtgggtagaggccaggatgatgccaaatatcctacaatgcacaggatgtcaataatgtgaaggttgagaaaccctgagttagaaaataatagggaattgggtacaaggtgagtatgcttgtaagagtatttgaaattaactgaatgaaaacagaaagattggcaaaatggaaactagcatgaatagttctccttaaggtacagaaaagtacagaaagaaagtgctgaaaagtactggatcagccagttcttttactggccatcatctgctttcgtgggtcaaaattgccaaacctctcaatacgtatgaataaagtaggagtttggcttttcttatgaatggatatttctaaacagacatctgaaaattgaggagcatctacggcaagaaaattaaaaattaacattttgtattatatggattgattttctttttttaaacaataggtaagtttatattctaaccaactaggatttttctcaggagcacatggatgaagtatgctcctcgcagcttctaacttcagtaaggcgcatggttttgacccttacccagcaaaatgatgagagcaaagagtttgtaaagttctttcataaacaacttggaagtatattacaggtaagagtttatacttgtatgatttaccaatatgtactgtgtggtaaggttttttttcggggggtgggtgaggcattttcttgcattacacaatttattctggtggacatccaatctagcgtccatttgggatgatgttgtaatactttttagttgtcacttggttaaaataatattgtattattaggtcctgtttgtatcttcatttaatttggtcatctctaaggcatgtctcttataagcttttactggtttggtttatcttctcactgaaaacattttgagtttgaaatgtttacaaagtattctgtggctgtttctaaaataattggctaaagtaatttgactaatcagggaaattttggaagccagagaccagctggttgtagagactttttagggtgtaccagtacgcttaaattatagtaagtcagtaactgggagagaatttgccttctaggagacatttagcagtgtctgcagccattttgtttatcacagcaagtagtgtggagaaggtaggagggctgagaggaggacaggtactggcaactaatgggtagagaccaggaagaatcttgataaacatttgacaatacacaggacagtaccccatagcaaagtattatctggccctaaatgtcaacagtgccaaggttgagaaatcccatgttagtgttaataaaattaccttgtttattccatatgacaaacatctttacctttatatttacctgaatgtttttccattgagatagttcagtgatgtgtatttttactccacattaggtgatacatttttcttctcatctttattacagaattttcttatgaaacttggctttgcttcttatttctgtgtttaaactggttttagataatcactattaactttttttaaaccttgggcttgatgcaaatttgtatcactgtaattttccattttgttagtattaggactaaaggacaaattgtcctggccccgttagcagttattagtactaacagataatttctaaggactacaaaacattgatggtgttgtgcattgtaggaaactccattttagaataaggctgaaagagaaattataatttaaatattttttatcaagatccatgtagcccttcctcagttttgccttctatgataattgtggacagatcccaaagcattaatttctaaagacttttttctcagtctaaggtttgactgcttttctttcatcccgttcttgattttttcacaagaggacatacatgaagaatacaagttaatttacgttaaatattgcccagagtattgaaaaatttttatgagctagagcttaaattaccatcttctacatttttccttctgaaacccgttcaagaattgttttttccacaaagcacccagcatatgtacgtttttaccataactgtactagataagatagtcttttggtgggggagaggagcaggcattgaacatcatagttgtttgcctgtttgctaaatagggtagtccatattttagaaggaaaaagaggagtggttttactaaaaatgtatacagtatacttccttatttgaagattctcaacctaaaataatcaaaagggtcagaatctactttaaagagagtttattcaagcacagtgttggagggatagctgcctgggaagcacagattccaaagaatagacatcagaagtttgggatcatttatatcaggggtccccaacccccaggctggtgagcagcaggcgagtgagcaaagcttcatctgtatttacagtccctccccacggctctcattaccgcctgagctccacctcctgtcagatcagcagcagcattagattctcataggagtgtgaaccctactgtgaactgcacgtgtgagggatctaggttacatgctccttatgagaatctaattcctgacctgtcactgtctcccatcacccccatatgagaccatctagttgcaggaaaataagctcagggctcccactgattctacattatggtgagttgtataattatttcactatatgttacagtgtaataaagggcacagtcagtcaatgtaatgtgcttgaatcattccgaaaccttcccccaagctatggttgggggaaaagttgtcttctgtgaaaccaggtcctggtgccagaaaggttggggactgctaatttatgtggacagagtttagagaagcttaacagagtttcagcatctttctatataaggctttaatgcatagttacaacagtctaattagttgaggtgatgtttttgtttcagaaaaggtggaagatgagtcttttctgccccctgatctgacttaggtacaggacagtaaaggaggcagttaatctgtaacaaacatcagtggttgggaggcaggaggtctggtctcttgatctttcctagtcatttacagaacaagaacagtgaggaaaagagttaatgtgttgtctaagaagaagaaatcaccaacgttcaagttgccagggcttaacttcctccttgacataataaatgtagagggtcttgaaatcctattttcttttacatgatcctatatatcaacttgaatagaactaatgtttacttttgaagaaaaatttaaattagaatggttgtcttaagtaaaggaggaagctttaaacatgatcctatatatcaacttgaatagaactaatgtttacttttgaagaaaaatttaaattagaatggttgtcttaagtaaaggtggaagctttaaaagtattctaatggtacatttagaggtggaagattttgtcttttcctttcatagcacttagtatttattactgtagtatatattgtatctcctgtactgtcagggaactttctggtattagaaatccctgtctgaattcatttgtgcccagcagttacatcaaatagggactaaatatagatgaccatatatgttcttcccttgtgtatactctttaagcaggactagcaacattcccacttagtaatatagcagtattctttagtaatactaacaacctatctttccttagtaatcataaacattagttttaagtttttcagtacttaaaagtaatagtattttataattgaagtttactgtctttaaaaattatttggtttatctttgaataggattcactggcaaaatttgctggcagaaaactgaaagactgtggagaagatcttcttgtagagatatctgaagtgttgttcaatgaattggctttctttaagcttatgcaagatttggataataatagtataactgttaaacagagatgcaaaaggaaaatagaagcaactggagtgatacaatcttgtgccaaagaggtaaataacgttcattttgatttttaggataattgacacataaatacagttcttgatcattattattaactgaaatcacattttacctcagcaaaagtagttgtttttagtaataccagttaatcacattataagtcattacatatgctagtcacttgtggaatttgaggactaacagcagttgctaaagatcaggaatgcgggcaggaattgatgttaaatgtacattgtcagataaccagttcacattattgtcctgtattcaggtcttgaaagatgagagaaggactgggatctgatcctgggccagtgccaggtgcctgccatgtctgttattgatccctgtagattcttcgagaatatgcattacccagaggtcactcccagtcaacacaaatgcttattagttagggctttggttttacctccctgtagtttgttctgccttgtcaaattaattttgatcacaggtgagattggatgactgttctgcctcaagttgaggcataccaggaagccttttccctagatgtgtacccttttcctgaccctcttttatgagaaggaaacaagccaagacccaaacagagatggctcttctttcttagaatctaaagtagacgaagtcaggctgtccatttcacacttttcatgatatttattttctggatataaataaatttcagacgttgctaagagcttgatgaaaataaaacagcatgatactataataaatgattagaaagtaatacaggccaggcttaggtctataatcccagtactttgggaggctgagacatgagaaatgctaaattatgtatctaagtatgttgctaaattctgtgtaattgatttgttttaaaggctaaaaggattcttgaagatcatggctcacctgctggagagattgatgatgaagacaaagtatgtgctaattaatttttgcctaaaaatatggctgggcgcggtggctcacccccgtaatcgcagccctttgggaggccaaggcgggtggatcacgaggtcaagatttccagaccagcctggccaacatggtgaaaccccgtccatactaaaaatacaaaaattagccaggcgtgtgcctatagtcccagctattcaggaggctgagacaggagaattgctagaacctgggaggcagaggtggtattgagccgagatcatgccactgcattccagcctgggcaacagagctagactgtgcctcaaaaaaataaaaagcctacaaataatgcttttgaaacaatataaaattattttaacagctttcaccttaatgtttgaaagcagactgtatcatcaaatgacctttttcctgacacttttttattttaaaaataaaactagactatcaaaaatggttctttgtattttttattagataatgatcattattaatacgatagacttactatataccttttacacatgtactttaaggaattaattactcaaatatttttgtgtctaggacaaggatgaaactgaaacagttaagcagactcaaacatctgaggtgtatgatggtcccaaaaatgtaagatctgatatttctgatcaagaggaagatgaagaaagtgaaggatgtccagtgtctattagtaagtttaaaggctctgtactatctttatactttagttttttgtaggtcatttattggaacagtttggtggagtgtaacaagtataaaattaagtgtcaaagaactctgattttgaatttcactgtgaccctgactaaattatctagactttctgcactgtaagtttttaatacattctgtttgaggatttcagatactgtatataaagcatctgtgccatgcaggaatgcagtaagtggtagctattgttaagattatgtgctgaaatttactaaaaattgtgtattaatcaacttagatttgtctaaagctgaaactcaggctttaactaattatggaagtggagaagatgaaaatgaggatgaagaaatggaagaatttgaagaaggccctgtggatgtccagacttccctccaggctaacactgaagctactgaagaaaatgaacatgatgaacaggtattcccgtattgactgacacacttccatcagccttattttaactaatcaaacttccatcagccttattttaactaatcaaagtagatccttctaaatattcaggtttcatgaatgcaagcctcattaatatgcttattaaaatctgaaaaaccagtttattttttatgattgttttttagagacagggtcttgctcagtcttctgggctggagtgcagtggtgtaattgtagctcattgctcatagcctcaaactcctgagctcaagcgatcctcccacctcagcctcccaaagttctgggattacagacatgagccaccacacccatccaataatttatacgttttaaattatacactgtttttagtggtgtgattaaatttcacaccggccctctccttcctatttgggttgtgaatcattccattgtccggcatgtctacactgtatacactacctgcttgttaatcacttaatagccatctagggtagcagatagacttgcagtataacagtgttcaaacaacccttatttgacttaatggccccaaagcacaagagaattaattattctattattagttattgttaatctctcactgtgctccatttataaattaaactttatcatagataagtgtgtaggggaaaaacagtataaatggggtttggtgctatccacagttttggaacatacactctatggatgaggcggtgcttttttatatgttattttcctccctggtctagatcttttcttctggagttggatattttactgtgatgtgccttgttggggtcttttttcattatttgcagtggatactcagtgattgttttcaagttggtaaatttttaaattctctttattactgccacaccattttctcttttctctccttctgtaattatcagatattattagtactcatggattgatcttctgattttctcctcttttccttatcttttggttttactttgagagattttctttgactttaacacttgtatgaaattatttttatttcagctgtcatatttttaacttctgaacactttctttttttctgattgttactttttaatagtgccctgttatttcacagaagcattaccttccgttttcaaatgtctgctgaaccttggttctttatattgaacagtgatatatcaaaaagcaagttaaggttcttttgggcttcactgcaggtagggcatttggggagacagccagcatattcctacaaacttctaaatgttagtatctattggtcttttctttgagatggtttagattcttcaaattagggtccttcactgtcgtcctgcctggagtgtatgagcttggctgctgatattctgaagctagattgggaatggggctgaggtcccaccgttatacaggcatgcactagattattctgttttcagtattctatttaggttggtgcaaaagtaattgtggttttggtcattttcaatagcaaaacccacaattacttctacaccagtctgatactttactgtgtcatttgtgtctccacctctactcccagtggccccaggtttggggctcactagtttaatttctctaaaatataatctgccattttctgttgaggtgggaggagagaacctacgtaggcacattttccttaaacagttttaaacaactaccaccaccgtttcatctccagctcctgccccaacatcatcatgtcttcctttctagatctgttacttacagttatgaggtgaatctcagtttttgtttcctctccctgctgaaggcatttagctttgttcatcttcctctcgtcacttcctccttcattcccttcttgtctgcattaagtgtcttttagagtctgaaaaaaaatgaacagtgcagtctgttcgttccagttgtattatactgtgtgtgtgtgtttttaaggcaacaaggaaaccctttaacttagccatcttgaaatcacaaccaaagccgcctccttgaaatagttttagaagatacttttaaatttctttgtatgaaggtcttgggttggacaaaaactacacactagtaatcatctcttttatagtgaccatatatttcaggccctgctattaaaacatttttcccttctaggtcctacaacgtgactttaaaaagacagcagaaagcaaaaatgtcccattggaacgagaagccactagtaaaagtaagaaatctaaataagtctttgattttaagataatttcctttatttgctttaaagctaaaaaaaaaaaaaaaacacacacagaaaacactaaaattcttagtttgaaagtactttggacctgatgtatgtttttcttctccctataaatcctttgtagaaaacataagaatttgtttctataaacaataaagaaaaggtgacaaatatttacctgcacagacaaaaattctgtcaagagcatcgcatctttagatacaaataatggtagatttaaaaaaaaaatctatttgtaggccttattactgaaagtcctaattttttagaaatcaggtggatttcaggaatctgagtcttaaaatgctcccaggtgattttgatcaactaaatttgggaaccattgataaggaaaatttgtagttgccttttctttttggtcttaaatatcttgattgctcttattcaggcgtattgtctttattagtataatagtaaaatttaacattttttgcattacactaatgttaagactttcttttgatgacagatgaccaaaataactgtcctgtgaaaccctgttacctcaatatcttggaagatgagcaacctttaaatagtgctgcccataaggagtcacctcctactgttgattcaactcaacagcctaaccctttgccgttacgtttacctgaaatggaacccttagtgcctagagtcaaagaagttaaatctgctcaggaaactcctgaaagctctctggctggaagtcctgatactgaatctccagtgttagtgaatgactatgtatgtatcatttacatttccaaatatttttacttttcatttctgtgcatatttcttcattttcagattagcattctccacatgtaaaccattttgtgtttaggtttagaacatgttggaacatttttctaattcacactttaactttagcagaagggtaatagtgaattaagatgaccatctcaaaacccacatgctgttttataattttgagaaccaaagggataaaaagatttcatcttaagttcggctctgaagtggtaatgatgcatgaatcctcctttatcctttatactacctattcttctcaactgtttagaatatattgcaaattttcaataaacttaaaggtttacacttgggataggaaataaaacagtttgacaacagaatctttatacagtgaatgataaaaaaaaaaaaaactaggaaatctgtactcatgatagtacttactaaatgaaaattcaagtgaagcccaggtctgaaaaatacttgagcagaggaaagcaaaaacctttaaagtaattaatcttgcttaagctgcaaacataaatgaaacttcacttgggtcatttctgataaatgcttctgttagaaccaaagcttaaccccagcctgtcataagtagccccctaacatatggatatgtgactagggactttctgagaaggtacttgataaaagacaattttgtaattgcaaaccaagcaaataatttattttacttccacattttccaaataaatacttgcctctgatattttgtcagtggaacactaaatctcttttggtctggtgttcccacttcctgaattgcttcttactcaaataaactgtaaaattttattgtgtctcagatttgtcttttacagtttggtgtcagagtaggatttgaaagagaccccctgtggcctctggaagcatcgaggaaccaggcaaaaggtgtccattgtgctcactgctttctcgctgcatctggaggtcctgggtaagtccctctcggatttcaggctccacagtttgtgtcctgagctctctgagtttatctgagtaattttattttgagactgagtctcgctctgtcatccaggctggagtgcagtggcgcgatctcggctcactgcaacctctgcctcctgggttcaggtgattctcctgcctcagcctcccgagtagctgggattacagacgtgtgtcaccacacccggctaattttttgtatttttagtagagacagggtttcaccgtgttagccagaatgatctcgatctcctgacattgtaatccgcctgcctcagcctcccaaagtgctgggattacaggcgtgagccaccgcacccagctgggtaattttattttttactggatccagaggtcgaactagatgtttgacagtaactagactgggtccagttggcagcctcaggtaggtgaggtttagaaagatagggtattatgggttcattaacacctaaagactctgggacccctctttctagaactctagcaaattttatgtttagaaattaggaacatgaaactatgcctttaactatgcctttctggagaaatggttacactttaccagagaagagaagagttaaagttacagtggagaagttttaatctagataaaattgtttatggggacattagaaaagaagggatcctaaatgccttagaaacaatgggaagcagtttttgattgttgtatacaggcttctaaaagacataattccaaaattgccttgctaaaagattccttgctaaaggcaaataagacagatgaaaagcttaagcagtgaattgacaaccaaaataaaatgaattgtatgtagggagtgatttcactctgacctgttactctgcttatcctcctctaattattctgagtccactaacccatttgttcagtcatcttaatccttttgcacaattaccctttcactctggacgatgtgacagaaaggaagttaggctaatgctttgcttagttagaccctcagccaggacaccgaggtctggctcctgtaagtacttttacttctgggtcaaaagctgaactcagagccatagcaaaagattttccaaatcccaaggaaaatccaaaacagtttgctgaggaatgtagatttagaatgaccctgggcttcctgatttctgtcagtttctacgcatgatattagccactggggaagcatgttaatggatgactacggcaggatggcataagcctcagaagagtattgccaaccctttaagagctacttctgtggatagcccaaaagatgctacaaaaacaactggaaaacatctagaagctatccccatggtctttccacaaaagattgactagtccaaaaagttgaatctatttctgattacacggctaaattggaaatctcatttgttaaacattctggtcttaaaatacagcagggagtatttcctgcgggaactgaaatggtttttatggttttattcattaatagtctctgactagagtctggtgacttgattaaaaaacacaagattggatggcaagtcactgatatggctatattagtcaccatagctgaacattttgagagaacattagaactagaaaaaaatcagtttctgtaaagaggccattgaagaaaagagtctccacgcttgaccagtcctctaatggacctacctgtgttgggccagactatttcctcattagatgaagttcccaaggctgggccaggcatggtggttcatgcctgtaatcccagccctttgggaggccaaggcaggcagatcacctgaggtcgggagttcaagaccagcctgaccagcatgaataaaccctgtctctattaaaaatacaaaattagccaggcgtggtgacacatgcctgtaaacccagctacacaggaggctgaggcaggagaatcgtttgaacccagtgggtggaggttgtcgtgagccaaaatggtgccattgcactccagcctgggcaacaagagcaaaactccatctcaaaaaaaaaaagttcccaagggtttgactctgaagacaataatcaacaccaatgggacatcaagggattctctggtatgttactctccataaggcccttaaacaaacatggggaggaaactaagatcagcatcagtgggagtcacgtacagtgttggtggataccttatccactttcaaccccatgctaataaatcagccagtcccttggaggaaagaaaatatttcacgtttccaatcaagttcagagaatcctctgtgaaccagtctaaatgacagttggactaatctcagaaaagcatgccttcctacaatatgacactaaattgagagggcacttaaagttctctctggaaggaaagttaattttagagcttcctgacccttctaaacctgaactgctctgtttcctacaagcaggaattgatcatattgaaactcactcttataccaacctagacctttctgaagtacccagatgtttgtgggcttgtttctcaactgacaaagggaagattaaaagtggtaagcctataaaaatacaaatacattattccaagccattgcctaaattgccctcatgccccctagggtcagaggcaatccaagggctttacccagttatagaggatttaataaaacaattccttgtacttgtctctataatactataatcctacagttaagaaatccatcacacctttaatcccagcactttgggaggccgaggcgggcggatcaggaggtcaagagattgagaccatcctggccaatatggtgaaaccccatctctactgaaaatataaaaattagctgggagtgctgatgtacacctgtagtcctagctactcaggagactgaggcaggagaatcgcttgaacccgggaggtggaggttgcagtgagctgagatcgtgccactgcactccagcctggccacagagccagattccgtctcaaaaaaaaaaaaatatgtatatatatatatgtgtgtgtgtgtgtatatatatatatatatatatatatatacacacacatatacatacacatatatatatataaatatataacatataatatataacaaagttggagatttgttcaagacttaaacatacaataaattgtcaatccaagatttcctgctattccaaatcctaacactttgttatctaatgtgcctacagattctaaatggttcacagtgtaatctttctttcctctgcctttttcagtattccagtaagccagtagttctctgcttatacctggaagaaccagcaatatacttggactgtagtgccacaggggttcgctgaagctctatcttgtttttctcagacattataccaagacctgtcaaccttacaattccatagaaattgtattctgtctatatgtagataatctttcatacttttagcttacaatggacataaggcctcaatggcaaaactttagttctgtagagcggctgtcctcagcctttttggcaccagggactggtttcatggaagacaatttttccatggactggggtaagggggatggtttcaggatgattgaaatgcattacatttttgtatattttatttctattattattacgttatataatgaaattggtatacaactcaccacaatgcagaatcagtgggagacctgagcttgtcttcctgaaactagatggtcatatctggggatgatgagagataatgacacagcatcaggcattagagtctcataaggagcacgcaacctagatctctggcatgagcagttcacaatagggttcaagctcctacaagaatctgttgccgccagtgatctgacaggaggcagagctcaggtgagaatgtgagtgatgggagtaggtttaaataaaggtgaagcttggctcgctggctccccccaccactcacctcctgctatttggcctggttcttaacaggccctggactggtactgggggttgcagatccctgctgtagagtaaaggtccattacataggatgtgatctgactgcagagagaattttcctcttaactgaaataataaaaacaatccaagggttccctaggcccacaactaaggcagttaagggagttcattggtcttatgggatactgcagatcttgagtcccacatttctctgctggcttcccccttgcctgaatttagaaaaatctctgtcccagagctttgccatgggaagataattaggaacaagctttcaataaaataaacctggccttataaccccttcaggttcaggatacccaagttatttaaaacctttcactttgggattatcaaatatgataatccatccttaggagtccttactcagaaacgtggaggaagctactgacccattgcttattatacgttacagttaaatcgagttgtcagagcatatccaaaccatctaaaagcagtgacagcagcagctaaattgataggaactttatctgacctagtattagggaataaatgttacctacaagttacacgtgcagttgaaagctcattaccttccagtcagatccaacatgtcttaataagtagactaacattttatgatatccttctcctgtcaccttctaatctctatctcagatgtcagtctgcttaaccctaccactttgctgcctctgtctgaacaataggaagaccaaaactgtgtgtgtggtatcataactattgactcctcacattgacttatggaaaacttcattaaataattctgaataaatacattttattgatggatcctatgaaaaaactgtagagaagaaatactgagcaagacatgctgtaacaactcagtatgaactaatagaaaagggaattctttctcagtttaagtcaggacaacccgaagaattacgtgatctaagacttaaccatatagcaaaatgccaatcattttccatttatacagataataggtatgcctttggagtgagtgatgattttggaatgttgtggaaacaaagggtttctcacttgtagtggaacccccatcagtactggacctctgccagatgagcttctttcagctattctgctgccctcacaagtagctcttaataaaaatgatgctcatgctcgtaggactgaacctgagtatcaaggaaatgcatgtgtggacttttatggccaagtctgaaattgacaaaatatgcattttgaatgaactccacagaattgaccaagatcaaatcactcaggataatttgttcagtaaacaatgctgtgcacttgagttgaaacaacaaaaatggaatcttaaaggttgcaaatttcatgctcaacaaggactcagtgaaggcccagacagccagctggtccttcctgagtccttcaaactgtcattattattaaaggccctgcactctacaaaccatcatggtgaagaaaaacgtttcagattatgaaaaagattatgaaagcagaaatggcttacagcagtgtggcttgtcaaactcataaagctggaaagacccttaagatttctgccacctgctagaccatatgtaggtctgcagatggatttcattcagttgccaccctcattgaggtatcagtacattcttgcggtagtgtacctgtttgcaagatagattgggacttacccttatagaaaggctgatgccacaacagtagcaaaaaattcttaggaaatgtatttcctttatggggcttttctggagagatctccagtaataagggaactcattttcctgaacaggttatcagataaacaggattttcaaactcggtggcactaccattggccttgtcatcctcggtcttctggaaagcttgaatggacaaattgtatcttgaaactaaaattagctaaattgtcagctggattaccttggccaaaaattttaccactagccctaatggcaattacatcaacccctacagaaaaacacaaatttgaccccttatgaaataactggaagacctatgcctttaataccagaaccccatgtatcacctgtatttgttagctctgaaatgactcaatactctaagaccttaatggattatgcaaaagtctatttctaccagctgaaggaggctttttgtgaactgcctaccagtgatgatctatgactggcttccataacttagaacgtggagattggatcttttggaaacaacagcagagaaaaattgcccttgagcctcattggaaaggactgtagcagacagctcttactactcacaatgcagcaaaacttcagggttttcagccttgggtccatctatctcaagtagagagagcttccttagactcttggacttgacaacctataggtgacttaaagatataaaagggaaagcctttccctaggagcaggtggcatcgtgaagtaaacaacttaccaccacaatgaaacgactacatttaaaacttttctcattaagttttgatttggttttgcattaacacaaaatgttcaaacttttgttgggaacttttcctactcaaacagaatatcctctaaggtctgatgttcaaagaatagccactctcactcaaccaaagcaattgctggccatgtagtcatatagatgaatggaatcacaactaataccgaaatctactcccacacacacttgggtgagcaattggttttatgaaaaggtttggtatccttcccctagcaggttggttgatatttatggttgactgacttcgcactgggaagaagttacagaagcaaaggtatgtcctgtaactactattgattttattgctggtaattttatcactatggacagaaaaccttaatggaactgggcctaatctagccagggttccagtctccctatatgcagtcagactttatgatttaacaccaattagggagactgctctcctatataatgacacatatttaaaatcagaacttcaccatgatacccttgactatattagtagagaacggactgaaactgacattggttcaaaggaaactctagaggcaaatggaatacccctgtagtttcactgtatacaatagggtttttaagatcagtattcagggcatatttgaaaaggaaacaagtcatccttatttggcgatggtacccatgtgtaatacatagaagtgtttttttattcctctttctatttaaatcataaccattctacctggcagtgtgcagatgcagatatgacagagaataaccatgacaatcacatcattcccaattggtgggtaataggatctcctttgcccctttctctcagtaatactggattattcatcttgtatggcaacaaaatatataaatgttttcacctatatggtctggacactgtggtttgggctatttcctacctaaaatgaccagatatgactctttaaatggttgtgaaattcttaatctggggttgtttgtacatgaagtgatcccttacaaaagaactccctgtgatctcccaaactcgaatatatgaaggggttctagattttgttctttggtaagatcgctttttctttagctggcagtctctgaattggaaaaatggcttatggatatttcagcaacccttgaaaaaaagttttaatgatactttcgatactcttcaagcaatacaatctgagatgagtcatttggtctcactggaactccagtagaagtttagctgctcacagggatgagctttgggtgaaacgtattgtttttatgttaattagatattgttgccccaaatttaaaagatcttaataaatcagaattttttttatcagataagcaaggcctcctccattgatttattcagttggttaaattttaggcccctgggaatctttgcttagagggatctttaagttcttgctacagttactgtgttttcttcctttgtgctttatatccccacaaggggttcaaatgctttccagcagccactcacacgtcagatgattgccatcagggaagctaacactgtgtaaacttgatggagggtgcatgactgaatcccaacataacttttgatgataacaactttacctgacttttcatcccaacttctgtgtcagtagtggttacaggataatgctactccatttggccaccctcaagctgagagggcagccaaaaggggggaattgttaaagcaaaattaaaatggagatcaggcctgaaaatacctgaccaaaacccccataaaacaaaggcctttaaaacagccttaatcttccttgaattgcaaacataagtgaaacttaacttgggtcatttccaatcaatgcttttgttggatagaactaaaaggagtttgagagcaacctgggcaacatagtaagaccctgtctctacaaaaaattaaaaattagccaggcgtgagagtgcaggcctgtggtcctagctactcaggaggctgaggcgggaggatcacttgagcccaggagttctagactatggtgaactatgattgcccctgctgcattccagtctgggcaacagagtgaggccctgtgtcttaaaatttcttcttaaatatatatttacagttatgattcataatttcttagaaagggggcttataatctttgaaaaacgttagtacaaagagtaactcttctaactcttttgtttgcctcactacgagtacaattatacatttaaaacttcgaaaattactggttagatttattcttatctgatcattgtctagttgccatagaagacatttaattgaaattaagtcaaaggtagattataaaagctcttgaatttgaattttagtcagggatcctactgaatgtttttgtgcaaggaagtgaaatggtcaaatttatgggctgtgaagattaatctgctgactatagcatatactatcaagctagattgggggatctactattatataagtatgaaatataagctgaacaggagcagggtgagaaacagtgcaagaagaagaaaaacctaagatttctacttggataattggtagaattatgatactattaaaaatcagaagggagaactaggagggaaaaaaatagaattcaagtttaggaaaaacagtttaaggtgatcacaaaagacagttactaaattcatacctcagctttctaacagccccatcagagttgatacactgaaaagtttgtaagtggttacttacattctgctgggtacagctctcgtgttcagtaaacatatgaaaaaacaagagttgtctttctgtttttagtcctggttgtaactatttcttcagcatgtatgaactgcccccctgcctttttttttttttttttttgtgacaaaatggtaacagcttgacagtatgtttcacagctgtgattgtagcttttcctatgaactgcatatttctaaattattcatagagctgaatgtagaagaaaacgaaatgtgatagaattactgagaaaataattcactatttctttacatggatgactggtttggatctagagtatgtatttttttttttcattacattacaggaagcagaatctggtaatataagtcaaaagtctgatgaagaagattttgtaaaagttgaagatttaccactgaaactgacaatatattcagaggtatttagctgtctttaattaaacttgtctttacataacaaatactgttaaaatgaaaaatgatttgtatttttaattttcattccaaaggcagatctaagaaagaaaatggtagaagaagaacagaaaaaccatttatctggtgaaatatgtgaaatgcagaccgaagaattagctggaaattctgagacactaaaagaacctggtaagagttatcaatttaaatcttgccatattgaaaaatcattgaatcttcatactactattgtgttttattttttaaatatgctactactgacctgggagatttaagccaaatactagaaagaaagtgtaattctgtaagaattttagttcaactatttataaaacagtgtcagataatttttttctattcacatctttagttttaaaaaatgtagacatgctggctgggcgcggtggctcacgcctgtaatcccagcactttgggaggccaaggcgggtggatcacgaggtcaggagatggagaccatcctggctaacatggtgaaaccccgtctctactaaaaatacaaaaaatcagccaagcgcggtggcgggcgcctgtagtgccagctactcgggaggctgaggcaggagaatggcgtgaacccaggaggtggggcttgcggtgagctgagatagcgccactgcactccggcctgggtgaaagagcgagactccctctctgaaacaaaaaaaaaaaaaaaaaaaaaaaaaaaaaaaatgtagacatgcccatggtttaagaaaggtacaaaaatattataaatagcaaaaacccacttttttttttttttttgagacagagtctctgccaccgaggctggagtgcagtggtgtgatctcagctcactgcaagctcctccgcctcccaggttcgcgccattcttctgcctcagcctcccaagtagctgggactacaggcgcccgccaccacgcctggctgatttttttgtattttttaagtagagacggggtttcaccaagttactcagatggtctcgatctcctgacctcgtgatccgcctgcctcagcctcccaaagtgctgagattacaggcgtgaaccaccatgcccagcccaaaaacccactttttattattgatttttagttctttaggagactataactctaaatattatgattcttagtttttaagatgcagataatacctcttttctacccgatgacaagtatgtatctagccctacctctctctcctcctcctctcagtgttcatattatttttgtttgttctattttttactttcaattttggttaagtatatgtgcattttgttccatcaactttggtcattatcccttgctgctcctcctctgctttcttcctggttctctgttcagttttacccatattcttacattactaaggctattatatacgcttacattttgttttcgtaatataattaaatggttctataccttctctgaggttgcttctatataaatatcattcattgtagagccaagcgatagtctcagattttctgtatgagtctaataacacagctctggagccactcaatgtttcttgcatcaggatcaaagggttttctttttgttgttctccatcagttcatcagttgatgaaaattgcatgatatctcattgtttttgtttttcctggaaatggagttgaggagaaggaaagacccttcagatatcagaccttcagttaatttctgttttcagcccacttctacctgttagaatatggtacccttctcagttgcagcctcttgcaagtgtttgaactgcagcttcctccactgtcattgggtatgcttccatctgcattgagcattctggtaatttgttgatatcccctcttctgttttctcacaaccagtcttttgttggtgtagatttattctattctatagttgttttcttttcatagtggagtgtttttagagagacacgaagtatctgctcagtctgccttgttgaatcagaaacgcctcacctattctttttttactgtgtgctattagggaattgtattagcaagctaatttaggatttcttttataataacgttatattaaaagtaaaagctttaatgacagagaacaatgttaaattctagtaattcgataagtaatttataaagcatttttattctgtttttcagaaacggtgggagcccagagtatatgagatgtcttcagaggctcatctaactctgtccttacatactcaatgcatatatgaaaacaatactaaataaacatctgatctgtataaaaatgtaaattagtttgacactgcttttttgataggtgtggtcatttctccccatggtagtttaaaacatcagaaactgaattctggacagatttaagccttgacacactgtgtttttttttttttcccccttcttttttgggtcttcatttttttccccattgtgatgtttggtaacgaatttaaaatgtagttttaaataaagtttggacttatctataaagtatcttttttggaaattatattgaattctatacagcaagtcaatgttttatataactttaggctgctcagagaagagcaatggttaagagttagttagagaaatatattatttgttataaagcccatccattaggccagtcttccaactaatgccagtgttgctgctgttgggtctgatgttcttcttttagatacctgcaggtcctattcctgtgcaagaatagggcagattatcaagatatccaggatacctatgaagttattatagaatatttattaatccattgaaattggataataagtttagaacataggttctcagtatctagaacttacatcattatcatctgtttgttaggatttgaaattctggaaaatatttatctacatcgcctcagactaaaagtaaaaaaaataagctttatataattagggagatttctgcacagagaagtaacattgtggttaattttaaatgaaaaacttaactttttcaagtggggataaataatacaactaaatttctgtaatagtaagattctgtatgccttcagataaacttgcctattgagatggtaatttaaagccaaagcatagcagtttcttttgtgtgtagtgaggttgaagcagatttgcaggtgaagtattgaaagtttatgtgactttaagtcagcttttgaaaagtgattgatttgctttttatcccaaactgtccatatacccagtaaggcttcaaaaaaccagtcaacaatgagtaagtcaatcttatagattcttcttcctcgaataaaatacaaagaattagttccaataagtattttaactttgttaacaactgaaataccccataaaaaaagaacttgttgagagtatttctttaaaatggttacttgctgcccaggcaccatggctcactcctgtaatcccagcaccttgggaggccgaggcgggcagatcacgaggtcaagagattgagaccatcctgcccaacatgggggaaaccccgtctctactaaaaataaaaaaattagctgggagaggtggcacgtgcctgtagtcctagctacttgggaggctaaggcaggagaatagcctgaacccgggaggtggaggttgcaggttgcagtgagccgagatcatgccactgcactccagcctggcaacagagcgagactctgtctcaaaaaaaaaaaaaaaaaaaaaaaaaagttaacttgctgtatacctcagtgtaatgtccattcaaggagtattaaatgaggatttccctgcgaggacatttactgtattgctacttaaattatggaagacaatatatcttcaactttaataaaacctattcagaaaattaccaattcagaattcggagttcttatccaggtgctctaactaacttcagggaaattggaacaataagttatgttacatgcacactcaaattctttattttctccactttaagcaggaaagggtaaaaactgttttggtactcaagcccagccttacatactgtgtttctctctctgtctgcatgcatattaaagtggaaaaattgtatttatatcttagttattaccatagtacctatgaaccttatcaaaattgcttatttgactggtgttacagctgctattaatctaagtctattgtttttctattttagtagataatttagttttaaaatacgtagggtttgagagcagatatatttatttaatctgttttctctagtaactattgctgaagggttaggcattcagtattcctatttgtcctaattttgaagttaaaaattttggttacagatagatagagggagaaaagttcaaaatgagtgagagagaactttatgcaggttgagataatgcctaaaataatgagctggccagactgtggaggtactctttgtattttgtaacattgactttgggtaaatgctttttcactgttaataaatatatatcctgtatacaa

SEQ ID NO: 931 - DNA, 157125 bp, Homo sapiens
atgcaattcttgagtattccagcattatttatttgatcagagtaaaatacacttcccatcactacaaactgagcacaactacagttgtctacacattcatatttttgacgtgccaacattttgcattctacatgaaacatttggtttaaacaaaatcttaagaattctctattttgtttcccatcttccctcctgttctctcccatcctccaaagatgttttatattaactgctatgagatttatttgccggtcacgtaatacggaggacagcagggaacaacacaagatttaccatgcctaggggatgaatggcaaacccaactttggctaatgtcattgagaacaacttggaagcgtgagcagagatatctcatgaagtggcagtgaacctacatttccatttatcagaagcaaacatggaaggttacatacatgatgaagtattggaagttaaagacttaagacacaaaatcactaatttaaaagaacatgcaacatgagtatcaacttgctatgtagtgtacatgtaaatgacccaaatattcacctctagcatcctgaatctcttcttactacagctgttatttgtacagccactgaatgtagattagtaaatactgacatcacaatgttgacacatgcagggagggggagataaagcaacagttcttccttccaccttttccaaagtctcaggattaggggaggtaataagttttggaaagaaactgaaatgcaacctggaggagagttggacaagccacattttccactcatgggaaagaagcggaccattctgctactttcccaaagacaaagggactccttaaagggtaactgaaaaatgagcgctatcctcccagactgttttcttctatcaagtactgcatcatcggtaagcactgaatcctacctttcttaattatactagccaatgacttccttgttctcgttctttattctaagatttcccaaaatttgtaatatcaaatccaggctttagtttatttggaaagtggtttcagcacctggaagatgagctggctctggggctctggaaaatcatattcctttatccttgtcccagagaaaagtaggtaggaggtagaaggtttgcttttgtggctctggatggtggagaaaggtaaaaggaaaatgagaataatgggagggaagaagacaggttaaatctgcaagggtagatcaaaggtaaaaataaggtggaaaaacccattggtacttccctttttctttctttacacagttagttagttagtttgtttttttatagaaaaattagggttctacatttacacatagcctgagaaaatgaattacaggatagtgttaggctcacatgggtaagtaaaaaatctacagaaaaatctagtttcaactgacatggctgaacactgaaaaactgccaagaagttacccccaaaagatacagagaatgtatagacagggacaagtcaaagctcttcctgttataccctctccctaccctgttacagggctgagcagagttggtggtagatgatcataattcaagcaactattgctttttcttctatggctttggctgaaatgtatatgctgattgattgattattatttgattagtacatatccagatatattcagattttgacatttaatacacagcagaggaggctgcatcagacacatgacactctgtgacatccatttcattcacaccccccacccccacagtcagactgaaaactcacaagaaggtgtctgtggtgaagaacattacaaaggttataaatcttaatagggccctgagagtttttccccctatgcttaggtgaaaaaggcaatgaacaagatgctctcgttctttaagtgctttgtgcaacaacgtccgtgtcgatgccgaaatctttttttaaatctttttttggaggaatcttttggacggaggcaaaagtcttcctccagagttccagtctcagaagctgcgattccgccggtggtgacgctccagttaccctacggtgatcacacgtgtgctgatatacctcttgtgcccacgttcctccttggggtcagtcctgcagacctgcatcaaaatgctttcagagagtctgtggactttggggaggtgtcatctgggtgaaatgctggggctagggaaggagcccgaattccttggtgactgcaaagggatggcggaggatgtgggggatctcttggggctacacaggtccccattgtgcagtttccacagaagctcctcgttttccatagagagtcgcttgttgactttcgactccttctccagcgactcttgcagaacagcctgctccgtggaaagctgccttgaagaaaaaggccagaaaccatgagatctatgtaaaaaaaaaaaaaacttgaaaaatttttcttagcgtttgaaactttaaagtccaaaattattcctttgggataaaacagaatcctgcacaaggtcacaggtatttggctggctaagaaaacccaaacacaggccgggcgtggtggctcaagctcataatcctggcaccttgggaggccaaggtgggtggataacttgaggccaggagttcaagatcaacttgggcaacatggcgaaactctgtctctattaaaaatacaaaaattagtcacgcatggtgacatgtgcctgtagtcccagctactcaggaggctgaggtgggaggactgctcgagcctaggaggtggaggctgcagtaagctaagatcacaccactgtactccagcctgggcagaagagtgagacctcatctcaaaaaaatatataataataactgtactttttgggcaatttcatagtaggctgagagccacttttgcaaatattcgacatgttttatgactaccttatgttgcaggctgttttctatttggttttgtgttgctctttgtctgaaagcattctcagaggcagccagaggccgtgggagcaggcttgctggcctgggtctcagtgtacagttttcaggccgctttggtaaaagcatgaactactacaatcatattttccacagagaaatcaatgcccttttaaccatctgcttccatcatatttccaggaggtgcaggggtagagcgtgtccagaaagtacactggatgtccaagggagcggggagctcgggagaaacagcactgttttatttttaccttgagattgccatgtgcttgtccatccgagctttcaattcttcattctcctgctggaaacgcttcaatttgtcaaccaatgctgtgttgttgtccaccttggcataaacaagaattccaacatttatacaatattaaaaaaaaaacccctcatttcttaaggcacctcacgacacaagcacactttggagatttaattaaggaaaatgcaattccatattaaaatatttatacactaacaaacatactgaaaaagattttaaaacagcaaaacagagcggctgggtatttttaaaacatgtatgccaggacacttaaatattgatacgagtgggtaacagatttgttccaggtcatgttgttttggaattctctaagaattggtgcctctttctgtttcaatgtgaaataaaccctgcagacacactgcccacacttatcaaagcttatctatctccttacggtgaattttgctggaaaaaaaaaaaaaaagattcccacatctgatgaaaactcacaggccagcaattcacagtccctggcaacgtttactatggacttgaactcagtttcatggtaagttttcagcatttgcgtctgagtggccatacaaagcttcaattcgatagagctcttagagcatgccatcaaagaagtaacatgccacgagtctcctcaggtcagctgaagatagataggtctgttctcttgctgccctgtgcaggctgaactttcaaggcaaacaaactgatcagcggagagatgaaaggataagatgcctgaggacatttaatcacttaacatgatgaagacctgattccatcccccactcactttctaaaggtaaggctttatgaagaggcaatattatagctccgtcaggattaagtctaagtccttgtccttgtagcaggactaacgcgctttgagtatgttgcttagtttggaacctgattgttcttaagacatcctgttatccagaagcagctcaggacaacctgttcaggttaaatcactttccagaaaaggagtctacgttcagtaattatgaaggattcccagataaaacaacgtggaaaaaaacctggaatttgagattgggaggtattgtcctttaaatatctcatcctagggaaactagtcctaataatgtcacagagctgattatgggcagtgccggtttcatgggaaagctgtctttcttagaaaacttcctgtgcttctaagtctcttaatttcatcagaggcctgtaatttacaaatatgaagggaacagtgggtctccctctcattgtatcaactcattcttgcacacatacacaatgcaaggctgaaggatattatcaggatacctctggggcatggcaagaaacaaatagtagatcatcagaaattaaatgtgttggtaagtttacagcaaagtctgatttattgcacatgattttttgaaagttttgatgcatgaatggcatatggagcagtcctattaacaggatcatctgagtcatccctgactaccagattagaagataccagactcagtcgaacaggacgacctttggcaggaactggtatgtatactaggttggcccattaacaaccatgagttcctttccttcctttacaaaaatttcctgataattcaaaatgctggtatatccacacaggggcttggccgttatctccctcaacagaagtcatagtctccagaagaaaaccaaacgccaaaccaacacaaaccaagcagcagagaggtcccccatgtcccctactgtccagggctggtttgggtttgaatgaggcacttgtagaagcctgagtcactcatcactgtggggagaagaggccagtagcatgcggcagctggacagtcaacagcaaggcaccgcgagggcggggatcacttaagctgccttgccaaactctgccaacttggttagagtcctggctggcagcagctgtatttcagggccgggccaagactgacgctgaacactgaacatgccactcacactaacatcgttctctgttctagacactgcaaagtgaatgttaattcatatttttggtaacacctgctacttgtccaaatggattaatcttattatagcacaattttttttttgagatggagtcttgctatgtcgcccaggctggaatgcactggtgccatctcacctcaatggaacctccaccttcccagtacttgggattacaggcacccaccaccacacccggctaagttttatatttttagtagagacagggtttcaccatgttggccaggctggtctcgaactcctgacctcaagtgacccacccatctcaacctccctaaactgctggcattagaggaatgagccactgcgcccagcccacgattcttttatcacatgctaattcacaagaagcaagatgaagaattttgataaatagtattgctattcatttctattaaattcatttctattcatttctattaaacgtatccaactgttttggatctaagaaacctgtccagggtggctggtatattaaagtactgattttacatagatatttaaacatttttcttatgcaggtgaagatccaaaataccactgaaatataagcctgatttgtttgtagtttttccaaggactgggtgctgttttacatgttccttgaaaaagaaaacattctaggaggcagcaatgaataaatatggaacaaacttggaaagaaaatgtgaactttatcttttgtataatttctaaatatctttaggagcagttaacccaactccacagttctaaaatgcagggctcaatttcacacatattaccccatttgtaagatcctctttcattctgaaggaaacataccagtttctccattttcattaacttgatgtcctgttgatgcagtttctcattcttgatctctaacacagctttcaggctttctaactcctgttctagatacatgatctgaggatttttctggaaaggacacagcaagatactgctcttattccacatagttcaaattcttaacagaaagaatctttgattagattgagacattagacaagtagcaagcgacagatgttcatcatcttagagcaatttcaaagaaagaggtgaaaaacaagagcaccttaatgtcgaagactggtcctaatactgaaagcaaacatttcacttatttatcagtaacttaatatgcaaaaatgtgagttgcatcaaacatgttattgtatcaagagaaaaactttgcttacatacaaaacagaatcttggctggagatgaggcaatctgtgagtcagttattggcattttctgggagaacagggaacaacagttctctcctaccaaacaaactgatcaggaaagaaaaagcagtgcattatacggctctctggaaaacaacagggataacaatgtcctgagtgtttggatttttgttatgatggggctacgttgactgggccatacttctagggcagacataatactatcattttctattgtgacaccccagtacctacacggcatggagtacacagcctatttaaatttctctccaaaaattacaagtttgccaggcatagtggcatatgcctacagtcccagctactcaggaggctgaggcgggaggatcaactgagccaggaggtcaaggctgcagtgaactgtgaatgcaccactgcattctaacctggtggcagaacaagatcctgtctcaaaaacacaaaactctccaaaataaatgctacatcaggggaggcgtcctctgagagcacaccatcagtgtggatttcccaccaccgcccacccactccttgctttattcggaaattcaactaaaccattcaaaatttatgctacagaagaacagcatatggtccactgatcagatatgtttaatgaagcaacgtcttaggtaagagtcggtggtgtggtcatcaagcttatcttccggggcattggtttctgctctggaccaatccttagggagaatccaggaaggggcctcggggattacttaatccaaaccccttacttcacacagaaagaggaaacgtgttccacgggttaagcgccctactcaggaaagatcaggaaagcttccagagctggaaagggtcagggcagggactaatacatctttaattctaggttctttagatagttccctgaggctaggagaggtatgcgtgtgtatggtgggaggtggggtggggtgggatgaggagaggttggttaatgcatacaaacatacagttagacagaaggaataggttctagtgttcaagaacatagtagggtgactatagttaataataatatattgcgtacttcaaaatagctacaagagaagatataaaatgttccaaacacaaagaaatgataatgatgacggataccctaaataccctgacttgggcattacacagtctatgattgtctcaacacatcacacgtaccccataagtacatgcaaatactaagtatcaatttttaaatttcatacattttatacagtgttacccttgtacgcaggatttttttttttttttttaccttgaaaatagcgaatcctacctcatttttgttagagggaaatggcataacttaccgtcagttttaaaattagagcatttacaagacttgtaccctctgcattttctcctcctcctctgccagcccatccctttctcccggactacagtcagacgcactctttttccgcagcctcagcatgcttacgtgacagaagcggttggatgcttctgtgttcctcactctgactctgccttagcttttcaaaagcggctgcagtagaagaatcccctttgtgtaccggaagctctttcaaacctgtttcctgagccatcaataaagtttataccctgcatatccctgcatgtaagtctagatttcttttgaaatcactgactcttcctaagaatcttctagaataaatagctttgaagtttctttgaatataagctcatctaatgttatcaaatagctagagggtctcccaatgacattatttgcagaaggtctcactgagagatccacacatgtactttctagagctggccagagatttgaagtggagaaaagctttgcttctgcagtctcagagtataaacatgaaatgaaaacagtggtactaaaggcagaagcagcaaggaaacaaatttttttcaaaaagacaaaggttggggtaaggctggggaaaaaggacaaatgtgccacaagaaatttcagcttccaagagatttgtacttttcagaattgacatttatccatacggcgaaatattattcatccataaaaagaaatgaaatactaacataggctacaccacggatgaaccttggaaactttatactaagtaaacgacgccagtcttaaaaggaccacatgttctacaatcaaccttttctattcattcctcagaataagtaaatccatagagatagaaagtagacgggggagagcctggtgctggggaatttgggggaatggggagtgactgctaatgggtccagggttccttttgggggtgataaaaatgttctagaaagaggtactggtgaccaatggacaactttatgaatatactaaaagccactgaattttacatgttaaaagagtgaacttttcctgggcaacatggtaaaatcccatctctactaaaaatacaaaaattagctggccatggtgatgcgtgcctgtaatcccagctactcgggagggtgaggcaggagactcgcttgaacccaggaggtggacgttgcagtgagccgagatcacgccactacactccagcctgagtgacagagtgagactccctctcaaaaaaaaaaaaagaaagagtgaactttgtagtttgttttatctcaatacagtgattttttttttaaataaagtcttcacataaaactctaatcctaattggtagtttccttctttttagcttagaccaccagaaacatcctggacttcatccgtatgtcagattttaggatggtaaaacaagacgccagtaagcaaagcagttgttttacacaccttagaaagcacattgccagacatgagaaggattcccaacctgtgttatttctctggctgctgagtacttgaatgactctaaaaggcaactgagaagaaaaattccatactgataaaggagcacacacaacttaccaaatttgctttttctcttgctcttcttttttgttcttctgatttcaatttttcatttaaagcatcattttcactcttcagatcattgatttgcttctaaaacacaatgaaatgtggaacttaagttaacaagaaaaccccagaaactcagcatacgtacacagaaacattaaaaccaaacaaaatcaaaaatgatatttttttttgtgggggatactgggatattgacattcacccacctctagcgattcctgcttctcagaaagtaaatcttcaagcgatttcttttctatttcatggcctttcttaatttctgggaaaataaacggatatttttgaggcaataacattctatgagatcaatgtactctaaaacagttaaagcatatagatgtaggggttgatgatgaagccgtatgacgttactttacatctatagtatgcttttatgtaaattggccatctgttctcaaaatggccttgagaggtggttagggtagacattcccattttatgactgagagccctgaggcccactgaagcccaccatggcccacagaggccatgcgaccttaggacaacactgagtgccatttcagggcaggctctcataaatgccactccagactcctggtctggaaaccctgtgctcttttcaatttgctcttcataacctaaacataagtctaaaattatactcatttctagcaggaaggaagaaaaacaatgttcactacaagtctgcctggagccagtcacttttacacattatcacctctgcctgactttgggcaactctatttttgtggtgagaaagtccttgctgaaggtcacacagccggttcttagcactcatccacgctgctctgtaagatgcaactggtttagtagaaagactgtgagcgacactgccgattctgttctgaaagcaatggcttacaccctcccactgatgacagatgaaaaatagaaaagactatttttctattcaataagtggcatcgacatttcacagcaacactgctgtgcaggagcacttggggtggatcctttactgtggattacaagatagaaacttgtacttgccacttcccagggacctaagctggcaaccaccaccgccaaaatggcctttacagtcttccaaagcccatcctatttaacacaaggctggcatttgtaactattatttgcatccttagtgggaaaaggcatctgttaacaataaaccacgcaaaaaggaaccaagaacaccccagcctgaaggccacagggcattcgctgaagcaggaagttatgaatcatttccatcttaaaacatcatgtggttccttcagattttattctgtttaaagaggaaaaaaagcatccttgcctgaaagggaggcttcataggccttctttagcaattcaagtttctctgagtggctagcttcaatttccaacttagaggtttcatgcgcagcatttaagttgtcaaactgtaagcaacaaacaaaaccgtggtttaacagtaaaaccaaatgtcctaagttgaatacgcaaagcaaccacattaggagacgtcacagcttcacaggtaagcgtgggctctagtttaaaggctcctcaacacatacaaaggtcagggcagtggttcacacttgtaacctcagcactctgggaggcagaggtggaggatcacttggagcccagcagttcaagtccagcctgggcaatgtcgcgagactctgtccccacatgtgcacacacaaagaatgcatgaagagcaacgcaactgggattcaccgctcaactctcctctgtctccttccctaccctcaggaacacagacacagaggctctccagggtgacagatggaaatggctgcatcagtcacaaggaatgaccaggaacgaggatatgtttcacagtgacagggccacatgctctgcgcctgtcacttgaccactcaggccctagcatgtgcctggcctggagtaggcactctgtagatatttactaaatgaaaaactgagttaaaaagggagctacaaaattaaaaaggtttgatattttattcagtgaaaaaaaaaatgggatatttaaacagatgccactaaaaaaaaaaaaaagaaagaaatgcaaaacaatagtttggcaacacaccaccaggatgtttacaagggattatttctgggtagaaagaaagggttgttttttcaattttatcttttcctcctccttttcttcccttctttcacttaacataatacattcctttggtcataagaaaactattcaattaaaaagatactgtttccaaggcaggcggatcacctgaggttgggagtttgagaccagcctggccaacatggtgaaaccccgtctctactaaaaatacaaaaattagctgggcatggtgatgggtgcctatagtcccagctactcaggaggttgaggaaggagaatcacttgaacccgggaggcagaggctgcagtgagccaagatcaagccactgtactccagcctccagcctgggagacagagtgggactctgtcttaaataaacaacaacaacatgctttttatacctattagactaaaaaagagaagctcatcaagatgtgaagagcaaccaggattcaagtaagcagcagaggcctcagacaagctctggctgcaaaagcacagacctgctcttgcaattgcattttgtacttctctgcttcttcaatgtaagtgtcccgaagcttttcatactccctggtgtaaaactctttaagccgattctctcgttctgttttttcagcctggtgctgctggacgaatgcttcatacactgtttgtaactcattcctggctttttctaatttctcacaggtggttgaagcagtgactgaaaacagaggagaaagaagagggaagaggtcattttatttgtgaaatgtcctatattcattacagtcacacacagctgtgatgacacctgaagcatacacccatgatgtcttgggtctctagtgaccatgtcttcaaatataacagtatggaagtgaactgtaaaaaggaacacgagggcagggcgcagtggctcacacctgtaatcccagcactttgggaggctgaggtgggggaatcacctgaggtcaggagttcaagaccggcctggtcaacatggtaaaaccctgtctatcttaaaaatacaaaaattagccgggcatggtagcaggtgcctgtaatcccagctactcgggagggtgaggcaggagaattgcttgaacccgggaggcggaggttgtagtgagccaagatcacgccactgcactatagccggggtgacagactgagactccatctcaaaaacaaacaaacaaaacccccccccaccccacattcaaaaaactgactcccaagcagtaagagaagtacttcagaagacccaggtttctaagagaagatcccctctcatgtggtgaccagtcaatgcagtggtcaagaaaagagccttggccaggcagagacatttcttaggacaagcgactcctccctctcccagccagccagtgtggtagaagctcacacaagagcaggaaagacgagggataagaaacaagtggaccggccgggcgcggtggctcacgcctgtaatcccagcactttgggaggccgaggcaggtggatcatgaggtcaggagatcgagaccacggtgaaaccctgtctctactaaaaatacaaaaaattagccgggtgtggtggtgggcgcctgtagtcccagctactcgggaagttgaggcaggagaatggcgtgaacccaggaggcggagcttccagtgagccgagattgcgccactgcactccagcctgggcgacagagtgagattctgtctcaaaaaaaaaaaaaaaaaaaaaaagaaacaagtggaccttaaacttgtagttaatttgagttgattataatttgttatttcaaaactaataaaaataaaatattagcctctattaaacgcaaatcaccagagcacaaatatcttagggaaaaaaaaacacatcttaaaagcacccacataggccaggcacggtggtttgtgctataattcaagtattttaagaagctgagaccgggcgcggtggctcacgcctgtaatcccagcactttgggaggccgaggcgggcggatcacgaggtcaggagatcgagaccatcccggctaaaacggtgaaaccccgtctctactaaaaatacaaaaaattagccgggcgtagtgacgggcgcctgtagtcccagctacttgggaggctgaggcaggagaatggcgtgaacccgggaggcggagcttgcagtgagccgagatcccgccactgcactccagcctgggcgacagagagagactccgtctcaaaaaaaaaaagaagctgatgcaggagaatcatttgcacctaggagttcatgaccagcctggacaacatagggaaacccatctcttaaaattaaaaaaaaaaaaaaaaaattatccaggcatgatggtgtgggcctgtagtccctgctactgaggaggctgaggtgggaggatcacttgagctcaggagattgaggctgcaactgttgggcaacagagcaagaccctatctcaaaaaaaaaaaaaaaaaaagcaatataaaatgaaaggttaaaaaaatttatatatgtatacataggtacatatgtgcacgtatatatgcatacatatgtatgcatgcatatatgtatatatctatgtgtacatgtgtatatatgtacatatatgtatgcatatatacatgcatatacatatacatatataatacatatatacacatatatacactatatatatagacacacacacacacacacacacacacacacacacacagagtcttgctgtattgcccaggctgaagtgcaatgacacaatcttggctcactgcaacctccaactcccaggttcaagcgattctcctgcctcagcctcctcagtagctgggattacggcacatgccaccacgaccagctaatttttgtattttagtagacacatggttttaccatgttggtcaggctgttctctaactcctgacctcgtgatgcgcctgcctcggcctcccagttaatatattttaaaagggcaaagtaatctgatacacataattgaaaatcagaacatcttagctcttccctacaactaccaaaaatagaatgactaacaatataatacatggcagaacacaaccaaagatatatgtacacacactacaataaatcctagaaaatcttgaattccttaggaagcctgactttggacattcccagtcttctgtcaccgatgtgtaaatacaggcagacagggtactactgtaactgtcagggatacacatgctgtccacatccccagagtactcgtggattaatacgacagggttgctggcaaatctgttaaattaacccttacctctctttggaaaggaataacatatcaggagttgaaggaagaagattattttagggcacagaaaaggacaatttagatcaataattatttggcctaaggaacgtgaaaatggcaggttcttaggaagatttcctacaatggtgtcaacttgttatctcaggaacctgccatgtggtggtagaaatacccaagtcacttgcccccagtcagtattctttcagaggaaaaggaggccacattgaaataatggcaggaatagtgtctgccaaagagaacccttaaaaattaaatcaatctacaaatgtttattgaagggcaaagatttaacattaaaaaaaaatccccaaaacaaaaactatttctcgttgcctggcacagaatggggctctttatcttgtttaaccctcacagaggaccctcctaaacatatagataaggaaaccgccacagagaggctaaatcatctgcccaggggcacagagctggcaagcgtgagaggatgggtttcggtgagcagtctgaattctgattctgcctgcacccaaagcccgtgccccttcttttctaccaagctgtttcttgtgctggggctggcaaggcgcatgatggggcctctactggaagagacaacagacagaggagaagtggcaggaccaggccagaccttggggcccagggagtggcactcaggatagtttacgtccagtcagggtggaccaaaggtttggtcagatttttaaaacaattaaaaaataaataaataaaaactgtgatgagggctgggcacagtggctcacgcctgtaatcccagcactttggaaggccgaagcgtgcagatcatgaggtcaaaatatccagaccatcctggccaacatggtgaaaccccatctctactaaaaatacaaaattagctgggcgtggtggtgtgtgcctgtagtcccagctactcagcaggctgagtgaggcaggagaatcgcttgaacccgggaggcagaggttacagtgagccaagatcgcactaccgcactccagcctggcgacagggaaagacttcatctcaaaaacaaaaacaaaaaaactgtgatgaagcagataccaaattaaccattttaattatttttaggtgtatgattcagtggcattgaatacacttacatcgttgtgtaagctttgtcatcatccattctccagaacgtttccccccaacctgaaacttcgtaccaattaaacagtaacaacccatcccctccccttccccaaggccctggcagcgaccattttactttctttctctatgaatctgaccattcagtacctcatatacctggactcaaatagtacttgtcctgttgtgactgtttatttcatttagcgtatgtcctcaaggctcatccaagctgtgggatgtgtcacaatttccttccttttgaaggctcaatattattccattgttggccgggtgcagtggctcacgcctgtaatcccagcattttgggaggccaaggcaagcagatcgcttgagttcaggagttcgagaccagcctggccaacatggtgaaaccccatctctagtaaaaatacaaaaattagcggggcatgatggcgcacgtctgtagtcccagctactcgggaggctgaggcaggagaatcgcttgaacccaagcagtgcaggttgcagtgagccaagataacgccactgcactccagcctgggtgacagagcaagactccgtgtcaaataataataatgataatattccattgcacgtacagatgacatttgtgtatccacttaccatccacggacacttgggttgcctccacctttggctactgtgaataatgctgctatgaacaccgggggacaaatacatgcccgagtccctgctttcaattctttggtgtatatacccagaaggaattgctgactcatatggcaattctattattaattatttgaaggactatggtactcttttccatagtggttgaaccattctacattcccatcagcagtactacacacaagggttccaatttctccacatgctcaccagaacctatttgattttttcaaatatatgtaacagccatcctaatgagtacatcactgtggttatgatttggtcagtagattttcaaattaagccatatgatagaaataaaattgaggcatcaaggatgaaaatcctatcccagcatgagcaatgatgggcgacagaacggtgagccttggtgattaagaaactcacaaagcagagaagatagaacccaaaaagacagacggaggccagattacaggggccatcgcacgcaactcaagcctttgggactgaatattaaaagtttcttttctcctttaaaagaatttagtgaaagatagtgatggtcttgactgctggagaacattctctgcacattcacttttccttctattacactagtaaccacagaagaaaaaatgactcaagaagtccaatgttagtcaaacgagtaaacactgcattagcttctgccaagtaactttccgactctgaaggctcctcgtgtgaatctcgtattagaactttctatgaaaacctacaacagaaacatactttgcaagccgttggtgaaggtatcaaatagcttctagtcagagaaattctagtttcacgcaggcttttcacttgcttctcttaaaatttccggtatttccaaagttaaaaaataaaaaagcaggaacaagatctgaacccatctggaagctcatatctgggacagaaacatctaagtgaactcagggactcagcaataaacaagagactgcctccaagccctgggctagaagagcttcgaagctgacgttaatagcagactaccctggctgattttaacacatctgtttatgataaaaatactgtcgctttgaatatgtaattgtggcacatcagcctttaaaaccaaataggatacacagaagtcctttcctattagccatgggacagggctgtttccctctattcaccaaaaaaaaaaaaggcagctctgacgttttgataagtgaggtgaagagaggacacatgggaagaaacgggaaagagaaagggagaaaatgggtcagatgggggaacaggaggttcactgctgttattgtaatagtccaaagcagcaggcccagccccagacagtgacatcagcctgcagctgtgcacagacctttgctctgtttactggcccggtgtgctgctggggaacagctgggctgcagtaatcgctcacactaatggctttcgtttgaaggaagtggcctgggctgcgaaggaaacatttatttggcataaagactcatgaagtattttttaaaggatgcacatgtaaacgctgtattaaaggttctcagagtgctcctcggcagctgtgacataaacgtgtgtgtgtggcggtggggggcgtgcataaccccgattttaggccatggactttcctgtgcactgactacagcttaggagagatttatggtgccacctgtgtgtgctctcactcctatcctcagcctagtctcttcttgctcattctccagaattccactcactttcaattaatcagacaccccacaaagccaaaaccaaacataaaattgtttcgaatttgcaacaagcaagcatggacatgcgaatgtttgaaagaaggtattagacaaacacaaagtcaaagtagtctttttgtccctattttttttttttttttttttttttgagatagagtctcgcactgtcacctgggctagaatgcagtggcacgatctcggctcactgcaacctccacctcccgggttcatgcgattctcttgccacagcctcccgagtagctgggactacaggtgcacaccaccacacttggctaattttttgttttttagtagagatggggtttcactatgtgggtaagactggtctcgaacttctggcctcatgatccgcccacctcagcatcccaaagtgctggaattacaggtgtgagccactgtgcctggcctctgttgttttaatcattccattagtctattttttaaaaaagcacatatatgattaggaacaccaacagaccaccatctgtaggagaactgctgggcaacttttgtatacatgtttgtaaaccatgaaagctatctccagcaatctagcttaaaagaggaaatacagttctcaggatttaaggaaaaagagaaaaaaaaaaaaagaaaaaggaagaaaggaggaagggagggaaggggaggaaggagaagaaggaaaggaaggcaaactcatgtacaaaaacatctctaaaatgtaaggccacattgagattagaagtcagtattttcactctgcaatgaatcacccaagaagaattctaggccagtgaccctccctgacagtttaaatcatggatatctcagcaagaaaaaaaaatcgtaatcagtgaaatgctttaagttttgcttttcaagtaattatcaagatgatatgtggaaaatgcccagtgccacagtcaaacataatctctggaaaacagagctggagtcctcccaggtccttcattacttagccctgcagaactggagtggagccattacttaattagtcctcatggctttttctcagaggggaaggtcagacttttattatttccatctcacagagactcatttccctttgttgattgataaatgtactgtttacagagaaaagcattacacagccatggcccgacattgttaatattcttttgaaatgatacagtgctttcctagtttttatatctgagtagcatggttcattatgagacgaccaaaaatattttaatgctcaagaacataaataaatgtcctaataggatagagccaaaattacttgggttcaaatctcagtcacaccactcagctgctacatcacttgagcaaattacttaaactttctaagcctactttttgttttgttttgttttgttttttttgagacagaggcttcctctatcacccaggctggagtgtagtggcacaatctcagctcactgcaacctcggcctcccaggtttaagcgattctcctgcctcagccccctgagtagctgggattacaggcatgcaccaccatacccggctaatttttgtatttttagtggagacagggtttcactacgttggccaggctggtctcgaactcctgacctcaaatgatctgcctgcctcggcctcccaaagtgctgggattacaggcatgagccaccgcacctggcctaagcctacatttcttcatttttaaagtggagatattattagtcccttctctagaagatgaaatagcacaggtgaagcactcaccccagtgcctgaccacagtaactttgcagataaattgtataactgttacggcttgcaagagtccattgattccagtgtgtttgaagactcctggaagacaggcttagggttccataacagaaatataacagttaaaaagcagcattgctggcctcgtattcaaatttgatgcatatgaacacacagacgtagctattatggtggagtgtacactcacttcaagtctttcccttccgctactattgttcttgacattatacgcaatagaattttcctaatttggaggagattttatgtaaatcagaactaaaatataaaaaagaaaagtgccaggcaaattttcatagcgccacataagagaataccatagaaagaagagacgaacaggaaaaagagatgattccattcccaaactgcacacatactcctttcccagacgctctggccagcctgctgtgggtggcgactctcccccaccccaccccgaaatccccctctctgcaccatctaggatggagaagagcagcctgcctccagctctgcctgcagtgggcccctcactctctcttggccgcctgggaaaccggcctcctcctctcagttctgggctccttcacttctttcttcaacagtacatacccattacacttctcggggtaaacagaactgtcacttctcttgtgccccacccccagaagcaggaggggacactacattctaccgtaggagtgtgatgatgtcataacattctactaagggaaatccgaggaaatccgatcctgacacacgtccatggcaagcgactatgtaggtgacccccttaagccaaggtctgatctggtttgaaactggaggtagtaacatcactgaacaagtaaccaagaagtcatttttaaacatcaaattgatgctttgtggacaggcagtggcctaaagaagaaaaaaaaggtgggacccagactatcccacaaataggcatgtccagtttcctgggcctccgtgtcctgatatggaaggtaggaacaaataccacctgttctgccaacagtatagattggtgatagtaaagtgaaacagagttactcttatgctttgtagaaagtcttcccagcctgtggaataatcccctactcacatagtgccagggtttgcctctctaaagatactttgtcaaatgaccaagaaattttgcagacaagtggtagaccaggttctttttctacatttccaaattatctccaaatgcctttctgattactcctgggcattaaatcaacaaatcactaagagctcatttcaaagtcttccataaatcataaattattaggaacttgctttttacaaaaggcctgcacaatcaaatcaatcctcccataaatgccacttcacctttaaaactcagttcatactttacaaggtgctctcacatttgtttcatttaatgtaacaatgctctgaacgaataaaataggtattatcagacatctcattttaccaaagaagaatggaaataacggagctggatctacaactccagcctctttgttgttgttgtgttttgagtagatatggggtttcaccatgttggcaaggctggtctcaaactccgggcatcaagcgatctgtccacctcagcctcccaaagtgctggaattactggcttgagccactatgcccggccctagaactccagcctctttgagagcctaaccacagaacacccagcgggatctgactggctatttttcccagcctgagatgtagaagacaaagttaattcacacgtaccatggatgcctcagggtagtagggcttaattctcttgtggaagcactgctgaaaagattccaagataaggcaggtaaaaaaatgacctttccccccctatactgggtagtgctgacaaagtgtgactcacaggtgggaagacaattccacccagccagcctgtcttccatctccatcttggtgcctaggtaccagccgggcctcccctaaggttctagcctctccctgccagtgttcctcctcccacccttgaagagaagcctgcaaaggccatttgctgtttttcagctcattcactggccagcatgctgcagaacagatgcttttttttttttttttttttttttaaatcacaacagcaaacactccgtgtataaacgaacacatttaggaataaaagtgggttggaggcgagagcacagctgaatatctgacaatatgttctaagattcaggcctgagaaaaagtgaggctgactttaaaggaatcctgtttcaatcaagagtttcaatgtaaaaaaaaaaaaaaggatgattttaagtcagggactattcattctgcctcttctcctcactgacggatcatttttagagcacgagggtcaaaaaggctgctaaaagtccttggcatgtgtaaaatttaaaagcttatttataagaatggactcaattcactcggagttacttcatattattcttactatgcttgagatatgtatgtatttttttacataaaagaaacaacattctaggcagctagagcagtgtcaaagggtagtcctggggcacctacatgagaaccacctggatgatcattaaaagtgcagattcctcctcaatttccattaagggaaaggttttgctttatttttctttgcaggtagccaaagctgtactcagatattgctaataaggaagaaaaactggtctcctgttaacctgaggacactagggccagaggtcaggaagagggatcaccttccccatcaacacaacatctttttagaagtgctgcctctccttctgtaattgggaagcacctattactattccttaaagcccaaagaggggttagtaggatgatgggtataggagacgttggggtttaaaaaaaacaaagtgcagattcctggacttcatccccagccaaccaagtcagaagcaatgggcatgagaactgaggatctgcatttcaaccaggtctattttcgtacacaataaagtttgggagccactattctacacaataaggtattaaattaggaaaatcccaagttgagagactggagttaggacaaggaacaggacaaggaggaacagtcagtgggtttcaaacacaggtaccactggtaaaactgcatatctgcaggtgaaagaacatggccttttacttataaatacagccaaccaaagtccaaattgagggcagatgtggataggaagagaatgagctaagtctgaggtggctatcaactcagtcttcaaacaagtcagggagataaacagccctgttttggtgtacagttggttttcagtatattaatagatttttcattaaagcctacttcaagaaaagtcacttctggaattttacaactcaaaagtgacttacctgtaaagagtttaaaaattattttaaatacatagccttgttaaaccaaaattgtagataaaaacggaacagtgaatgaatcaacacattccatatggcgtgaggcaatgtgaagttcatagacactgggttaagtgttgattaggcaatgtgtatactgcttttggcaatgtactgttttttgcaagttactttcctcagtaagatacattttaacaatatttcttaaactcttgattagaagaaaaatattccaaaagtagctatcaatgcaaacgagcgtttatttcaaatagttttccaatcttttaaatcatttcatcaaactttccctgtggtgactaccagaagattggtggtctagccatcttgggttcttatgcaagctctttgctttccagcttcccttgggaagttacttaacctctgagccacaatttattttttataaatacaatgcagagaagtagactgagagctgaacattgtttgttagggatgagtaggcaccaaacacacgatgttgttatacctagctcataattttcatgcacaaaaatcaactggtctttttacactattataggaagggcaagcatttttagtgaattaaggattaaaatcttgtttcacaaaatagaaataatcaggactaatgtataaaaagatgagagttagctgttaattgtgatggctcaaaaataattttgaaatacaaaataatcttcattaatttagatcaagcttgtccaactcacagcctgcacgtggcccaggacagctttgaatgcggcccaacacaaatttgtaaactttcttagaacattatgagatgtgtgaatttttttcttttcgtcatcagctatttgctagtgttagtgcattttatgtgtggcactagacaattcttcttccaacgtggcccggggaagccaaaagattggacacccctgatttagatgaaaagtctgattccaaggattaacattaatgaaaagcaaaaagaactctaaagatcataatcatggccctctattgcaccagctgttattcaacatgactctggaaagaatcttatcctagaggcaaaatgtctgctgcagatgtagaccatttaactgtaatctatttccaaggctgacactttcaaaatgatctgattaactgggattgtcggacataatataaaatgtatccaagagagttacagctctcctttatgactatgcattcctaaaggacaattatcttttcttttcaagatgtggatttcattttttaattattctgactctgctttaaacttttattttaggttcaggggcacatgtgcaggtttgttatttgggtcaacttgaatcacaggggcttgttgtacagaatatttcatcaccccggtactaagcccagtacccgatagttattttttctgctcctctccctcctcccgccctccaccctcaggcaggccccagtgtctgctgttcccctctttgtgtccatatgtgtttgtcatagaaatgttaaacggtttatagaaaaacatttgtgcataaaaaacactgagtattagcatattttaagaagaaaactacctttccctagctaccactgttggtaataaaatcattcattgattgaagtctaagcacctgctaagtgccaagcacaaggtgggagaactacaaaaattaaggagctattggccttgcccttgaagagttcctaattctagatggcaagaagaggtctataaacaaatctctgtaagaacaaaatcttaaatgtgtacagggtgctttgaaaagcacactagaaggcacagttaacttacttgaaagatttgggtgaaattcaattgaagatattttagctaagacttaaaaactgagtaaaagagaaggagcatgaggggtccgcgacgggaggggagtggaaagaggagagtgcactccaggcagagaggataccgtgcaaaagatgtggacaagaggtgcaaatgaacccatggccggggcctgggaggggaaaggaggtctgaacaaaggggaaagagtgcctagacgtgaatttggactggaagatttcaatcagtcaaatcataaatggtgtgcttagtatgtctggattttttcccccaaggccaaaatagagtcttttgtgtttgttaaaaatgtccagtacaggccaggagtggtggctcaagcctataatcccaacactttgggaggccgcagcaggtggatcacctgaggtcaggagttcgagaccagcctggccaacatggtgaaacctcgtctctactaaaatacaaaaattagccggccgtggtggtgcgcacctgtattcccagctactcgggacgctgaggcaggacagtcacatgaatccaggaggtggaggttgcagtgacccaagatcatgccactgcactccagcatgggtgacagggtagaaaactccttctaaaaaacaaaaaaaacaaaatgtccagtagagacacatgtcagcctgactctaagtacagatcctggccgcaagtggagttgggggcgcaggcctggaggcaaggtgacccattgggtagctgttgcagtatcttccaggtgagaaattgtgggacttaaaacagcagcagccagaatgctgagcagggatggatccaagtggcatttaggacacagactgacatgcacgtggaggatgggggaacaggagtatgatttcagttgttagcttgggtggtaagtgaatcatatcgaccctgccaaagctgaggaacaggggtgaatgaggagacgctgcatggcgctcaggaaggaaggggctggaccatcaggaaggtctgattatactggactggctcacctgggggcagcccctcactgggaagcatctgcagcttgggaaggagagaactagaaaaataaatctgtgtcactgttgtataggtagtagcggaaaccatgggaatggatgagaaaacagctggcaatgaaacccttgctatatactatgacactatttaaggggtaagtgaacgtatgggacagccacttgacagactttcccccagcccattaaaggtgatcataatgaacactatgaggcaatgtggaaaagtgcttgacctatccagtgaaaaagatcacagcagacatctgaccaggtgccatggctcacatctgtaatcccagcactttgggaggccgagacgggcggatcacttgaggcaagtgttagagaccagcctgaccaatatggtgaatccctgtctctactaaaaatacaaaaattagcccagcatggtggtatgcacctataatcccagctattcgggaggctgaggcaggagaactgcttgaacccggaaggcagaggtcacagtgagccgagatagtgccagtgcactccagcctggcaacagagcaagaccctgtctttaaaaaaaaaagattggagcagacacttaacatacacaaatctcaaaagtattatgaaacaagccagagacaaaaaacagcatactatatctttccatttaaatgagaatctagttcagacaaaacctttgataataaaggttaaatcagtgtttgcttctagggggaggggtgttccactgtgaaatggcatgagggaatttactggattgacagaaatagtctatgcttgataaggatgtaggttttaggagtatatgtctgtcaaactgatggaataattagcattccgctgtatgaaaattacaccttaatttaaaaaatcgtagtatgaagttgtatatattcatataaactaagaaaagggaatatgcaaataaagttatgtcagggcagtggagctgccggctgttttcttttcacttaaaaatcttaattttcatacattgttctaaaaaaaaaaaaaactttaaaacttaaaatacccaaaaatatttatcgagtacccaagaaaacagaaagcatattatattatttttccataggaaacagaaaagaatccctacaattatggactttatacctgaaggtaacaagaaaacacgagacagtaaagacatcaacgtagagtatcaaaaaatcactggaccaaagggacacttttaagagtttctgcagaagcaaagaaccagtgcttccatgaagggagtgtggctcagacagtggaaacacacaggctgctttggacactgccacagtgagactgagggaacaacgggaaagtcagtggatgctgggacagctggaggctgttagatgcggaaggtggaaagcacagactctacctgggtttcagtgctcctgagtttatgaactgtcctttttctttgcagttcttagtagtttgggtaccttgtctcaactttcattgagaaggtgaagaaaaattacccaatgggagagtgacaccaactcccatcgccccacccccattattttggagggaagaagtgggtgctttgatgacggcgatagtggcagctctcttttcttgagttgctgtgatgggccaggcactacaccactgctttatatgcattactattttattcaagctccacaataacgcagcaaaatacatactgatttcatatcaccagcgaaaaaaccatactcaaagaagttaggtaacatccaactaggagtggatggacaaaaacctaggctttgactccacacaccacactctactggatcaggagaatactctgatgaggtctcatttccacttgagtttgaagagcctgtcgtttgggatttctaggaatatttagtctaatgattattcctttctgtagcatagatgatgccctcacaaaacagccagtgtggttaattactacacagctgtcaagctgcatacatcctaatacctattatttaatagcagttaacacttggtgctagatgctttacaatgcattacctcatgtaatcctcacacccacccttggggcagacaattagcatcgccatttttaccgaggatgaaattgggacagaagagatacaaagtgacttgtcctaagtcactcagttaccacaaatgtggccccggacagtgtgacaacatcagcctaaccactttactgcctcaaaatttaaaactgggttcccaactttgctatgtcaatgtcaaagttagtttcatgctgaaactaacaatcccactggcagccttgagagtgttcttcctggaccgcttcatcacaagtgtttacaggtttcgcttccctccacttacagaaccaaaacccttctccaaacggagaacggttaccatcagatgtatgcctgctgcaacagcagcaatgacacattccctaagaagccagcactgggtgactggggatctggataggccacccactgtaccaacactcgggaggcaggagaagcagtgcaccaggacagcttccttatcaaggataggaaggtgacagtgggcacagactgttacagctatttcctgtcaggctacctgactcactggaggtgctgaatccctgggccccaactgcggttgcttaattgtgctgtccactaaaatgtaaaaagagcatccttcattgaagcagagcgaatgggcacagtgttccattctcattgctgccttgtcttcggagagaggctgaaatgtgaacctctaggtaggctcacctccacttccactgggttataatgaactctgaaacacacacaaaaaggcctctttcctgatcttctaactctgttaattatgttatttaaggcatggacaaaagcaagttgggttggtcatttaggtaatcataagggctgctgtcaagttaagtaacatggcagaaagcctgcaaagtctgagagctgggctgtctctcagctgggatttccttgaactgtttcaccagaactctcaagtctttgggattctgaagtttccatctgtcttaaaattacttttccataaagaggccttcatttccacagcctaaaataaagtgaggactgatgtcttggctaggtattaagaatctggacggttagtcagggatttggcctcacctcccactggaaggggaaaagggaagatgaatgcagagaagtcttttacagagtcttgctctgttggccagactggagggcagcagcacaatgacagctcactgcagtctcgaactcctgggctcaagcaatcttcccacctcacactccagagtagctgggacaacaggcacacaccaccatgcttggctgatttttaaattattttttgtagagtcagggtcttgctatattgctcaagctggtctcaaactgctggcctcaagtgatcctcccacctcagcctcccaaagcgctgggattacaggtgtgagctaccacacccagcccagacaaagtcttgaccccacgttcactgccgtttgatttctgctgtggtgaaggtgggagaattaagagtgttcaaatccagcaaatcaggttggcagtgtggtcttgtccaaaagaaaaaagggcagtttctcctagagttgggtgaacacaatttgcttctctggatgttaccttgcattattcatacaacatacctgggcatattttggtggagactgtaacacacacagaaaactgcaaagggcaaggaaataagccctagaatggtcagctccagatctggctgaagctgaagcaggaagttgattctctaggttgaggagcccagggcagagagaagaaccccaaagcggtcagatcactccaagatacgagttgacgtagaaaagggagtgtcggctgggtgcggtggctcacacctataatcccagtactttgggaggccaaggtcaagagatggagaccctcctggccaacatggcgaaaccccatctctactaaaaatacaaaaattagctgggtgtggtggtgtgctcctgttgtcccagctactcggaaggctgaggcaggagaattgcttgaacccgggaggcggaggttgcagtgagtcgagatcgcaccactgcactccagtctggtgacagagcaagattccgtctcaaaaaaaaaagaaaaagaaacagaaaagagaaaagcaaaacaaagcaaaggcagtgtcgtgtctgttccatgaaccctaagggcttccaggagagaatggaactaaaataacagcgtagcctggaaactggagggctgggtggtgggtgttgagacctggaaactgcagggctgggtggtgggtgttgagacatgtaaactgcagggctgggtggtaggtgttgagacgtggggctccctgtggagcggggaggtggtgaaccatcagcccccctccaaatagtaagattagcatagaacgtgcctttttcagccaagttgccttcatggacagcatcctttcaacttcatactcactactcacaaaccaacccttggaagtacaacggatttactgtttatcaagaggggaaactttcactattctcatatgaaaagtgcttcagaaaaaaaaatgacaacattatttaacaggaattcacacaattacaaaaataactctgtccctctcttcagcaagagaaatattttgctcatcagaagttctgctaggcttagtcagatcagtgccaggaattctgtgaactgaaggtcaagctgccaagattcaaaagaaatgtcgatagtaagtgtttgcccagatactagacagggagtgccaacagctcccagcatgcaactccagccacaacgcagacaggacaaccacattttccagtgttccccttgtcccataaaatttaacaacaacaacaaaaagctcttacctagctctccccggaggttaacaagttcttgagatagggttttgtgttgtttcagtgcttcctcccgctgcggaaaacacacatcaagttactcatgctttcaagagggtccctttcagtaaggtacacatttgttatcactaggaaaatgagacccagtattgggaagccaagatatgaatcatttaggctaacaatttgtgttgttaaaagaaacacagttgtcccttagctgttaaggaaattcgtaattcaaaaatctgtatttttgcaggtcccagtgaaactttggtttgacgcagtgaatggcccatttagaaatatttactttgagccagtgcttcactgctgatccatagaacctttcggctaatgcatactgtacttaagatgtaatgcgttctcctcctccaagggcaataaacatctaatcagtttaagataaatatttaatgttctaaacataagcacatatatgcactttgtcctatatttgcacataaaaaagtttcgttacaatgccaatccttctaaaagaaagacaaaaagtttgttagaaagctatagcagaaagataatcctttaaagacaaaattaaattaatttttttcagctacataccattttctaaggattatgatattttggatcagtgataattctaaatcgatgttagagaaacaaaccaaagaaaaccggatggctgtttttagtatcagagaagcaagtatcaaccttgagctgaagaataatgttcaagttaccagcaactcccggcaatcacacatacacacatacttacacaaatacagtaattacatacagttccttaaaaggtagattccctagcaccagggagtaactaaaaaaaaaatgaagaatttcaaagctcgctgaaaaatgccctcacgaggatcacccaagacggagctcccaccacatcctgatcacagcgttgcagagatcatgagacccggcctttgcaggcaagagttgcttgtcattcaaagcattttccctgaattccagacagcctctgcagtagtcctgacattcttccagaaaagcactataaacaaatactaattacccttgttgctgcacatggagaatagaggcacagtttgctgctggggcagcccattttccagcttctgtctccaagtccccccacccctcgcactgtgcaagaagcatacaggtggccgcgccacccaccagtcgggtctgtctacattcaaagctctagcaggaggcgcgccattggccctcgggcgtcttacttcatgtcctgcaggttaccgtgtgcctcggattcctcactcacagaagctgatactgcagcttctgcctttggcacaggcagcctgtgattacttaaagccacagcctttcatttatgaaaaacgagaggcaggcattagactgatcgattgccatttagttaaatatcagctgcaacggaggaaagaaaaaactgaccccctctgcatggataatggagttatttttagacttgtgagcctttttcttcccctctctaattgtggtcattatttgatcacacttactaatagaaaagggaaacttgttcttcgaagcccatatactaaatgaggttatgaactaggtgaagagcaaggaaaggggcatgctgtcgtttacaaatttaaatgacattatgaaatgagaggtgtttcaaaataagtctgaagtgctgatctgagagttggagatcccatatatttttaacttttactttgttctcacctctcagtaagagctacggaagtcaagtctaaacgccagcactgaaacgtggtcagcagggactgggatttaagacccacttttcactgagtacctttctggcttcaatggtattctaaatgcttggtttttaaaaatatggcattaagttgttctgaaatcaccagtgagtcagagtttcttaaaataataagtaattggttttctaatgtagaaattaaagcctgaggaaaatcagcccgcataataatggaagaaaaacataaaaatatgtatcataaatacttctcgtaatatcaaatttaagcctgaattttgtttagtaatctacttcaagtaaacaccaggaagctttaccactcaagtaacaggaaaaacaagacagctttactaaatgcccacaaacaatcctgaaactcatttggtgaacttgcttaaaattcacttttcagtagtaaccaagttactaacagaaggaagagatggcaagaaaattcaatcatttttcaaatttatggaaactaatgggaggatgaaagaaattaaaaattacagttagtataactgcaaagaaaaattgtgtgaaatcattatgttctactgcaaaaatacaccaggtgatatttttgcttattaagggaggttttgggaaagggagtttcaccaagcatgtcgacatttccccaaacttcaactccactgcactccacgttcctgtccttaatgcctcagaaactactgacatcttccaacctctgtcaggcacagtaacagtaacaggaaaaccttgaggtcatctttcactctttgtctaaatgggttgtgcaaaagtcagttggttcttcccttgtaatgtgacaccattcccctcctccaaatgcatagaccatttacccttctaaattggttggtaacttattacttcaaactaattaactaagcatttttcatagcagatgctgtgaaaatataaaagaaatttaagacatggtccctgccttcaagaagcatggggcctacctagaactagaacatccaggctcaattcttttggtcatctatcaaggcagatgacctcatcggatgggaagcagtaatgaaaaaaaccaagggctttaaataccatccatagatgaaatgctgaccccagtgcccatactgtaaaagacacatactaagggttagtttctgcctgactctccctggtagcttggcctttacatgtacttaccctttacttgtagatgataaaatgcattatgtcctttagatactgatttactgtttctttttactcagctgctcctagatcagtgtttctctcttagatgataaactcttaaccgtctagataacaggttgattcaattctctttgtattgtaacatgcagaattacacacaatgtgaaaaaagagaaaggtggaaatctggatataaagatgcctttatgctcaggcattaaatatatgaaatgctcaagaaaaaaaaaatggattcaccataattgaattaggagtccctgggacacaggcacttagtctctggctgtggtcccatcggtgtgcctgcatttttgctagccactgagtagcatcaacagcatagagcatcttgcagagaatagccacatcagatggctcagacgtgtgctgcatctgacctcctccccatcacccacacagtgaatttgctcaatgcatctatgtttttttgttccaagtcaactttactgctagtgccattcaaaattcacctttgttcaggtgctactttaggttaaattccacttgcaaaaaaaaaaaaaaaagatgtggaggcattttgaagaattagaggtttggggagggtgacctcagccctgttcaagtttacctagaaagccacccaatagacccttttaggaagaagcttaattactaccatcaatactgttgttcactttggctgtctgtgcagaataccgtctaactaagcaaggataaaccaagaattagaaaaaaactaaaataactttagtgtgtcttctgcgaaacagagtgtgacattagttctcagattcatgagatataagaatgtctgatatgtaatgaaatatgtctgccactacagtgggaaacttatagttactaagtagacttgcaacaaaagcatggtagttgcaagattctcttaaccattttcacccataatcgaaggctctaaagccatttagaaaaggttagcaataacaaaaaatatatatacacacacacacacaaatacctatatattatacatatataaaaatacatagacatacaatgtataggtatatcatgtatataaaaaacatacataatgtatatgtatacaatgtgtatctgtatctattttatatacatatgcatgtgtgcgcgcgcgtgtgtgtgtgtgtgtgtgtgtataaacacagtatatatacttctgtaatgggaatgggaactaaaaggttaagggagtttttaaaattgtttaactttacccatgattttttttctccaactatttttattttatttatttatttatttatttatttattttttgagacagggtctcactgtcacccaggctggagtgcggtggtgcgatcttggctcactgcaacctccacctattgggttcaagcgattcgtatgcctcagtctcttgagtagctgggactacaggcacatgccaccatgcctggctaatttttgtattttttggtagagacagggtttcgccatgttggccagactggtctcaaactctggacctcaagcgatccacccgcctcagcctcccaaagtgctgggattacaggtgtgagccaccatgcctagcctccaactgttttataatagtgctcagtatacattacacaatcagtaaatatttgctgattataaaataaagagagcaaagaacatttacataagactttatgctcatcctacatctggaattccatcctctccgttcatatgttcactcacatatatactgtgttgactattaaagctgctggggtggtttcataagaaagaactagatgcagatcctgccttcagtaaatttcctgtcttaaaaagcaaaaacaagcattaaaccggtatctctaatataacacagacaatgaaagagaagcatatatgctcctggaatccagacgggaacagaacgtagatctagaaggccaggaaatcattcctgagtgggttctggactgggagtggtggatcatgcctgtaatcccagcactttggaaggccgaggcaggtggatcacttgaggtgaggactttaagaccagcctggccaacatggtgaaacctcatctctactaaaaatacaaaaattatctgggtatggtggtgggcatccgtaatcccagctactcaggaggctgagtcaggagaactggttgaacccaggtggcggaggttgcagtgagctgagattgcgccactgcactccagactgggtgacagagcaaggccactgtcgcaaaaaaaaaaaaaaaaaaaaaaaaaaaaaaaagcgggttctggagctgtattcagtgcagtcacaattccttggctgtcaggacctaaatttaagtataaggtgaaattcacacacagtacaattgtctgggaaattcactaggagcttgccatgtttgtggacaatgcatctctctgtagatccaacccagtgaatttttttcctctagcgttggatcaactctctctataactgagcacctgataaaggcctcggcttgtgtttagaggccaggttgcatgagggaaaagtatctttaaacactaagatagcagagagtatagaatgctcacgccacaagaggtgttcggggactgagcagacacatgaaggaagggtggactcctgaccttcatctcaaattgactcccgggccttcgttcactggggggaatacaaggtggacttgtgttcttcatttaatttgctttttttcttttttttttaagttggaatctcgctctgttgcccaggatggagtgtagtggtgcgatcttggctcactgccacctccacctctcaaagtaaagtgattcttctaccttagcctcccgagtagctgggactacaggcacatgccaccacacatggctaatttttgtagttttaggggagatggggttttaccatattggtcaggctggtctcgaacttctgacctcaggtgatccacccgccttggcctccccaagtgctgggattacaggtgtgagccacagcgcccggcctgcatttttcttccttcagttgtttgtgtactgaatctatgtaaattaaatgcaagtggtgatgtgatgctgctgtaaaaccgacctgaacatgtaggtattgtgggcaaggacagcaacccagtaatgatacgtgaacaatggatgacgtacaggaagtttacaggacatttttagttgatagcttcctagacctaggtttacgtcctggttctcctcttgctagctgtctgatagcaggcaaattacctaactctatgcctcaattttcatatttgtaaattccaactcgtgtctttggtgaggatttaaataaggtaagtaagaatatctggcacttagtaaatattaggctggtgcaaaagtaactgtagcttttggcatgatggcaaaaccgcaattacttttgctcaaacctagtattcaataaatccctcttgcttctcctccatctctttatgtacggctacagcatctgggcatgataataacattaaaaggggcagttgttgccaaatgataaagagccttatagtaccagttgaaaaccagactccccaaaacaaaataacatgagttacgtaattataaatttcctagtagccacgctgagaaaagttgaaaaagatgaagctaattttaataacgtattttatttaacccaaatatatatataaaataatatttcaatatattcaatataaaagttgttaatgagatattttacatcctttgttttcattctaagtttttggaatccaagtgtattgtacacttaccacacatctcaattcaacggatttacatttcgaatgctcagtctcatatggctagtggctaccacactggacacatcagctgtagataagggagaaccactggaagatttaatcagcagcgtgggatgctttggtaagaggacgctgtcagcagtgcttgggatggattataggtgagaaacagtacaagcctaatgattggttaaaaaggtgctatcacaggttgggcgcagtggctcacgcctgtaattgcagcactttgggaggccgaggtgagcggatcacctgaggtcaggagttcaagaccagcctggcccacatggtgaaaccctgtctctactagaaaattacaaaaactagtcgggcatggtggcgggtgcctgtaatcccagctattcgggaggctgaggaaggagaatcacttgaacccgggaggtggaggttgcagtgagcccagatcacgccattgcataccagtctgagtgacagagcaagactccatcccaaaaaaaaaaaaaaaaaaaaaagttgctatcatgatctagtggaagctatccagggtctgagcaaggatggcatgaatggggacagcaaagacataggaaggggaaaagcactgtgaaatgagagttcacaggacttgactgacgtcatgaggaggatgaaaggagagaaaacagttgaggatgggggctattaggctagatataataaaataaaataattggtttatttctaaacataaaaactaattgttccccacatttgatagtatacagtttctagttagcttacttggttatataaacacactcttgattcctttcttacaaatgaaagagaaacaaaaataccatatactattaccgttactaaaaccctaagtagtctccaacttcccctcaaaaaaaacaaaaacaaaaacaaaaacaaaaaaatctggagaaagctgtaaaatactcatcaagaaatcattaaggctgggcgcagtggcgcatgcctgtaatcccaggactttgggaggccgaggcagacagatcacagggtcaggagatcgagaccatcctgcctaacacagtgaaaccccgtctctactaaaaatacaaaaaactagccgggcgtggtggcgggtgcctgcagtcccagctactcgggaggctgaggcaggagaatggcatgaacccgggagatagagcttgtagtgagctgagatggcgccactgcactccagcctgggcgacagagtgagagtctgtctcaaaaaaaaagagaattcattgaaactgtctactagtctggtagtttctccaaggcacagaccaagtctcatccacttctctctctccccactccctaaaaaggcagccatattacaggggcctctgtatgaaaccaggacaggtttgttgatctgaacaaaactacagaacaaccaaactgaacagttttctttttgcttttaatttttattttttccctatgttgctcaggctggtcttgaactcctgaccacaagcgatcctccctcctcgtcttcccaaaatgctgggattccaggcatgagccacagtactgagccagtctttttttttcccctttgcattatcatgtatagccatctttaaaactgtgatttaaaaaatgtctgaagagctcaagttgtattcttatcagttgccccctgagataattacagcttttattgctatgtcagtaacatgttgatataaacttggttttctcaatgaattttagccagttcctgaaataacatccctgaagaatattagggaaaagtaacaacacggcaaatctgctttgcttttgttgcaccacagagattgttttaggaataaacagaactttcagaaagaatccccagatatgattcagggagttaactcaaaagtgctctttaatccataaatataactaacgtcatttttcaaagcattaaactaagtgtgatatgaaaagctacacacagacaaacacacaaattaagtgaaaaaaatgctaatgctagtttaggtctagaggcatacaccggcgtaagaggcaattatgttttttgctgttgccattctaaccaacagactctaggggaaaaaaaggaagtgagaaaatgtttccatcccaaattgctagagaccgactcaagtatctggtgaagtgacaaaaatgtaatgggatgaatgacacctgatctttcccatcatttacctagatattcccaaggccagcgtgtgagcaagtcctccccgtgctcccccgacctcaagtagaaaggctctttctaggatgcacctccttacctcagacagcaggtgctgaatcacaactgtcaatgcctcaaacttggtattaccacaggcaagaagctgcttgagctgcaggataaatccactttggttttcacattttgttttatattgcgtcaattcaagtgttttctcagggggcagcgcatcgggagctgtctgtggctggatacataagcttcgaggattcttttgcctgctcttttcaactgcaaaacgaattaacataggtacaaagataggtgaggttaatttttaaaatcaccaccacaaggattcaaaaacaaccagataagccacagaaatccatttaagttatgttgctgtaaggaatgcatatggatgagaactggaatgaatcggagatctagacggttggaattcatgaacagggaccgtggcttcatttatgactttaaaagatttatggggaacagagaattaggaacatgacacaaatggatttggcaacccagaaacacaaaaactgggtgcaaaatgttgttctcctcgtttctcattttccagttaaattggtagagaaaccttgactgaagagaagcctgacttttctgatctcatatgctgaaaggaacacacaaatcactggactttaaattaaatgcctttctctcctcccatacattttctacaaatcttttaccttttccctgatgatggcctagccattacacagatttataccgcagatgagtcatttcctaatctctaataaatcataacatacatcgaaaatatactcagattttgcctctttaagttcactgttaggagtactatactgttgactatactattccattttctatcgaacacaagctttgttggtcttttttcccaagtagtaataacggcttacacagtttttttttaaagcacatgctaacactccaaatccacccaaaatgccacgctaagtgattattcccttcctgtgcaatggtgccctgggtattactctgttttaaataaaaaactgttcagtcttggaaccattccaaatgtgtcattttgaatatcaaacagaattggaaaaacaggacatcaattgcttaggttcttgaaataaacaagccaagtaatccaaacaaatgtaaatctggaaaaaagacacaagaaactaaaaaaaaaaaaaagtttccttattctaacagtctttcattacagcatccacgttctgtggtagcaaatctgaaacaacttttaaagaaatttagtaattactgtctctaatttttcaggaaaaggcaagctactacagtgattgcttaaagaaacatcagtactcactttctaagaacaaatggctaaatatattgaataaactaagttaaaaacagggaaaaaaaggctcttattttctatggctgcattacatggttaaataagtcatatttgtattaatacttgataattctcagttctaaaatcactaaaatatccattgtcccactgtgtctctgtaatacttgatgagaggaagtatttatccattactctttattattagcaattattagtagtagcttatgaataattgtcacttgcatagatgtagaaaatagccaagttaatatcgtaatattacagccctgaaggaagaacaaattattagttacatactaatgaaaaataatctaaatatttgaccatgagattagcattctttcatgtcatttcctaaatgtttttagaaattgtcacataacacataacaattccacagtgtttcgctcatcacagtgtgctctcactttccctttcttttcatcctcccaataaccccagatagggaagagaaggctcacaggtgtgaatgtcttccctggatgtagacaacttctatgggaatccagattcaaagtcagaacccaggcctctgatgctaagcctcttctgttcccacacattttggaaagcggattaggtggtgatgtaatatatgacatacataaaaataaatatttatgcaacaaatgtaataatatcttgctataatacatataagcccattatctgataactcattttaacaaacctacatataaacatctatgtgttatataactttataaacaaaaatgttcaaattctttcactatctagaatttactgtaacaaatatagacacagttcattctcctgatatcatttgtatatgtcctaccgaaacttacttaaaaattcatttattgataactcctttatcatttcctgagtcctgagtaacatttgcctctctttctagaatttctatgctaatcaacgctatttttaacacaatttcagagctttaaaactgttggtttataattatttacaaaatctgagaggtgagtcttttatattaatattttggagaaaatattcttcaagattcttgctttttgcttataaatccgtaacaaaaatatcacagaatacatgtaattgtactaacaatgtttacttttgaagggaaggtaataggaatcagacagctaaaaagtatcctgaagcattttttatactttttaaccatggggtaaatatattacctattcaaaagttaaatataagaagtaaataaaatcacttttaacagacagttaaagtgaaattcgaggacatacattttttatataatacttagctatgaaggaaatagtctatgcagaatttttccttggggaaactacacaggaatctaaacattacgcagggtttgtaagtgattactcaggatagctttatgattaaggaggaaagaacacattgatgtattcgtctaagagtacgtgtcttcaaattttaaaatgagagcaaatgagccaacagactgccctctccgtggcgctggaaactcgtgctgtgcagtcaccatcttccgctccatatactgtgctccctaaggatgaagtgtgaccgcatggcagccgatgacccagtttccacatgcttcccactctcagcactcctggctcagctgaagatcagagatgatgcaaaaatctccaatgacgctcaaaaccccaaggctcatcaatacgtacttcacagtactgaaaagccaggggttcccttaaatcctgcaggattcattactaacgtgaaattagcatattatcagccaaactttgcccttacccttgcttattagcatgttactgttttgataacaaaggttttatacagaagtataaattattttgtttactgtacctattaacagaacatgttctgattttaaagggccaatttaatcagaaaccttaaaattaaacgtcaacttctatatcgattcagatttatctcaacaagataattaccaccatcagctgtgatccagccttactgggactcattctaatgaaatggcagcctccatcaggaaaacgaaggccagaaccaaagacatttgctcatttggaaagcagctggatgaccctgttggctatctttgttctttctattcagaaacctcaatttaataagatttaaaactagtgcaatgaagtcatgtatcatcttcttaaagaaagtagttggttaatgaggaagatgcccatttctcaggctcaaatcacttaggcaaatagacctccaaatcccaagaccaaaaacaattttgagagaaaaacctaaccattaagacatggactaaccgtaaccacatactagcagctgaggacacattcattctaggctgaagaagccacacatttcctcaatctgctggcttttccaattattaaaatcaagttagagaccagacctactgagggagtttgccttgggttccgtgaaacacaaactaaacacagaatttggaaacgaacgttgtccacttttgtgtatactcactgacctactcactcactcatgaaatatatttattaaaatctaccatgagggcactgctgtggtgggtgtgcacctgccctggtgctttgcggggacaggagaagtatcacataagagggtggtattgctcagagaggcacaaagacaccaaagatctctgctgactcatgtttccctagtgctcagctcttcaactccaaatctcaacctatctgtaaaaaggtgacagtcactgactggatggtaagtcctttctacaacatattgcattaaaaaccgatgtttgtgggttgacaaaacataggttatgaactcagaagctagtgagaggtctctctctgctagcggcatggacagacagaaaattcccttttttctgccttaatctaatcgtacacatctaaaagccctcacagggacactgacacagaagttctttcagtcagtttccccagcatctggtggcaggtgcttatcctgcctatgcaatcttacatacagttttttaaagttaccattcatgtcaattattagtttatgtttgtataaagttttctagtgttcattagctgtttactctaaaagagttaacagtaataatttaggagacatatatttttctatttacatataatatttttctatttctaggtagacatggcatttactgaaaatggaaaattttaagctcagcaaagcacagtgtttagacatttagaattacccaagccaggccgggtgcggtggctcacacctgtaatcccaacattttgggaggccaaggcgggcagatcacaaagtcacgtgattgagaccattctggctaacacagtgaaaccccatctcgactaaaaatacaaaaagttagctgggtgtggtggcacctgcctgtactcccagctactcgggaggctgaggcaggagaatcacttgaatccgggaggtggaagttccagtgagccgagatcacgccactgcactccagcctgggtgacagagcaagactccgttctcaaaaacaaacaaacaaacaaacaaaaaaccccaagccaagcccaattatttgtagggggagggaggaggatttaggatgcctcaccatttaaacttttcattactatattggtagaattcgttgcaatagctcatattatatcaaaaagggttctacttcttttcttcacattaaaagcagattagagaatagaaagcatattcgagaatagaaagcatattcatataaaaaattcctgtttgggttaattacgcttataaaatttttcctgaagcaacagtccaaacttgccctaaactattttccatatagctggcaggaaaaaaccaaatttctcatactcttatgtacctaaaatggactcctaactcaaagaagagttaatataaattcaccacattcagaagtacttttaagaaggcattgcctctctcctatagcaaccaaaaaagcatggcactggtctaaaaatagacacatagatcagtggaagagaacagagaacccagaaataaagccacatgcttacagctaattgatctttgacaaagtcagcaaaaatacatacaatggggaaaggacaccctattcaataaatggtgctgggaaaattggaacagagaaactggagacctatctcttatcatatgcaaaaattaagacagatttaagacttaaacgtaagacctgaaaaaataaaaattcctgggtggggggagggaactagaaaaaactcttcacaacattggccgacgcaaggaattcatgactaagatctcaaaagcaaatgcagcaaaaacaaaaatagacaaatgggacttaaactaaaaaggttctgcacagtaaaagaaacagtcaacagaggaaacagacaacctatagaatgggagaaaatatttgcaaactatgcatttgacaaagatctaatattcagaatttacaaggaacgctagcaactagcaagaaaaaatacaaccccaataaaaaatgggcaaaggacatgaacagatgtttctcaaaagaagacacagaagcagccaacatatggaaaaagtagaacatacgaaaaaatgctcaacatcactaatcatcagagaaatgcaaatgaaaaccacgatgagataccatttcctatcagccagaacggctattaccaaaaagtcaaaaaaccacagatgttggcaaagatgtggagagaaggcaatgcttatacactgttggtgggactgtgaattagtacaatctctatggaaaacagtatggagattcctcaaagaactaaaaatagaactaccattcacccagcaatcccactgctgggtatcttcccaaaggaaaagaaaaacacagactatcttataacagaaatgaaaattaaaatagccaattaaaacattaaacattagaaatatttacaatacaaacaataaataaaaagagaacatcattctcaaaatactaaactgtcgacaagcaatttggaagaaacgtgcctaggactcaggtcaccagggagaaaaaaggcaaatctctcaccccaaaagaaagctctattactcttaattttccacagagccacataattgctgatgtttataaaaaggaccctcgtgtactaaaatgacccaaagtattgcctaagataaatacagaaatatgatattcaatattagatacctctaaaatcacacctgttgtgtttctaagaaaataatatgcatatactattaataaaatattattcttagctctgaaagaggctttaaagctcataaaaagcatcattacattaatttatagggtaattatctattaattaaccagaataaattgttctaacaaaacaagtatttacttatatacagcttgccatattcctccagtgtctcttgatgaaaaacactgctatccttcccattctgaatgcaactctaaaccgtaatttattacttactttccatttttgtgtaaaagtagatactacattaaaacataatttagtgtagtaaaactctagttatctgaaacttgtcaaattaggacatactgtccctttcaacatctcacttttaaaaacttatcaaaatcttacctattgtgagcaaaacttgccattcaacactttattgtcttcttcaattgaaagctgtaactacaaaagggcagatattcatgtcacggcaaagctacagctctaaaaccgccacagctaccgaagcttggaatcaatccacgacaaaacgttttcagcatcatgccattcatcacaccagttcttagcaaatgcttgtctatgtggcaagaggccagcaaaatctttcatgactgctttcaaggaggctgaaaggaagaatctggattcacagtaagataactaaggggcagtgaaagactacatctctcgttcttcttcaccttggtccttttgatttcttctacattctacaaatccctgaattttaccttttcacacgcaaatgctaatatatgtgtttttttttaatggaagctttctaatatggcttcattgacgtctacattttgtagtacgaaaaacacaagagaaattgaagtttacttactgtcaccttaacagtacatgaataaatgccctcctaatccataacacatccataaatgcgctaataacatattaagcatacaaaagccacatttaaagttgaacacattcttcccaatgtattttataactgaaaattcattcaagagatcaaaaatcaaatgttaagacttacgtccaaacgacaaaataacttgaaagtttaatggaaccattacacacaggtaatcaatgcccctccaaaacgcatagaatagagaaaaaatagcaaggcctgttgcaagatccaacttgttaaataatacactcccctcatttataatcggccaacatccgcttgagaaatacctgttctgccttctctgtggcagatattccaatagagctcttataacattttatacctgtctgtgggacagagactagagaagtcacacgctctatttcccagcctcccttccaggtcgagtcatgtgactaagacccggccaatgagacggaagcttaagcgacctggcaccaccccttcctcatttctttttcttccttcctggagcagctactgtgagatcatgaggcaacaatcatgaggacacggctaagaagacagcagagatgaggattcctgacacggcagagccaccgaacaacctcaaagctgcttttcttcaggtgagacaagttgcttcttagtgaagctgttaattccatctaaaaagagtcaaaagtgaataccaaatgcgagaacataatttgatgaatttcatcctaattaaacaaacgcattcacattctgcctgcctgttactgaacacttctttaaaacggttctcttcacgaacacaaagaagggaaacaacagatgggggtctaattgagggtgcagggtaggaggagggagaggagcagaaaacaataacttgggtgctgggcttaatacttgggtgatgaaatcatctgtacaataaactatttattgtacaagaatctgtacaataaactctgtgacatgagtttacctatataacaaacctttacatgtacccctgaacctaaaagttcaaaataaaataaaatggcaaaagtaaatggaaatattttgttctgatactacctctgccatccctcgatacgtacgtacacatgttcctcccttgcgctgcagtaatcacttttaatgtcactagctcagcagaaagaattctgtctttagcgtactgaattgccttcactggagtcaagaaggaaattaacctgtgaggttcaaatggcactcttcatagcaattaatacaagaatttccagcttcatagaaaaactgaatgctaagtggcagggaatatttcttagcaaagtcttttccctccactaactcattataaaaatagaactaatatgttgaggtagaattccgaaatagaccgagtttaatactttggtaaaaagactattgctgacccttctccatgtcagtgacgtcatcactggacttcttagattttcatctgtgcctaatgtcctgcaacatcacgcacagttcctgacaaattcactcttttcctcctctcccctgtttaaagaggaaagataacctcgatccaacaacacgctttgccagtgatggataccacccagtaataatatatcagagtgcccagtgccctctgcgtgggatcaatgagaaagcttattctggccggatctctacaatgaccagcccccgtcccaccacattctatgctcagaaatactacaactcctttgtttccttgaaggagcccttcctcaagcccctcaaggtttttacatgctgttttctctgtcggaaacactttgtttcttagtaaattctccatttcctgaggacccaacttaaaaggcacttctactggaggacctggattaaaggtacctccacctgctgagagctgcttgggcacaagtccacaccctgcattattaactggtgctctgtctccttctgttaaacagtgggctgtgtgaaggcagggtccatgtgggacttagtcccagtcatactttcagcacctaccattatgcctggtacacagtactcatctaacgggtacttctttatgaaacgaatgaattaatctgtaatgtgaaagacagtctagaagcaagggaaaggctggaggcacagaccaaatactaagctcttcagaaagcccagtcaacatcttaggctggattatacaaaactgttcctatttggctacttttgacttattatacaaaagtgttcatatttggccactttttacctattaattttttgtgtgtggttttttaaatagagacagggtctcattaactctccagggctggtctcaaactcctagccttaagtgattctcttcccttggcctcccaaagtactgggattataggtgtgagccagtggcaccagccaggaagagcagtttcaatgcttcaacatgataatgcctggactagggtaatggcaggtggtaaaaacaaatcaagatttcaaatgatggagtcttagagttttcaaccaattgattgtggataaatcaggacaagtaatgattcaaaggtgaggtttggccagacgtggtagctcatgtctgtaatcccagcactttgggaggctgaggcaggcgaattgcctgaggtcaggagttccagaccagtatggccaacatggtgaaaccccatctctattaaaaatacaaagaaattagccgggtatggtggtgggcacctgtaatcccagctactcgggaggctgaggcagcagaattgcttgaacctgggaggcggaggttgcagtgggcccagacagcaccagtgcactccagcctaggcaacagagcgagactccatctaaaacaaagcaacaaaaaaacaacaaaaaccaaaggtggggtttgatgaccagacacatggtgtcatgaaaagaaacagataattcatgagtattaactgaatttaggaggtaaaaaaataaggagacaaatcatttagataagatgaatttccaagcagagtaatacactgagggttttcaaatcttcagccagaaattcacagatttggaggctaaggggaacctggaagtcatctcttgtggttcccttattttgtagccgtgtgaggttaggtgcacagggctattcacttggtcaccagcagaatcaaggctacaatccaggcctcttgggatccaggtcaacaccactgcactgaggcaaccaacaccacttccttcactaaggataccaacccaagttactgctgacagtccattcagataagagtcaccatgacggcatgaattacccacttgacggacgatttctcggacgttaaaatgacataacatggataagcccatcaaagactgatattgggagtaagcagaattatattccttacatgattttaaaaagcctccaacacacaaaacgcttcctccatccctgctattccttggatctaacaaaattacagcaaaatttgcagctggaaaatatgtacgccaaaaattctaaatagaagtcccaggttttagtcctatctctggcacttactgtgtgcctctgggcaagcgaattcacttctctgggcctcagacttcctggtataagacagattagatcacctctatgtgaactctagctcaaaaaattatgactgcaaataaacagaaaatagttttacgtaagtttagaaaataaaatgtgtccaatacatcactatcaactaaaccctggtaatagaagccttgtgtcgtttgcttacgctgtcttggaaagctatctgcttcacaacaacactacagacaacttagaatgtctactactagagcactggttaagtaaatcatgacttacccaataatggaatgttacagaactattttttttaatgaggtagataaacatgtgatcacatgcaaatctaaaacacattaactttaaaaaggtatagaatatatagtacgcttttatttctgtataacaaaaaagaataaaaaagacctgcatagatttacatgtgactggaaacgtgcaagaacactatgcaagcagctgagagcggctgtctccacggagagcagacagggactctgggtaagagagaggcttgcctaggactgcacaaccttccatactgtttgatttttaacttggagcgtggattacagtatttttaaaagaactctttaaaattaaaagctatttggagctactttagatcagacaaattattgcaaatatagggcaccctttgttatttttcccccctattaatttgttcagttggaagggctgcagcggccctgagctgggagaggagggccactgctgacctcctcctcgctgcctccccccatttaccgtcagctcagactgaaagggagaggctggcaaaatcaaatgacaggtcaaggggagttatgaaacacgagagagaggtgctggaaaaaatgagaattctcccacagagaagggagatgcctctgggaaaactaaaaatagtcagctgaaaacaaatcaccagggacagagatgagccacgtggaaaataagaaacacgaggggtcacgtgcacatgaagcagaaacaaaaatctatttacatcctcatcaaacattcctgtgacacctaacgctattcagcccaaaacaaatataaaaacaccccagctaacatattttacagaataaaactgatttaatttactgtagctgtaaaatcatctaggacaaaagtagcaacataggccaacccaatgccctaaaagtgagcagacaggtcaccacgtgcctaaaatatatactaaatttattttcatcttaggcaccgaaaataataagcagatacaaacataaacctcaggggaagtattttgagactgcacacacttttattatgaagattggaaaactagatttgtgattcacttactacttccccataaccattaggatgttttctgtcagaagtgtttagtatacagaaatcttttagcatattaaaattaactgtcaaatctgactgagaaactatccaatgaaaaacgatgggaaccttctcatctacacaggcgaacaggaaatattcttctaaatttacctgtgtcctatttcccaaacactggaactaaaatataatttaacaggtgctgattttcacacatttggctggtgatggagaaaagagctagggaacaccaaggcaacaattctgccttccatcaacacaaacaacacaatctgctgccaaaagtaaaagtactatgcacttgtgctgaagcaacagaaaacaatttttaaattaagcctcatctctcattagagagagcttttttcctccaattatctgtctccttggaaaaacctctgataaacatctgcaaattaatgaagacatcccccgtgcaacactaaacagagatctatgcgagacagacctgtgtggaaaacaacagtgcttctcctaaaccctgaaggaagtcgaaggtttcgaagcaatcctttggccgtcagtcgtatgtgaatggtggataaggagaatttgggagacaacaacatgtcttcggagcaggtggcgagatttcacagaagaggcaatttccatggactgtcacatactgtctttttaaactcagtactcttcaaggccaagaaatacagtcagaggaaagatgcctacacagcaaatgtcattccaccagagaggcatagaagaaaaaaatcccccagggctggccaagtgtttctggcttccgttttcactttcagatgttgccaaaatgatgctcttcctctgaatacaatctccctcctgcaggtctagaagctgcctctgaaccacatcacactgtgcatgcttgtggagttgttatggttttcatccgagatggtaaaggggaggagaaagtgggtggtctcaggagctttacagaacaaccaataatgtcacagatcctgtaaccacttgaaagatcgctaggggaaattaactacttcaagtgcctaatgtttctttcataattagaaaaaaattaggatttcctgaaagtaaactgtgtcctgattttaacatttttcactccttatattcacaatgataacatgagcattttttctctagatattttacatgtaaactacatttaaacctggtattttggaaaagttttttttttaaagacttcaggcaataaatgttctcaactacaatatttaagaaaatttctattctaatatattaatgacagattgtcaaaaggttaaagttcaactttaattcccacatgctgaggacctcacaaataatcaacagtaaaagattaatacggtttctctatcagatgtaatatcagagttccagaagaatagtccatcagataggcatattctaaagactacatttattgcatgagtaattgcatttatagaacatcatgtggtctcttatagtggtctttcaagactaggagtgtgaggagggcacagttatgaatatcttttgccagttatctactaatttttatttcagtagagtggcttgtaaaagtatgttaaaacatgatagcaaaaccaaaagaacttgaaaaacaaagatatggttataagaattaacaacaacaatatgcccacttaagctaattccattaaaccacgaatagcctgagctcttaacatttttaaaaatgttataaacaaaacaatgttttaaaaatgtcctatgcctgtttccaagatttcctagaaaataagactcagaaataaatgcagaattgttaccataaataacactattaagtgctattaaaactagcaggaagcagttcttttagaaattctatagagtagggtatgaagcagggaagagagagggaggaagagaaaatttaaataagttctcttccctcaagccccctccctcttcactcaagcccccaacttgccattttagaggttgtcagcaagagagacagacccaataacctgtccagggttcctgtgagaaagatacacctagttcatacactgacgaaaaacctgctacatacattgcaccacagcaactgaagctaaatgatcaaggaattaaaatcaaggccagctgcttctaggtgttgccttttacttcatcccagtttattattaaaaaacctgaacaccttttccttccagattctacatactaaaaatataccagaaccttttcctctacctcccaaaaccttgtaaaaaccaagaaaccaatcagcattaaaaacaaacagaagaacagagtcaaattttgccatgattaaaaacagacatgccaccactccatatagtaggaggtggtttttctttcttttggttgtgtttgttgtttcttcagtaacagcaaattctaaattatccttttttgtttgtttttgtttgttttttgagatggagtttcactcttgttgcccaggctggagtgtaatggcgcagtctctgctcactgcaatctctgcctcccgggttcaagtgattctcctgcctcagcctccgtagatgggattacaggtgcccgccaccatgcctggctaatttttgtatttttagtagagatgagttttcaccatgttggccaggctcgtctcgaactcctgacctcaggtgatccacacacctcggcctcccaagtgctgggattacaggggtgagccaccacgcccagccttaaattatccttgttaaaagggaagttctttagactccctaaaagaagaaattaccatctaatcatcgattaatcagattcattaacatttttacttgaattacattaagctataaccacacatattgaaaataaacattgttaatgatatctcttaacagcagagcaagaagctgcaggaataaactaaattcagttctttcccaaacatagtctgcctcctggtggccgtgcagcacaagtgcaccaaagcaagggagctgccttggcagtccataaacaaatggccatcgcttacaatctactgctccaagcactctcttacacactttacgtttgctcatttaaataactggataagcaattactttcaggtcacaactatttttatactatatatgcctctggggggagccaagataaaaaattggttccaaaaaattctttgattatttgatcatctgttaccagttaggaactccatattttctgaaattgaacgaatgtgagaagtacctaaaaaaagcatctttgttatttttaaaagtcttaatttaagaggaaaagataggcatcaccaaggacagtagaggaaaaaataaggaaattttagtgcctaaagtacaacagtttgtagttgtaaaagttagctatgagtctttatgggccgggcgcggtggtgagattacatgcctgtaatctcagcactttgggaggccaaggcaggtgggatcacctgaggtcagaagttcaagaccagcctggccaacatggtgaaaccccgtctctactaaaaacacaaaaaattagctgggcatggtgacaggggcctgtaatcccagctactcaggaagctgaggcaggagaaccgcttgaatctgggagatggaggttgcaatcagcagagattgtgccattgcactccagcctgggcaataagagcaaaactcctcaaaaaaaaaaaaaagatgagtctttatgaagcagagcctgtgttaggatgtcagtggaaaacaaaaacatgatttaaaattttatgcaatgtaggatctcaacattaaacaaaaacgattaagtatattggagcaaacatgccagaatgtcaccaatgctctgggaggtagaagagggaggatttctattttttctttattatatgtttttgtattttcctaattttttttttcaaaaatcatgcagccagaaaaaaattaaaaagtttaagtgttagaataattttatagaaagcctacaaaatgagccgagttttcataatgacacaaagaaaaataaacgatgtgtaaagtctatactaaggcttaaataacaaaagaggatgatacagaatgtttcataagtcagtatgttgtaatatcacagtatattcaaacaaacagaaattccactggtctgcatagaaatgtgtttttttaaatcagtgatttagaaaacaatgatgtcatgattctagacaagaatctagcataatctgtatggggtgcttagatgctacaaaatgccttcaatttatctgttattgtttgttgttgttaatgatcataaagaatgaggaagaagattaaaatttaaaccaagtgacttgtgtggagattcaagcatctctatccaaccaatcttccttagcctaatatggaatattaatctttatatttatctccttactttccctaacacagcattaattgcaacattttcttcattttactcctcacagtctttaatgtagtaagttcaattctctattccagttgtagaaacttcaacttaaggcccaatttttccacactatcctcttcctcagtacgaagataaattgtaattatcaaaaaattaacacaaagcaattagaaaaacaatcaacttccacccacctgtaagatgataagctctcaaagaacagtgacattgccttttattttgcaataagcaaaataagagtttaaattaaaagcagtaatgcttttaattcatgtacaatgtttgtttttaaaaaacaaaacctcatatgttcatcgtagaattttttttttgagacggaacctcggtctgtcgccaaggctggagtgcagtggcgtgatctcggctcactgcaagctccacctctcgggttcaagtgattctcctgcctcagcctcctgagtagctgggactacaggcgcccgccaccacgcctgactaattttttttgtatttttagtagagacagggtttcaccgtgttagccaggatggtctcaatctcctgaccttgtgatccacctgctttggcctcccaaagtgctgggattacaagcgtgagccaccgcacccggccagaattttcttttcaatttaaattacttacacatcagactgctctccaatttgtttttaaacttaacataagcttaataaacttattaaacttaaaaatttcacacttatctttccatgggattaaataagcatttatattgttattttaatggcttcaaaaatgtctttaaaatgtcaacgaacttaattcctgtaaggtatataggttgtttccaattttcccccattgtaaacaattctgaaaagcagtcaataagtaaataaattactttcctaggaccaattctgaaaaacagaattcccgggtggaaggtgtttgctctctgctacagctgctgtaatttaccaaggagctgtacatatgagtgctgtttcttattcttcgccagtaccaggtgctaacattaagaaataagcaagaactgagagcacattattttaactcatatttggtaaacatttttcatatattccttagtccttcatatatttcttttctgtccatccacttatttttccctttctttttgtttagtttttttaattgtggcaagaacacttaatgagatctaccttctcaacaaaattttaaaagaacaatataatattgttaactgtaggcacaatgctgtaacaaacatctcgaaaaccttttcgcccttgcataacaaaccttgtaccattgaacatcaagttcccattccctggcaaccaccactctactctgtttctgactttgactatgttagatgcctcctataagtggaatcatacagtatttgccccatgactggtttatttcacttagcatagtgtcctccagctttatctgtatcacagcatatggcaggactttcttctttttaaaggctgcataatactccagtgcacatatatgccatatttgctttatcctatggacacatttaggttgttcccacatcctggctatcataatgtggcaatgaccattgttgcagggagtcagggaccccgaatggagggaccggctggagccacggcagaggaaacataaattgtgacgatttcatggacatttatcacttctctaaaaatactcttataatttcttacgcctgtcctactttaatctcttaatcctgttatctttgtaagctgaggatgtacgtcacctcaggaccctgtgatgattgcattaactgaacaatctgattgcaaaatgtttatttgaacaatatgaaatcagtgcaccttgaaaatgaacacaataacagtgattttagggaacaagggaagacaaccataaggtctgactgcctgcgcggtcgggcagaatacagccatatttttcttcttgcagagagcctataaatggacgtgcgagtaggagagatatcgttaaattcttttcctagcaaggaatataatattaagaccctaggaaaagaattgcattcctgggggtaggtctataaacggccgctctgggagtgtctgtcctatgcggtggagatagcttggccgggtgcggtggctcacgcctgtgatcgcagcactttgggaggctgtggcgggcagatcacgaggtcaggagatcgagaccatcctggttaacatggtgaaaccccgtctctactagaaatgtaaaaactttgcctagcgtggtggtgcgcacctgtagtcccagttagtagtcccaggcaggagaatggcgtgaacctgggaggcagagcttgcagtgagccgagatcgcgccactgcaccgcagcctgggtgacagagccagactctgtctcaaaaaaaaaaaaaaaaggactgagagagatacgccctggtctcctagtctcctgcagtaccctcaggcttactaggattgggaaacaccaaccctggtaaatttgaggtcagaccggttctctgctctcaaatcctgttttctgtaaagatatttatcaagacaatacgtgcactgctgaacatagacccttatcaggagtttctgattttgctctggtcctgtttcctcagaagcatgtaatctttgctctgcctttttccctttgaggcatgtgatctttgtgacgtactccctgttcatacaccctctccccttttcaaatccctaataaaatcttgctggtttcgcggcttaggtggacatcacggacctaccaatatgatgtcacccctggaggcccagctgtaaaattcctctctttgtactctttctctttatttctcagaccggccaacacttacaggaaacaaaaataacctacattgaaatattgggggcgacagaccatgggaatgcaagtatctcttcaacatcctgatttcaattattttggtaaataacgccttatcagacgtatggtttgcaaatgttttctcctatctcataggctgccttttcatgctattaaatgactgctttgctctgcagatttttaatctgatgtactccaacctgtctatttttgcttttgttacctgggcttttggtgtcataccaagaaaaatgacatgaagttttgccccatgttttgtttgaggtgttttatagtttcagatcttatatttaagtctttaatccatctcgagttgatttttgtgtactgtgtgagataagggtccaatttcattattttgcttgtggatgtccagttttcccagtactatctacaaaaagactatcctttccctattgtgtattcttggcacacttgctgaagattagctaaccgtatatgcacggatttatttctagactattttattccatcggtctatgtttctatatttgtgccagtaccatactcttttaattactgtgtgttgtaatatactttaaaatcaggaactgtgatgcctccagctttgttctttgtcaagattgttttggctatttgcagtcctctgtcattctatatgacttttgggattgttttttctatttctttaaaaaaatgacactgggattttgatagggattgcactgaatctgtagatctctttgggtggtatgtccatttagcttctattatagagttgtctttatcttgctgatttgacagagctctacacagagtatgtgctaatataacctcagtttgttctttgcttataaatactgtttctaatgatttttattctttttattttttttgagacggagtcttgctctgtcacccaggctggagtgcggtggtgcaatctcagctcactgcaacctctgcctcctgggttcaacgattcttctgcctcagcctcatgagtgctgggactacaagtgtgcacaaccacgtgcagctaatttttttgtatttttggtagagatggggtctcagtacgttgcccaagctggtcttgaactcctggcctcaagcaatccacctgtcttggccccccaaagtgttgggattacaggcgtgagccaccatgcacagcctgtttctaaggttttttaaagcttttgttgtcctaattattaatcgtttctattatactagtgttcctggaaagatcttttctacttaagtctatattcttagtgttttaattactttgtgtgtttaaaactaatttatctgaaatactttgtatatatgtgaaaaagatctagctcctgctaaaaaggtagtcactgtctcaagaagatttactaaatgatccactcctcacaacccccaacaccaatttgaaacaaaaatgtatcccatatgaaaagagcatctgtgttttaagtatagggggaaagttatgttaatcataaaacaacagtgaaaaaacagccttctctctactctcaccagaagaaaccctggcagcctcggcatcacctcatcagcaggtttgcaacttgcaaccacttcccagcacttggcaaaagaaggcaagaaagccgccctgttctcctgtgatgtctttactaagtaactgcggaaggaccagtgcattttctaccttccaaggcagacactctggcacctgagagtgatgatcttgtgtaaaccaatcagggtactggataaatacagctctgatgcctctggtatgccagtggctttagtgtatggtagaaccaaggtaataatagtattctgtggtatgtgtgacatcttccttatcagcagtaagccaagattttttttagagtcaatatcaactacaatcttgcagcgtcataacgtttaaataaattacaacagttagaccccaagaggttggttcttgactttaagcagtctttcctgcttgctttagagatttaaaataattcaacttcctggaaaagaaccctaaaaataagcccctagaattataaaaacaatgtaaaagatcgccatcattaccgttcctagcagctgacttaactattatttgagaaccttttataaaacaattctatgatgtcatattattgcctttctgggaattatttccccaatattcccatgtctccaaacgagaaatttgagacttggagaggcttagcaactagcccaaggtcaggacacaaatagaaagcagcaggacgaaggtttaaaccaacatcccgtgccttaaaagttcgttctcctcctgcttttctacattgtcttatgagataatgtaatttctttaattgataaaggtcaagctaaaacaatgatgtaacattttaaactattatgttagtcaaaaaaatttaaaaataatatccaatgttgacccaaggtatgatgaagccaggtgtcttttatgtcaaccacggtataaaatgatatgaagcttttggaaaacaatttggctatttgagtgaagtgactgtaaatgggtacatattgtgatttcctgatactacttttaataatctatcacaagaaattgaaagttgaaagtgctaattgtatagatgttcatcatagaatcatttatgaatgtgatacagaagcaccctaaatattcaaaagtagttaaatgttactgtatctgctaaatgtaaaagtgattactatatgttaaatgacaaagcaggatatacacttatctaaatttcatttaaaacgacaaattttaaaaagctgaagggtgatttctaaactacatgctaaactttttgaagtttggcaaactgctataattaaaagtgattattttactagaactaaggaatatgaagttggtcaactcaactgtaatctccaccactacttacagctttaaaataaaaatatctcaaagccatagtacaacgattaaaaatttacactcagaggaacatgtttatgtgtggaggcaatgtcttctgtatcagctaaaatatgactcatttccagcagaatatgaaaaaagtcaaggtgattttcagtcacagaatatcacagtagggagaaatctagaaatccaccctttcagttacatagaaaactattatcaaagaggttcaatgatccacccaaagtcactggcttttcagcatcatttttcagcatcaaagtcgtctttccaaagcaaacacactttgttgtggtcctctgtccacacagtaacttttcctcactaggctcctcataataccaggttagtcttaagtcatgataataactaaccatcgagaagaacctgggaaagtcatgcttatggtttcgggaaaatacagaggcctaccacacaatctagattaagctgcaatgttgaccccttagaatacattctatatatacagagtcatctatagattcaatgtaacagaaattattagaattggaattattagattacattcctaaaacctcacctgacttcattacagagattgacaagctgatcctaaaattcatacagaaaatcaagggacccagaatagccataactatcttgaaaaagaaagacgttgaatgactcacatcctgatttcaaaacttactaatcaagacagtgtagcactggcaaaggtaacatataaatgcaaagaacacaatttagaaatcagaaataaaccctcacattcttaaccaattatttttaacaaaggtgccaaggcatttaaatgggggaaatacatgtcttcaacacctggatgtccatgtgcaaaaaagaattagaccttctatctcataccatataaaaatgtaactcaaaatgaatcagaaacctaactataacagctagaatagcaaaaaaaacttaaatgaaaacacaggcttaaatcttcacaaccttggattaggcaactgtttctgagatacaataccaaaagcagaagcaacaaaagaaaaaaagttgataaagtggaccttgtcaaaatttaaaacgtttatgtttccaaggacattatcaagaaagtgaaaacacacccaagaattgggagaaaatatttgcaaatgataactctgacaagggtctaatatcagactatacaagaactcctacaattcaacaataaaaatgacccagtttaaaactggcaaatgatttgaatagacacttctccaaagaagatatacaaatggccagtaagcacacgaaatgacactcaatgtcactggctgtcagaatgcaaattgaaacaacaatgaggtatcacttcatacccagtagggatagctataataaaaaagacagacaaagccaagtgttgacaaggctgtggagaaacaggattcttcatacactcctggtgaggatataaagtggtccagccactttggaaaacagcctggaggtttcttaaactgttaaacacagagctaccaattgagccagttttctgataatggttaactaatttttaaacaaagccattccatagaatattagctatcttttttccccagatattaggatgtaccagaaacttaaaaggaaataaaagcctaaatgtgtacagcagagtttcttctgcatttttaccctataaaggctttagtaaccacatatattcacactcagcatcctggggatctttagaacttagatcattctgcatggctgtcttcctagctttaagagcctacaaaaggttacgaattctgagatagctgggcgcagtgactcacgcctgtaatcccagcactttcggaggccgaggcgggcggatcacgaggtcagaagatcgagaccatcctggctaacacggtgaaaccccatctctagtaaaaatacaaaaaattagccgggcatggtggcaggcgtctgtagtcccagctacgcgggaggctaaggcaggagaacggcgtgaaccagggaggcagagcttgcagtgagcagacatcgcgccactgcactccagcctgggcgacagagcaagactctgcctcaaaaaaaaaaaaagaaaaagaattctgagataatttccccacacttccctgcttattacactgaggaaactgaatacacctgatggggcatcaaggatatttgttattcatgttattcatgatgtaatgttatcccaccctgttttctttacacaacaggctcagaaatttatacctcttgcccaggtttccctcacatgacagccttcaatccggacctctcttctaggacaagacaaccctccttcctagaactcagtgcatttgtgattcatgtctatttgagcaggttttttattttatttttttaactatcctattagctctccagagacaaggcccctgctcattcttcgctcaggactgcatccttaacacctgacactcacaatgtgtgaacaaactgtagtcaacattctgtaacattacatgcatacctgggagatatatatcaccccataagacacatgacataataaggcaaatcacaaaaattgtctggtttctcagtgcatataaaacttatattaacactacactatagtctagtgtgcaacagcattatgtctaaaaaaatatataccttaatttgccaggcgtggtggctcacacctgtaatcccatcagtttgggaggccgaggcaggtggatcatgaagtcaggagatggagaccatctggctaacacggtgaaaccccgtctctactaaaaatacaaaaaattagccgggcatggtggcgagcacctgtagtcccagctactcgggaggctgaggcaggagaatggcgtgaacccgggaggcagagcttgcagcgagcagagatcatgccactgcactccagcctgggcgacagagcaagactctgtctcaaaaaaaaaaaacaccttaatttaaaaatatttcattgctaaaaaatgctaaagatcatctgagccttcagtgagcaggaattattttgctggtggaacatcttgcctcaatgttggtggctgctgactgactgattagggtagtggttgctgaaggtttgggtggctgtggcaatttaaagtaagacagcaatgaagtttgcgacatcaattgactctttcatgaaagatttctttgtagcacgtgatgctgtttcatagcattttacccacagcagagagtctttcaaaattggagtcaatcctctcaaaccctgccactgctttaagtttatggaatattcggactcctttgtcatttcaacagtgttcacatcatctttaccaggagtagattccatctcaagaagatactttatttgcttattcataagaagcaactcctcatctgctcaaattttaccagagatcaacagcaatgcagtcacaccttaggcttcacttctcattctagttctcatcctatttctaccacatctgcagtgacttcctccactgaagcactgaacccctcaaagtcatccatgacggttaggtcagcttcttccaaactcctattcacgttggtgctctgacctcctcccatgaatcacgaatgttcttaatggcatctagaagagcaaacccttttcagaaggttttcaactgactttgccccgttccatcagaggaatcagtatctagggcagctacagtcttacacaatgtacttcttaaatagtaagacctgaaagtcaaaattactccttgatccatgggctgcaaagtggctgctatgttagcaggtgtgaaaacatccatcttcctgtactatactcttgtactatatattactatgtaatacactatactatactccatcagagttcttgggtgaccaggtgcactgtcagtcggcagtagtattttgaaagacatctcttgagttgtaggtcttaacaatgggcttaatattcagcaaaccatactgtaaacaaatacgctgtcatccaggctttgttgtttcatttatagagcacaggcagagtagatttaacgtaattcttaagggccctagaattttcagaatggtaagtgaacgtcagcttcaacttaaaattaccagaagtattagcttctaataagacagcttgtcatctgaagccaggcactgacttctcctgtttacctgtgcaagtcctaaacagcatcttctttcaatatgaggctgtttcacctacactgaatgtctgttgttttgtgtagccacctttatcaaatgatcccagctagatcttctggatgactcgctgtagcttctacatcagcacttgctgcttcgccctgtactttcatgttatgaagagttaccttaaacctcatgaaccaacctctgctagcttccagcttttttttttctgcagctccctcacctctctcagccttcatacaattaaagagagttagggtctcactctggattaggctttggccgaagtgaaagttgcagctggcttaatcttctggtcagaccactcagactttctctctgccgggagtctgttttgctttcttatttgagtgttcactagaggagcacttttaattttcttcaagaacttttcctttccatttacaacttggctaactgcttggcacaagagacctggcttctgaattatcctggctttcaatgtgccctcctcattaaactcaatcatttctatcttttgatttaaagtgagagacatgcaacttttctttcacttgaatattcagaggtcattatagggctattaattggttactttcaatattattgtgtctcagggaataaggaagaccaagaaaagggagagagatggaagagggaccagtcagtggagcacttgaaatgcaaacgtatcagctgtgttcactgtcttagatgagcatggtccatggtgtcccaaaacaatcacaacagtaacatggaagatcactgatcgcagatcaccgtaaaagatataataataatgaaaaagcttgaaatagtgtgagaattaccaaaatgtaacacacagacatgaagtgagcaactgctgttggaaaaatgatgctggtagagttgcaaaaagcacagtatttgcaaggctccagaaaatgagcgatgcttgtaccttcgtttcttctgatttgctcttctaatctgccatggatttagaaggcacataactgttttatcactgtatataaaataagacaatgtaggcagtgtacaggagaccttatctatctagagagatcaatccatctatctttttttttttgagacagggtctcactgtgtcacccaggctggagtgcagtggtgtaatctacgctcaatgccacctctgcctcccaggttcaagcaattatcctgcctcagcctcctgagtggctgggactccaggagcgtaccaccacgtccggcaaacttttttgtatttttagtagagatggggtttcaccatgttggccaggctggtcttgaactcctgacctcaagtgatccacccaccttggcctcccaaagtgctgggattacaggtgtgagccactgggcccagcctatctgtcggtctgtctgtctgtccatccatccatccatccaaagtataggaatcgcagtgaagatattttgtgaaatcttttatgggttcttgagagacataaagttttggattctcagctgtggttcaaatagtggaggctgcaggctatcttgggaatgttaagtccagtgaaagtgtgaaaaaaaaaacataaaaatataggctgctgaactgggaaaaggtgctaaaaccaaatattgagaccacttaaaaattaaggaatatccaatttcaaaatagcattgatcttgggggaagtacattttccatttcatttagaccacattaacaaaatcattttttaaaagactataactatctattagtaatacaatgtcctttcatgcattagatggccagtcatgcttaccgtattttaatgctatgcgacccgtcataaaaagttaggtttacacctcaaattggaaattctacttataagcacaccagtaaaaaatcactgtaaatacttgtagtaacataactttacaaaaagattctttttatcgccatccataaagtggtcactcacctgcattaagagctgtaaataaattttttctcgaaggacctaagatataaaagaaacatgtaaaatacatatgttttatttgacatatcacataaaaacaaaccatgttgataagaattattttcaaaaacaatcaatcgctacatttcaggttcccggtgggaaatatcaccgagattcaaccaacttttgtcaagtgcattttaaatataaggtgatatttcacataacatcaaaatgtttaagtatgatatgaagtcaccacaaattaaataggaccagttttaaaaggaaaagccgcagtattttttcagtcaagaacagctgaagttcaagttttaacagtactgaattcacagactgtgcacatatgccattctgctgccgggagagcagaggccagacttcacgaaggacagtcactcccgtgtgctttccgaaactacccgtttctattcagctatgaagaaaaatagaagtttttcctccaaactgataaaatataaaatcaggaggggtaataggtacacagctgtaagtcactaaaagaaatctatgatgcttctacttaacatgaaatagttgtttctaggacataatcatctgcagataccagttagaacagctaccatgttctatctgaaattttacagagatgatgatctcttaaaatacgtggctgttatcaatggaaagcactgattcccacacaggtaaaactgttgcgacataacctatccattcaatagtgaggcattttagaattctgagtctcctgttctacaaagctgtccatggaatctcattctctgcaagttattttagtatcaaagttcaacagcgttaacttcattattgctgtgtggatcatggggctttatcatcatcaataaaaaaccacagttttccaacctgatgtcaactcagcaagaggtcatttggtgcctccgaaatttgattaactccctaggcaaatgacaacctgctgcacactgaagaattcaacccactcctaaaattcatgcctattttctcttcaattcagtacaaagaaaaggtattgacatacattaaccagcctcaaggtaccatattatcctttaaacacacacacagagagagagagagacatgttaaggaggatgctgtgacagagtaacacctctgagaaagttactaatagatattaacaatccaaagagtttcatgcaggttaacccagtaattcctccttctgggatatccacaagtaaccagaatctgaaacaatgaatcttgactcacatttgaagaggttcatctcagtattaataaaccccaataaaagtcagaagttgcccactataaactgaagtggacaaccatagaatagccatttaaagtgaagaagctctcctgatacactactaacttaataaaaagcaagatacagaagagtatattcattattacctcagttttgctggaataaaaacaaaacaacatatacatacagaggaaaaaagtcacaaggaaatgtgacagcaattgctggttgacagaattaaggaagactctttgtttctgtgttttccaaattctctaacataaatgtgggtctcattttataggtcaagtttctcactcacaattattcgctcaggctttagttaagcttcagttcactaagcacaaataatgctttttttttttttttttttttttttttttgagacagagtctcactctgtcacccaggcgggagtgcagtggcgcgatctcggctcactgcaacctctgcctcctgggttcaagcaattctcatgcctcagcctcatgagtagctgggactacaggtacacacgaccatgcccagctaatttttgtatttttagtagagatggggttttgccatgtcggccaggctggtctcaaactcctgacctcaagcaatccacctgtcttggcctcccaaagtgctgggattacaggcgtgagccaccgcatgtggcacaaagaaggcttctgatgtgctttggccccactgagacaaagctgcatgaaaacattgcacattaagtgtataccacatattttgtaaacctgaaaattacttttcataatcacagcaaataaaaagtgagggatatgagaaggaacagagataaagaacatttagaggaagaacaatgtcttagaccaaagacatgaagacacaagtacagtaataaacataaaacatctaccctgatgaaaagtaatcatgcatttctactcctttctcactattctagagcactgttttagaataatttaactcctgaagttttgctgtttctaccttatacctttgttctgcctgctgacttacacgtaatgatttttaactatagaacctaccaactgtcagaaaaacaatttcctcagtgcaaaaatgtattatatctcctttctcaacatatttgtaatcattgttgactataccataaacctaattgtcaaaatttaactttctacaagccaaggactttaagcgtcttgccctccctcttcaaaccacaatgaggactgtaccttttggaggagttttcatcaagtgaacatgagccctggataccaaaggcttcaaataaaaggatcctgaggaaccattctgaaatgctggttttggaggtttctcctcatatttgatgacagcggcattaccagctgtaataaaacagaaaagtacattttattgtatagataaacacagtttcgaccttccacatttattcctttgtccttgaaccaacaaatgctcaataagcacctacgacatgccagtcattactgaacattgggaatacaacatggataacaggtagcttgtgtctcagggatgcgaaataaaggctataatcagagtgaccacacatcctggttagcctggcacagtccaagcttatgcatcttgtccagttcagctttcatcccagataagagttggggaagaaataatacagccacttcatgctatgtaacaagaatgccccaggtgcagctaggaagagcacccatctccatggggacaaggaagaattcgcacagtcagctagttaatgacacaagaacagtaacatacagactccttggtagctataaggacacgctctggttcaaatccttgctcctacagcaaggagttaaaatgctaacttctgccctgaacaaaggaagtttgttccaaagtaaactttatgttttagctccaaagcaaaaacataaaagggaatcttacctcaataacaaaaaccatctttttatattatgtgtaaaaatttcccctccaccaatccagactggattttctactgtttgtttgtttgtttgtttgttttgagacggagtctcactctgtcgtccaggctggagtgcagtggcatgatctcggctcgctgcaagctccgcctcccgggttcacgccattctcctgcctcagcctcttgagtagctgggactacaggcgcccgcggccacacccggctcattttttctatttttagtggagacggggtttcactgtgttaggcaggatggtctcgatctcctgacctcgtgatctgcccgcctcagcctcccaaagtgctgggattacaggcgtgagccaccgcacctagcctgtttgtttccaaataatgatcaatatccaattctaggcacccaattctattctactattcaacgcttataaatttctttattaccaactatgatcccttttctcacttcactcacttagcaaagggttaagatacctaccttgtttacaaatgcattataaatgtgaagacagctagaaatttttcactaggctaacctattccaactgctacaatagtgcttatacacatcacattcaaactttgtacaggcgtgctattattttcccctaatccacacccaggccctgtacaatgagccatctgttcattgttctcgtgcccaaataacattcctaatattaggtcaaatcaacacagagctttccctcctgctgagaaaattctgtcaatttcctgtccttttttccaattctcaccttccctagaacctagagacttggcttttccaaagttgacaggaagctaatgggagtgacagtattaaagacaccgccattacaacattcaacagaaccctttttagatgttcatagaaaatggatattgggtttcaattagcattttagcttttgctgaatcaaatccaacaaagaaaattagacagtcttaaccatggaattataacaatctggattttagtcttacttttcttgaagccgtatttgattatattcagcaacaaataagtcacttattcatattttaaaaaattaaactgagttcaatttacagacctaatatgcaattgtatgattctaaattcatgcttttcttttctaaaatttagagacacaaaggcccacggttcacaaagagatcagtaaaaagattttcactaaagtaaaggacaggttcttcatgagggatggtactcctgtgtcccttgcctctctgtcacatgcaaaataggaggtggtgtgctggaaatcagctgtctcactgccacttttcagactcaatacaacactagatcaacccggcaccacacccatcatcagcttcataacacgcaacatgaagtcagaattcatactgcaaggataaaatgtctgcgtttgactcaggtacaaacacacatgcatttatattttatacatatttacatgaaagctatatatacaagatacatattcatatactctatgatcaacgattgtacctgctttctgctttactaatggcaggcacaacctgtactgagctgaacataattttatgactaacaatatctttctctcaatttctacttactgtactctaggctggcccactgctttccagtaaaccccaacttgaaggatgtataccaccatgagtcataatgctcttcaaatatttcccctgccctctatttctgttcctaacatggcaactgactgagtatcctgatgctatctaaattttccctcagccagagtcattatatccaaacaataaagtcctcagcggcaacaattccaatataagagatgcataatagtttccagcaatggaacaggatgtaaaatatcctagttctggtgctgacttgaccactgcctagctgtgctgaatcacctatctatgaataacaagggtctgaatatcgggtatgggaatagacagtgcattcgcccatatcgggtatgggaatagacagtgcatttgccttcacaactcactgtggtattcagtcccactgaggctggatgcatcctcagaatcatcctaaagacagtgttctagagagccatggacactaaacactgctggcttgaagagacaatacataaaatttttcatgtggccacctacttctcaacctgatctaatatgtagtttaaaactgcccctttgtcatctttggtcccaactgtctcaattatgccagaataacagattctctggaatctttatcttcatttccccatggccaaagtgtggttcaagtgaaataaaggagctggtgagtctaaaaggaaaaactaagggatattctcaggaaagcccaagcagaagacatgattttcctattagaaaagggcttctcatgctgggcacagtggctcacaactgtaatcacagaactttgggaagacaaggtgggcagatcacttgaggccaggagtttgagaccagcctggccaatatggcaaaaccctgtctctactgaaaatacaaatattagctggacgtggtggtaggcacctgtaatcccagctactcaggaggctgaggtgggagaactgcttgaacccaggaggcggaggttgcagtgagccgagatcgtgccactgcactccagcctgggcaacagagtgagactctgtctcaaaaaaaaagaaaagggcttctcattgtttcagacttttatctgcaaactaacattcatactacattctaacacctagtgaaaattcgcttttattacattatgtatatacacacagagccaacattctgttcatttcttgaattttatgtgaatcagtttaacactccccactgtgccagatcatctgcccacttggcttaaaatcaaagtactactgaaatctaaacttttgaatttcaaaagcaatatcactcaactatataataacaagaatgtctcacatataccctagaaaaacgtgaacagagaaagaacgagaacaaagttaacagtggtctggataatatttcctttttaaatagtccattcagaagtgcgtaagtactaacatgttttgtgatgtggagcctaatgaatctaccgcctgttcctcatcttagcctcacccatgacagacatcacgacttgaacacaaaactttccctctgaacctggaggcaccctgagaaaccactgacaccatcctacaggcgaattcttatccactaaccagtgttggccactaaccagtgttggcaggtgagacaatattcacttcccattcctgttgtgagagaagaaaaaaaacaaaaaacaaaaaactaagggtaaataagatccaccctattctttatcagcttaatcacttgaacaactcaaaacaccatcctgccaaacaatgaggccctgtcttattgcagtgaaaagggtcagaaatgtttgttgctgcaaggactttgaagatgacccagtcctcccttgtcattgatcagaggagagtatggaggctggaggctaagaaaagacaaagatagtccaacttaacatgagttagtaggaaaactacggtgggaccgggcgtggtggctcatgcctgtaatcccagcactctgggaggcagacgcaggcatatcacttgtggttaggagttcgagaccatcctggccaacatggtgaaaccccatctctactaaaaatacaaaaattagccgggcatgatggggcatgcctataatcccagctacttgggaggttcagacaggagaattgcttgaacccgggaggcagaggttgcagtgagctgagatcatgccactgcactccagcctgggcgacaagagcgaaactccatctaaaaaaaaaaaaaacaaaaaacaaaaaacaaactaaggtgggtccaaggttagtgcccttttctgcatgttacaccccactcagccagggctgtcagtgaaggtgaagggaaagaacactccatttcttttattcagtctccttctgttccttccatttccaggagaatgcaaatagctttggtctgcacctcttacatttcccctaccatctggctctcaaatataaacatggttttgtggccaaagtggaagaggaagtaatgtctttggaccttactttcctgctaacatcgcaaagttatacactctcccaagacccccttctaaattgcacaatagtccccaaatcttcaactctgttcatgacatacaatatatcatttatttttacccagttactttaatgatcttaaaaactggatattaggtatctgagtgtgaaagaccttataatctttaacctctataaatgagcacatttggtatagaaaccattgtgaaatgttttacactaatatccaaaaggatcaagatcgtaactttgaaattttctacacttaaaagaacacacacaaagaacctgctaaaattcccaaataagaacaatttattgccttacgtattttgatttggtcatttaaaaaatttagtaacattatttctataggatcccaaagttccgagaacccagtgctaattttacaacagcactgtgttatatcagaagttcttaaatgatgccactaaagatatcacatcacaaagaaacaagcagacaaagcgagaaaccaatatttgttaaagggattcaaatacttaagccagtataaatcagaacactgatcaaaagaggaagttaattcttaacatgaccacccattatcagaaacaggaaattttcagcgcgagatgattttttcatgttttgaggtagcctttaaaagtatacatgtttaatactttcagttacaacttaggaaaataaagatgtgatgtttccattttaattttagaaaagtatttttctacacttgcacaactaccagctacatacacacaaaaactagttatttcataagaaattaaaccatcaaaaagtctttgataataggataatttcatgtgccagaacattaacgatgctgctgaattatattaagagtgcaaaacacataaaagagacaacaaaattggtcctacacagaagcattcacatcttaaatatacatacaaaatgcccccaaatactaccattaccataaattacaagttacaaaaacagaagtcaagagatcctaaatcaatttattgaataaaaatttaagcatgcttacaaagaaaagaaaccagaaatcgtcgacctactttttttcccagtaaacgtggctaacaaaggaattatacaaaggctgtacgatcccacgaccagcagtgtcaataaggtagcatcatagtgcctctctgaaccagccggtggggtgagtgtagaattgataaagatttttgaagaaatatcagtttctgtacaactgcgaaatcctcctggtacagtcatttaaaaggatcaaagcaagcttaagcaggaaaaactgcagccatgttcactctcatatccctcatgcttgctcttagtgaattcgaatggagggaaaaaaaaaaaaatgcgtaagctccaaggcactacacaaaacagattaaaccagctagcaaatcaaactaagaaagagactcactgatttgaatgcttaatccgcaacaggaacacatcgccactagacaggctctgtgggtgtatggtaaacccctttgttaaaagacaaaaaggaatggacaaaagcactttacagcctccttaggagcatcagacacagtactgaaacggtggccaagtcaacatggatgtcgatggaaaacacggggctgtggcactacagactgtgtctgcttcaagtgccacaaattctgttgccacaacagtttttctagagcatgttggtgattctgttttggcagtttgtctttaaaattgctttgcaagacaaagagagcttaaaataatacacgtgtgaattaccttttcaaattcagagttccctcttacatgcaagcctgattttgtgccacaccttcaaaattccaacagtaaagctggtaacaatcctgtttaattgcaagtcacatatcccagtattcctgaagtgccagggtatgcagctacttactctcatatgagtccagctactgctgctaggtgacccgtcggaaatgtgctcattaattcggtcattaattcaatgccttctctacaaaaaatgcattctcaattccctcacatagctgctgtgtgattttagaccagtgacaacatctctgagcctcaatcaccttctatataaatatcagggtaacagcagaagttacctgagagaaaaaaataaaagcaaatatggacatcctaaagtactgctccacacccagaggagcctcatgagcattattacactttgtccccaactcctcacccaaaagaagaaactgatctgtcaaactgaagagatcagttcgccactcctctccacacccttgtgtctggttttattggtattctcatcatccatgaaaataccttctttttctcctcaactattttttagaataagggccatttcttttatatcctgtgctcctcactgcgcctatcatggtgtctgtgcacagcgggcactccaagatggtttaaatttatgaattatttcgtggggaagtataaaaaaggaaatgagaaaataagaaccaagtccaaatacatctttggaatgaaagaggtatctcagtaaattcactcatttatacacagaaaatagaactcacgttaactgaaaactttaacaaaattctcctgagtttcaattttttagaattaggattcaagttatattagtcctattacacaaaatctagcatccaaagattccacaggagatagtcttttgcaaagtaaatgaaactgaaataatctttttttctgattccagttagagtccaaatcccctgggttgctactcttaaacctccaaaacaccatcacttcagacgatgcactttcgaatccttcatgcaaaaatatactttaacacataattatttcaagagtgtttttcaaagaattttttttctgccaaactttcagagcaactccaaggaagcagtatgcctatttttcctgaaaccccagaaacaaaaattctaattatttgcagagcattagtttttcttgtaatgactgtttccacaacccccgaagtgtgatataaagtcgacttacaattgttgctgtaagtgctcagctcactgtgggtgctggctattgagggggtgcttcctgtcctccgcagcgcaggacttttcaaagatgctttggatttaggaagtggtctaggcaaattcacccatgacgactgtgcagttttcaaggatgtaggctttccttggggtttaaaaaaaacaaaaagtttccagtgctattcatcccgaaagctggcactttttaagcctgtaaactcaaacttctgcactaacaacaaagtcaaaacacaaaatgaatgttcacaatcatgtaacttcagatgaaagatgaaagcttcacgcagacatgtttatttttgatcatttagaggcaagagagcagaaatgatgaggcaattaggatatgagaagtgtaggagtaaccctgtctcctaaagtaattaactcacacatgttctctgaaggagatgatcaatcagaataatcatgagaaagcagcttttggcaaaactgaaataaaaaaataaacaaattgatacgaccccccatactggtgactaaaaaaaaaataatccattaggacaataggctatcatataagaaataaataagaaccaagtccaaatacatctttggaatgaaagagagatctcaggaaattcactcatttatacacagaaaacagaactcacgttaactgaaaactttaacaaaattctcctgagtggaaaattttaaaatcacccaaacaggaagaaaaatgcaatttgataagcaaaaatttcatttgaaaaatgcctaatgttctaacaccaggtggtgctatactattaagatttttttttttaatctcaccttttcttctttactccccacacagtttatttgccaaacttaaatgatcttcactccaacttgcaactctttcttgcagtaaaaatgtttccacttatcagtgaaataaatatacaggctgcgtatcctctggcatctctgaaactacattctcctgatgctcacgaacctgctacctaaatatgggcatttcccaagcccagtctttcgctcttaaccctcctcatgcccattctcttggagagtctattttctctactttcctctaaccattgtcctatgcggatgaatcccatgttctcacctgcagccctatcttccttctgaatctcaaggctactcatgttttaaagtacttattgagtactctaggttttcatcttagaccgacatgctcctgtttatgctaattatagctccactgttttatttttttaaaaatcttgctttgttgcccaggctggtctcaaacttctggccttaagcagtcctcccgcctcagtctcccaaactgctggaattacaggtgtaaaccaccccacccagccatatagccctattttttatttttttccagcttcaaaccattggaatcatcttttcttccccagatccccatatattctagcactgtctcccaatgctaccagtaccacctaactgaagactacccagagttgaaaaagacctttgatgaaaatgacattgttgcgtatcactaaggatcccataagtgagtcaaataatgctgctggaaagtaatgcccattgctttgttctagcgattttgctcataaaaacctcatcctaatggagaaaaagatgctgaagctcctcaggcctggcatttgaaattaccacattaagctcccctccttcggctccagcctcactcttgtatggctctcctacatccatgtgtgctctgctccgattaacctcgctttctctctgacaccagggcacatcatgtgctattctattaatattccaacaggcacatcatttcttttcaaagagctcttcttccaccctttgaatccttatttaaccctttatatcattgtctaaactgtattggactcctaaaatcctgtccttccatcccttccaactccatcatgttaatctcctaaatgtgaaaattaaggtcatgacccaatctaaaatttgggattctccaccatctacagcatgcggcccagcacagctttgaacgctaacccaatacaaattcataaattttcttagaacattatgagatttttttgcaatttcttttattagctcatcagctatcatcagcatattttatgtgtggcccaagacaattcttcttcttccaatgtggcccagggaagccaaaagattgcacaccccaatctataggatggtgatcgtagtttcaatccttttatttaatatttaatttcacaggcttaaaaggcaatgtggggttgatccctacccacttcttccccctcaggccatgcctctaccccttcatacacacacaccccttcgtggtttctctccagtcatttcgctctattcttctgcttacgcccatccttccgactgaacggcctcctttctatcccctcccctatttctgtccagtgaatccaaagtcagctcaagcttctcttctgaacccttgctactcatttgcagctccaccctaggcctactgaatcaccacctgcagtttcacaagatccccaggtgattaaaatgcacctggagtttctgaagcactgttgagaatcaggacctctctgtgagcttatcctgccaggacacccttctctgaatgccgtggactaagccttgctttctcctcacaccatgtacttgtttctatcacagcatttgcctccacattcttcttggaccatctctaaggttcctgagatcaggaagagcacctgattcaattctggtcctcaggaactggcaaaggtctagcatggagtgagacttaataaatgtttcctcaacaaattcatttttttaaatgccaacagtaaatgatgtattttgataatgtgttctcccatcatctatactgaagcattcagtgcttaacccatttttacaagcttatttgaatcttcagtctattagagacttttttctttacatcctttacaataattagcaactgttagatagcaaatacacactttaaaaatttatggttagccaccagttttacttgctttaggaagaacaggaaaacagatttttagaatataaatttgccaaattgccgccccttcagcagaaacactgatgagtcatcatcaaaactaataagcaaggttgggcacgtaacagatcaaaatgactgggccacagccacagtgcagccaaggcttcctacattttggaaatcagcttattcttcagaaatgcatgcctcatagctttgtttctaaacacaacttaggtttgcagacatttctgagtgtgcctgggaattactacagaagacctgtaccttcacacagctgcactagaggaaagcttaccccggcaaccaaatatcatttccctgacctcccctatctcattgtcacccccatccaggcccatcccctacacctaatggcagccagtcctcaccaaagtcttcccaattccaccatggctcttgactaatgagcaatgaggataatgaatgccgatttcaccaaaagattagtttctttgatagaataatcctaacagtgtgtgactattactatcccagttaatagatgagaagactacttaggtggttaaatggcttacttgggtcacatacccggccagtgacagtaaggcctagaatccaagtgtctaaccacctgcccagtgttccctcggccatgccacagaatagaaacatctcagttaaagaaaagtatgaggcttggaggcagacagagttcagaatggagctcttactggacaggagctcctacagcggaatggtgaaaaccgtacggatgcaacaaagacatataactatttcaccaacagtcccgacgtttagcttaacggtaaagttggcaatactaaaacatagcaatattaggttaattgagagactgcaagtaacacaggcgctaaattcttaaacagtgaaatcaatacaggacttctctgagttacagttccgaaaaggtgacatttaccaggtcatatcgtattgtgtaacttatcccagatgagaaagataaagatttaagatctacttgcaggatattattgacctcagtggtttattttaagctcgtgcacttagcatagacttacgtatagacaacagattggtttttattctgtaattataaccatcttttatgtagggaaaatctggaaggaataacacctccactttgccttagatagtaacacagtctattggatttgaagcaaaccttcactaatcaaccaatttactaaaatactcacctcagaaaacctgagtaagtatactatatttaacaacaataaaaatcagtaaaagacgcctagcaaaactaaaatttcaatggaaagattaagtgaacaacaggatagtgttaatattaatattatcctattctgtaaaacaaaatggtagaatggcgcttgccaggggctggtggggaagggaaatggggagttgttcaatgggtagaaagttccagttatgcaagatgaatacgtcctacagatgtgctgcacaacttgtgttgtaggaagctgggattacacccacacaacaccacacccggctaatttttttgtatttttagtagagatggggtttcatcaggctggtctcaaactcctgaccttaagtgagccacttgccgtggcctcccaaagtgctgggattacaggtgtgagccaccgtgcctggccaaaacagatcatcttaataaaaatctggacaatagattcacatgaaggtgtgtcttacacaagtatttatgtgcttacctagtaaggcaagtgcaagtaatcacaaagttcaaacatatacagagccagaaccacctgacatcctgccacagaattagacgttctcagtaaaaactgtaaactaaagaaaacatcatgtctcaccataaggtatgttgttctgtagtttatacagcttagtaggaacacaggtgggaagaagaaaataaggctggagaggcaggtagtttacagttgggtgagacatggcattgaatgccagactcataattttagaccttaaatgttagggatggatatggtgggaagatgtgggttgggggggtcggggagggtgaggcttttttagcatttacatcagaacttgattgtgtggtagcagtgtgcagaactgactgaagactgaaatcagggaaaaagataggaagctagtgtaccagcacctgccagggttagagaagtgagaattttaactaaaaaatgaaaagattattgaggtccatttgaaatatatcagtatggcacacaagtggcaaggccactaactactaagtaagaaagagaaaatgccaaactaacagacacagttaaaatacgagacatgagaatatgtattttttttccagttaattcagagaatatgtctgtagctataattatataacttgggttccttaaatacaactcaactacttagagacagttacctttagagtaattacctacagtaactaggaattattataaaatcaggggaaacttaaaagtgacaaacaagttaacaagttataagagaaataaattatacatactcaaaaccgtggctgcaggtccacttccaattaagcttaagggaccaaattctctcaccaacactaaatatacatgtttaagaacttagcttcaatggtagagtatcactgtataaatattaaataaacctgatgggcttcttaccaaataagtattatacaaaatccatatatttcctatgtgccaggaaaaaacagaaaaagaaatcccttactttggtaacaaaaaggaattgcacacatagacacacacatatgcactgtttctgtgaataaatttatcaaaaaagtgctattctattgtgaaaattataaaaatgagaaaaataaaagttctgaacaagtgtacacatgtgaattcttccatgaattgatatcttattaaatgctattgcaatctgaacctacatgtgattgcttttaaacgcaggaattgaatttttaaaacatgttaaagtaatctagaataattaagaatagccaaaaaaaaatttagaacagaaaaacattaagactacaattcaacaacgaaaataccaaaaaacccaatttaaaaactggacaaaggactcgaatagacatttctcctaagaagacaacaaatagcccagaggcacatgcaaagatgctcaacatcactagtcactagggaaatgcaaatcacaatcgcgcgagataccactttgtacctaatgggatgctatcatcaaaaaaaaaaaaaaaaaaagcaaaaacaaaaaattaacaagtgttggcaaggacacggagaaactggaacccttgtgcaaggctagcgggaatgtaacatggtgtagccactgtggaaatggtatggtggttcctccaaaaattaaacctgaagttaccatataatccaacaactgcatgtctaggtacagatccaaaagatgtgaaagcaggccgggggtggtggctcgtgcctgtaatcccagcactttgggaggccaaggcaggggatcaccggaggccaggccaggagtttgagaccagtctggcgaatatggtgaaaccccatctctactaaaaatacaaaaaacattatctgggcatggtggcgggcacctgtaattccagctacttgggagggtgaggtaggagaatcacttgagcctggaaggtggaggttacagtgagctgagatcatgccactatactctggcctgggcaagagagcaagactctgtctttaaaaaaaaaaaaaaaaaaaaagtgaaagacttgagcaggtatctgtacaaccatcttcacagcagcattattcacaatagccaaaatgtggaagcaaccctactgttcacaggcagatgaacgaataaacaaaaggtggtacagatataccacggaatactattctgccttaaaaaggaagttgacacatgctacaacatggatgaaccttgaggacacggtgctaagtgaaataagccagttataaataatgtatgattctctttcatgattactagaatagtcaaatgcatatagacagaacatagagtggtgagtgccaggggctgaaagagacggagaactgggggttagtaaaatggatacaggatttcaggggggaaaacaaagttctggagatggatatggaggatggctgcaaaaaatgtgaatgtacttaatgccacagagctgtacatttaaaaaattgttaaaatggcacattctgtgcaatatatattttgccacaatttaagttaaaaacaaggaacttgtgcaactagttggagtaagatattataaaataataaaagtcctactggaataaaaccatactgacagattaatacggtggtatatacatctcagagatataaaaattcaggataggataggataagggaggtatcttaaatcagcaaaaacatacttatttgtggtattaagatatttgaattgccaaattaaaatttgagaagcagaacggtacagtagttaatagttgacaatctcgaggtagatcgtctaggttcaaacccggcgccacctcacactgcctagtgagcaggttcctcaccgttctgcacttctgttttctcatatgtgagaatgggggtgataggagtactccttacctcataggttcttgtgagaattaaatgaatttataattttaaaatgcttagaacagcatctggcacaaagtaccatacaaatattagctgtcagcgctcgccatccaccaaaataaattaaattggattacaacgcaaagggcttaagatgaaaccataaaaaaaataattaaacataggtcagtcttcttgagtagggaccgtcttattatgcataaaaacacaggaaaagttaaaggaaacaatgtatttgacaacataaaagtgaaaaaaaattaagaaatcaccatatgcaaaataaaaagacataaaaacaacaggcaaaggaaatgaacagcagcagatcaaaaaaaaatcctatgcccccaaatataagtgagcgaaagctcttgatgaaacaatgaatacaaagagttgataacttttattattattcttttatttaacctcactgtgtctaacacctttcctggtgagccaactgtcattcctaatccccatcaccattgcttaaccccatagaagagtttaaaaagtcaaatacttgcttccaacctttcatgccagtaggggcaagagccagatctggtctgtacccatcagacataaggacaagagggcgaagggggagctgctgcatgggtgtccccatgaaaaacaaagagaggaggaggtccctgccctgagatgccgtcctttgcttccagcctttgaatgcagtcacaggaagtggtgggatgcacacggaactcctagcagccatattttaactgaaaagccaatgacaaagccacatgctgatgtgagatgagtggagaggcagaaagaggacatttatgaatcgtcaaacctggaacagcctgcctctagccctcccgaggaataaacacacacagcctctggtttatgtccactggttgggttttctgtcgcctgctgtaaattgtgttcttaactgcgccattctcctgccaacagtattggatgcaattggttcctcctttcttcttgaaaggctttccttacttggcttcagggatgcccctacgttcctggctgttccttcttgactctggagagtccagggagcaccccagagctatccttgacctgtgctctctacacttactgccgtggggctctcatccagtctggtggctttaaatatcctctatatggtgctgaatcctaaatttatatctgtagaccagatttctcccacgcacttcaaacttgcatatccagttttctactccacatggcctcttatcaatcatttctatgtaactgagtttcagatctccccttcccaacatctgtgtttccaccatccattcccatctcaggtaaaggctgcaccattcttccattgctcacaccaacatggtcatgttcatccgtgactcctccctttgctctcacccccaatccaatctaagcaaacctcactggctttaccttcaagcacatacctagaatctgagcgggcctcactgccacaacctggtccgagaaaacataacctcctgctgccatcacagcgacccccgcaagctgatctccctgttcctacttcacccatatccaatctactcccaacacaactctcagagtgatcccattaacatttaagtcactccagttcaaactccaagtcctaactatgattttcaagactatacatgatccacgctgggcacggtgcctcacgcccgtaatcccagcactttggaaggccgaggtgggtggatcacctgaggtcaggagcacaagaccagcctgaacaacatggtgaaaccctgtctctactaagaatacaaaaactagctgggcgtggtggcaggcacctacaatctcagctactcggtaggctgaggcaggagaatcgcttaaaccagggaggtggaggttgcagtgagccaagatcatgccattgcactccagcctgggcgacacagcaagactgtgcctcaaaaaaattaaaaaaaaaaaaacagcagacactgtctccattatatacataaacatatgtgcatgagaatatgcaaaaagaaaaggtaccaaatagtcataaatttttaagttaaaagctatttggtggtggtaagatgacaggtgtttattttctcacttttaatttaaaatgctatacctttaaaatagcctactgggaagagagtagtgtaaacttgataaactatccaatttgcctggttaaattcaagacacaagaggtaaagaataaaacagggccccgcatccctttcttgacattgacaagaggctctaggtcagcctcttctttgttgactgccagaaagccaatctgttgtgtcctaatcacctgttggccctcctctgtattttcacaccatcattactgactttgacctcaatctctacattctatattctgagccataactcctcttctcattctaccttctagtatctcagtcaagtcctgaaaaatagctcaatacatgtgcatcctccttacttctcagatctcagggggcaaaagttaaacagcacaaagcatcaacattaaaccaagcctggcccctacctatttaagagtgtaactctattacattatataatctcctatattacagaaagaaaaccattaagcgaactttggtatttgtaattacaccctcttccaaaatcctacagttctttttattaaattttagtattataagaacaaatgtgatgaaacaagaacttgtcacctcttctatttggcagttaataccaagaaggcaaaaactacatcttactcatcccacaatccctcagtgtctggtacatgacttacctagcatacacgctctatctgttaagtaaatacgttgcagaacacagaatatttcagtaacactctagatttatatgttgcaaatagtgattttactattccaccttcttgagttcatcaaggcaataggactctgtataactatcctcatttgcttaaattcaagggtaagctccccagacaaaggcagagcaacacaggtgagtcataacaaaaacacggcaagtcttaagactgcagtaatttgacaaaggagcaaaaagtcccacaaagggaagttctcacgatgactcgaactccacagaagcgcagcattctcggtgatgctgtcagtacctgcctctgcaagtatgttcacaagatgtctgtggcttcaggtggggattaaacaaaaataactgccttagtcacaggcctggaacatgtgtcccacaactacaggaacatttaaattcagaggggaataaaccaaagacttaaaggtgttgcttcattttcccagctaccatacaaaggagataaacaagggtcttcacatgttcaccagcaaatttatttaccatctgacacctatgctaataatgcctgataagaacaaaagaaggtgcacagtgagcctcctggctcattaggagtcaaggtttatgagcagagctccactgagcaatgaggtggtgagatcattgagacctcaaaacttcacaccaacttttttttttttcttttcttttcagagggtctcgctctgtcaccctggcaggagcacagtggtgcaatcatagctcactgtagactcaaatttgggctcaagagatcctcctgtctcaggctcccgagtagctagtagctgagaccacaggcgggagccactgggcctgtctcttatatctttatgtcagctcttttctgatggtttccttagtctctacatatttttactcttaaacctcaggcatgcacatacccctctgaggtgcttcccagtctgtagcctcctccaatttcacatgccccgaattaaactcactattctcctccggaaaacttcttgctactctattccacatttcacttcatggcccaccacctatccagcctctgaaggcggcggttggggagacacttaggactgttcacaccaacagaagtggccagacactctgtctcctaattattttaaacatgcattctactatccgttcccaaaaaatatgtagcactcgtgcaagtttgtgtctacattattagaactaatcagcctctacctccctcgaggcagaggctcatctgtcattgaccccgggacacgtctgctccaggcatgctgactctggccttgacgttccccaagcacatggtatcctttgacaaggccacatctgcaccctcagcaaccccagcagcctcctctgctggcaagctcctgcaggcgcattccaaacagttcaaatgtcaccgcctctcctccagttctccctcacaacaagttagtgttgctcctttactgtggatacacagtgcttcgcacaggtctccattcaaatcaagccaaggaatgtttttaaacacctgttgtgcaaccagtacactgtgctgggcactggaaaatatgaaaataactaagagctgaactctatccttatggatttcaccgtctagaaggagacagacatgtaaggaaataatgagcatacagcactataaatgcaaagcagcagagaggccaggacagctgaggtggaatctgaagagccaagagttttcattggaacgatttgcttagacacccccttatcccctcaccctccaaccagtaagctccttaagagggcatatttgcttaatcctgtttgtagtctcagaatctagtacactgcccaacacagagcagcgactctaagcacttcttgaatgaatgggcaagcctgcactgtgacatattaagcctactcatgagtcattccacaaagcaatcttctccataattactgccaagtaagaattgtgtgaaacgcctggaaaagatcaagcatttacaagtgatgatgtccgtgaggatgaaaagaggacatgtgcctcgcaggcacctgcatggccctgcttggttggtcctgacctcctccgcccatccatgtcctccagcccccaccacacacagtgcgtggttcactgttcctcacgcaccctacaccctgcctcacctcggggtctctgcacggctggtccctgtgcctggaaagtcctcccgcctgacacccaaatgcctccctcctcccttcctttcaggtgtttgcccaaatgtcgccctctcagtgaggcctttcttgaccaaccgtttaaaaatctaatctccttcactgctttatttttattttattttattttttgcttgttttttttgagatggggtcttgctctctcacccaggctggagtgcagtggtgcgacctcagctagctgcaacctccacctcccaggttcaagagattctcctgcctcagcctcccaagtagctgagaccacaggcaccggccaccaaacccagctaatttttgtatgtttagtagagatggggtttcaccatcttggccaggctggtctcgaacttctgacctcaagtgatccatctgccttggccacccaaagtgctgggattataggcgtgagccaccatgtttggctctttctcttttatttttggattcatcatcatgaatccaaaaatgtatttattttcttaatccccttattagaatttaagctccctaatggaaggaacgggtctcttctgtgcacttcattccagcacttagaagagttcttagcacaaaccagccttccccacattctccttcacacatatgtggtttaatgaagaattcacatatgtccatgaaagaagacaggagtgtgtcaagacttctgcatgcacgtaaaggaccagggttaagagcacagactgtggggccagaacacccggcccatttcccgtctccaccaattaccccactgtgtaactttggacacgttactgaagctttcagaccctcaaattcctcatctgtagaatggcgattatcacagtatccctactaggagttgtgggaattaaatgagattatgcatttaaaagagggcttagcactgtgcttggcgcacacaggcactcaaaacatgttagtgactaatactatttttatgaaaagagatcctgatacacactttaaggaaactaatttaattacataaaaatatagaaacatctattagcgacacattaaaattaaattttattcacatttcagagacagggtcttgccctgtcacctagcctgaagtgcagtggtacaattatagctcactgaaccctcaaccacttgggttcagtgatcctcccacctcagcctcctgagtagcaaggaccacaagtgtgtgccacttgcccagctaattttttaatgttttgtaaagacagggtctcactctgttgcccaggtgggtctcaatctcttgggctcaagtaatcctcccacttcatcctccctaattcctgggatcacagatgtgagccaccatgtccggcctcaacttggcttttagaataacttattgggtaataacctctgatttttagtaattactttattcaagtatgtgaaaaatctctcataattttgcttactgtctccctcaaattctcacctagaaaagtttaaaaggatataaaagtaatttgaagaagatttgaaattaccttaacacgaaatgaatgaaaaaataatcagtttacataaaccacgaaggaaataacttagcaagaaagaagagaaacctgcgatgacaggcaagtcactgcaagtttcggacggactactgtcttgaaaggaatttactttattaacccacaataaactcaactgaaataaagagttgcccttttgaaatgtggtttctctttctctagaagaaaaccaaaaaccatctctttcaggaggcctttcttcaccgacccacccctggacattcttctcatggggccttttccccacccatcaccattctttgtgccgctttgtgtttgctgcataaacacgcactctccctcctcagctcacaggagtcacggggcagggagagcattctgcgctacttctgtaatcctacctggctcaggctggcctctgaaatggcaactcatgtgtgtagagaagaacacagatatttatcatctaaaacctgggaaaagctggtattgcctccaaaagagagtgaaggcgggtctctctaaagatgtctgaattgatcatgaaggatttactcagcagttatttattcagcagcattaattttattattactgtattttttattgttttaagttccggggtacatgtgcaggctgtgcaggtttgttacataggtaaacatgggccatggtggttgacttcacctaccaaaccatcacctaggtattaagcccggcatgcattagctatttttcctgaagcagcattaattttcaatagccacataaaatcattcacatcagagttaacatcaagctttaaaccaaggcctgaaaagaaaagtgccacagtttctaaaccattcagctgggcaacaagaattttaatttttaaaaaaattaaacgttagcctggtgtggtggttcatgcctgtcatctcggtactgtgggaggcctaggtgggaggatcacttaagcccaggagttcaagaccagcctgggcaacaaagtgagacccccccatctctacaaaaatatataaaaatcagctgggcatgctgacacacatctgtgataccaggtacatgggacgctgagacaggaggatttcttgagtccaggaattcaaggctgcagtgatctatggtggagtcagtgcactccggcctggacgacagagtgaaaatgtctcaaaaaaacaaacaaacagaaaacaaacaaacaaaaaaacaaattagactttattattaaaaataaaactcaggccaggcgcggtggctcactcctgtaatcccagcactttgggaggccgaggcgggtggatcacctgaggtcgggagttggagaccagcctgaccaacatggagaaaccctatctctattaaaaatgcaaaattagccaggtgtggtggttcatgcctgtaatcccagctactcgggaggctgaggcaggagaattgcttgaaccagggaaggggaggttgtggtgagccacgattgcgtcaattgcactccagcctgggcaacaagagtgaaactccatctcataaataaataaataaataaattaataaatcaaacaaacaaaactcatggccatactaatagtattgagattaataatgtgttggttaacagcatcactggctggtctgaatcccacctctgccactttccagctgtttaacattggacaaattatttaacttttctgtggaagattccttgtctataaaatagggataagcctcaaagttactgtgaggattaaatgaatttatagatgaaattactaaaactgagcctggaacccgacatatacttaacagtgtgagctgctatcattgacattataataattactactacaaataattttcatcactatctcatcttatttcagtatatttccaaagaagcaaaggtagtttagatttggtttgttataatctcttataatctggtctcatataatatatttccacattttgacaagtaaaatggaacagctctttgggaggccaaggtgggtggatcacctgaggtcagaagttcgagaccggcctggccaacatggtgaaaccctgtctctactaaaaatacaaaaaattagttgggcgtggtggtgggtgcctgtaaatcccagctactcaggaggctgaggcagcagaatcgcttgaacccaggaggcggaggttgcagtgatccgagattgcaccattgcactccagcctgatcaacagagcgagactccgtctcaaaaaaaaaaaaggaaaagaaaaaggaaaaagaacagctgtgttgggtttaattacaattccttctcacattcattttaaagcttcaagaaaatggctgtttcaatactgggtctggttttctacttaagtgttctgaaaggatttattgaaaacgccaaattggctggaacatttctgccgcttacctttcagcagagtaactgtgagtcagtatggtggatatccatttggtttcaatttgctaatacacacagacacttcattgtacaatcaatggcaacaggatcacggggatctaaaagcacattgtttctgctccttgatttttctgttctacttttaactctgtggcgattaagaaacacctctcaatttactgagagcatccaaaaaaattagttgctattaatttttctgtaaaacataatacagtagaatcaaattagtcttcttagtcggctcaggctgccataatagtaataataccagatggggtggcttaaacaacagaaatttgttttctcacagttctgaaggctggaatgtccaagatagaggtgccagctgatctgcttcccagcaagggccctcttcctggcatccagatggccacattctcattctacctcacatactgaggacagttccagtgtctcttcctcttttcttttttgaaagagagtttcgctcttgctacccaggctggggtgcaatggtgctatctcggctcactgcaacctccgcctcctgggatcaaggaattctcctgcctcaccctccccaatagctgggattacagtcacctgccaccacccttggctaattttttttttgtatttttagtagagaaggggtttccccacattcccacattggccaggctggtctcaaactcctgacctcaggtgatccacctgcctcagcctcccaaagtgctgggattacaagcgtgagccaccatgccaagcccatctcttcatctttttctaagggcaccacccctactggattaggatcccactcttatgaccccgtttaaccttcatcacctcctcaccagccctgtctccaaacacaatcacattgcaggttggggcttcaacatattaatgtagagggacccaagtattcagaccataaaagtcttctaaccagtcaaatacaaaactcaaattcaaatccagaatgtttccagttacattaactttgtttccattcagatacagaaaaccacccagtaaaacgtaattagtttttaactcagactgaaaaatctggatgcataactcagttatcaagctcatcgacacaggatgataaaagctcaaaagcatgccctgtcttttcactaagactaaacagatccacttttctctaagacacattatgcaacacagagtaaaaggacttaacaactacttccccgctgggtgggactgatcgcctacataaaaggattctatctttttcaatgtatcctgggtactggcctcatttcttaaaagtatgtgcgcttagattttctgggattcaagccccacgaaattcagagaatcataccagtaacagcagttactcagaaaattaggtgagctccaaattgtccctagaaaggtaagggctgtaaaagctgacagggtcttagattctcagacacttacactttcaagatgtgaagatgaagcccagggagagtaaaagacttgctcaggcagcgtattggggccagagtggaactaaaacacagggctcctaactgcaggccaggggccacactccagtgccaccaagctacaggtgttcctcacagaggaggaagggagcttcccattctctgcaagcaccatgagccttattggacaactacagtaaggaccagagctttttcttcaccaccaagggacagggttttgctctgctgcccaggttggagtacagtggcatgatcatagctcactgcagctttgaacttctgggctcaagtgatcttcctgcctcagcctcctgaatagctgaggagcccctacaagggcacaccatcatgctctcatgcccagctgttttttttttttgttgttgttgttttttttttttttttttttagagatagtgtcttgctatgttgcccaggctggtcctgaactcctggcccactttggcttcctaaagcactgggatttcaggcataaaccaccacacccagccaggactagagctttcatctcactcatgccttgactccccaggtgtggcaatatcccaaataagaatcactctttctcccaatggcttttggcctctgtttttctcccagatgatgaacactccaagctaatgaattcctgtttccacccagatcctctggggatggagccatgtgctgcaaacccctcttcctccactcacgcctctgtggtcatgtctccttgaccttgacactaggcctgaatctaaataaacagcccgtaaaacatttctaagcattacaggctttcacacttgaggcttcatggtagggttgaaaaatgaaacctacaaatactaaattgtagagaggtacagagatcttctgggatttgctcgctttcattagtttccataaaacattctcacgtgtgtggacacataactatttgtataagggaacttactactaaattgatttgacatgactttaatttgcccaaggctgtaccggcagaagtaaggtgggttctttgcaagatgttctcagtcaattggaatggctagcaggcttttcatccccgtgacacagggatgacttttccatttctttgtaacacagatctgtacgtccgccaaatttagtatgatacttaatagctattcttgaggcgctcacatttcattggcctaacatgactttaaaattacaaattgtaagatacaagccaacataaataaaagttcacattagaaaaatttaactttttagtcaccctcatatccctcctaaatctatcatacatctttcagtaaaattaaaaaaaaaattaatctcttcacatgtattgagggcacactagggacctaccgtacaacacttcagcattgttaagcacttaaccatttgaaaaaacttaatgaaatgattcaaatttacatcagccacccaattgtatatttatgtacacatccttctgaatagcttataagatggtttatacacctatacctctctcctcaactagcctttgccttgctcaaagataagggatatatgttgtcatcttctttttctacctcctgtgctcaggatgctgatccacaaaaggctaactgctttagtgacagaaggcattagacctataatcatgactgtccaattttacattcaattaactcataaactattgaactattttattcttaccagaactggacacacgcctgatcctctgaggagatacggctcgatcagcactgggatttctattgtcactgttccgcctcaaacaggaaacagggggccccactttggcttttggagcagctatttgcctcaaaccgcaggagtcaggcttggatatattcctacctgaggtggtcgttgtttttgaagcagagccctgtgaaaataacagttaagactgtaaaccaaaactaaaattctaagccccccaactgactgaatgggcccctcctctaggccaaggcaattccaaagaaacctaaaaaacaagttcaggccatgatggcaaagaggtcagacatgcctcattatactctcctccctttagaattcaggcacaactgaccagaattaacattaaaacagaaaccttaagtcagacaaaacagactctttatagcaaaaagacactaaattccaacctgactctagtttagcatcacatgacagacagcaagccctgaaggaaattgaagtattttaccccaaaatatttttctttaacacattttgaaatggccctgcaaagctgtctcttgtaggggcaaatttacattctgtagagaatcttcttcccttcccagatctttggtcccaaagaaattagctgagagtctagcaccttttaaaagtctaaataggtaatatttgccatctattacctctaaaggcggccacgtatgagatttcatctacataataagaaccttggtctccacagccccttatcttatcttaaccgagacactcctttctattgatttcaggtctttagataataacttctttagttttttgacacggagtctcctctatcgcccaggctggagtgtagtggcatgatcccagctcagtgcaacctctgcctcccgggttcaagtgattctcctgcctcagcctcctgagtagctgggattacgggtgcacaccaccatcaatctttttacttttagtagagatggctaatttttatatttttgtagctaagttttgtattttttttttggcattttatttttagtggagatggggtttcaccatgttttcttttttttttttttttttttgattttttgtatttttagtagagatgaggtttcgccatgttggtcaggctggtctcaaactccacacttcgtgatctgccgcctcggcctcccaaagggctgggattacaggcgtgagccaataacttaattctttcaacgaactgccaagcagtaaatctttgaatccacctatgatctgtaagtccctacttcaagatgtctcatcttcccagaccaaactaacgtgtatctcaaatgtattgactgatgtcctctgtctccctaaaatggatgaaatcaagctgtaacccaaacacctaggcacatgttctgaggacctcttgaggatgtgtcatcagccatggtcctcatatttgggtcagaataagtctcttcaaatgatttagagtttggcttttttcattaacaaaattttaatccagatcataccttccccataccacttccttgtggtattagctacgtgaaaggaacaatttctaagtgaacgtgtacagttgtccctcggtatcaaaaatgattagttccaggaccctggcagatatcaaaatccatggacactcaaatctcttatatgaaatggtgtagggtttgcatataacctatgtacatcctcccatatactgtaaatcatctccacgatcattacttacaacatctacctattacttgtttcaggtggattcaacatagtattcagcatgtagtaagttcaagttttgctttttgaaacactgcagattttttttctgaatattttcagtccaagtttggctcaatccacagatgtggagcccatagatacagagggctgactgtattcaattttcatttttactatgaaacaattaaaactcttcacagcttactctttaattcaccatattctgcctttgtacccattagtgagagtgtactcaagatcaccagtgtcacaagttaaattcaagctagttttcaatccttcccctgggggctctctctacacatcgaacgttaataactccattctctggtttcctgacaaagctctttcctggttttccttctacctgtccggttattccttttctgggtcctattcttctgtacctttggaagctagtgatataatttggatctgtgtccccacccaaatctcacatcgaattgtaatccccagtgctggaggagggacctggtgggaggtaactggatcatagaagcagacttcccccttgctgttcttatgacagtgagttcttacaagatctggttgtttaaaagggtgtgtcacctgccccctcactctcttcctcctcctccagtcatacaagacattgcagccttgcttcctgtacagcctgtggaactgtgagtcaattaaacctcttttctttataaattacccagtctcaggtagttctttatatagcaatgtgagaacagactgatacagctagtcttcatgaagacctagccttggccctgttctctttcctcaccatgtactcttcctacatgatcttggctgctgtttcaattgccacgtgtacactggtacatccaaatccacatgttcaaccagtactctctcctgagtttcccatatacctaacttctttctatacatcccaactcagcatccttcaagcacctctacgtattagtccattttcacaacgctgataaagtcacacctgagactgggtaatttataaagaaaaagcagtttaatgggctcagagttccacgtggctagggaggcttcacaatcatggcagaaggtgaaaggttcatcttacaaggcagcagacaagagagaataaaagccaagggaaagcagtttccccttataaaaccatcagatctcatgagacttactcactaccacaagaacagtatgggggaaaccacccccatgatgcaattatctcccaccaggtccctcccacaatatgtgggaattacaggagctacaattcaagatgagatttgggtggggacacagccaaaccatatgactctacttaacttactaacatatagcccgtatagaatactattctaaattctaagtatatgtatcaattcacttaaccctcataataatcctgtgaagttggtaggtttattgtaccccattttaaagaacaagaacatgaagcattttctaaaattaatcttactttcctatctatctcaaaacttatctcttcctgtattcaccacaacatacccaggcacccaacttcaacaatgaaagctgtttctcttttccatctgctgtcatttctcagcaagattactgaaacgatgtccacaggatctttctggtctctccagctttcaattcatcttttatctgcctgctagggcaatctctctcaaactcgaatagggttagacaccttctgtctgtcttccagataacatcttcttcacaaggcccagcaatccttttgcatatggaagcccctgccatcctcttcaccttattccctactgctcagggttccattctcccagctcccaccacacctacctagagtcccctaaattagaaaatcttctcatatttcttcagctttgtactctacccagaatacctgcccttcaaattccagctagtgacaacatgtgatgtcccctataagccttccttgacaactctgcccaccaccacatcttgttccccctcctgcagcacagcagtctactcacactcccaacttagcaatcaacatacccttgcctgtttactgtattgatagaggcaggaggcagagaaattctaggcagacgggggcaggtccccagcaaaaccccaccttcaaggcaaaaaccctgaaacccacagcctaaagtgagaacttctaaacctgtttgcccactctctcctaattagttctttctgaataatgtctttttaccaattgaaagttgccttttccaaaactacctatggcctgccttgccccccacatcccattcatgtaaagaccccagactcacttggtaggggagacaagcggcttgactgatgtattagtccatttttacgctgcttataaagacgtacatgagactgggcaacttacaaaagaaagaggtttaattggacttaagagttccacgtggctggggaagcctcacaatcatggcagagggcaaggaggagcaagacatgtcttacatggatggcagcaggcaaagagagctcatgcaagaaaactctcccttataataaccatcagatcttgtgagacttaatcactattatgagaacagcatggcaaagacctgcccccccattattcaattccctcccactgggtccttcccacaacatgtgggaactcaatacaagatttgggtggggacacagccaaatcatatcaactggagacttcagaggacagctgagtctactgtcatatcaccctgaacacacccaatctcgcctgatctttgaagctaagcagggtcaggcctggttagtacttggatggcagacagacagctggactttggaggagagatggcttagctttggagaagagccaagtgtagatggccagactttagggaagattatctgcccgtcctgtcccgtcttcagctaccctctctgctgagagccactttcattgctaaataaaattatctgcctccaccatccttcaggtgtccatgtgacccaattcttcttggacagtggacaagagcttgggacccaccaactttgggtacccaaaaaaggttatcacactgaccctttgccctcgctactggagggcagctgccccacacagtgaggcaaagggcccactgagctgatgacacaccggtgtccatggatggtggagccaagagagcactgtagcatgccctctggggctttagggtcacagacaccaccacctgggcaccactgtggggcctgcacacagcatgctcctgccggtgctcaaagtggctggctggatcctgtactcacttgcccacacactcctgcccgcaagaggttgagcatggcgggctgaatggggcacccccatcgcaagttttacaaatgggttgagaaaaactcctgcaacagtattacccactgcactaggcactcagacagggtctcttttttccctacatcctaacaatcatcaccatatgtataatacatagtatgcacccaataaatgtttctattctacatagaggaaatgggagtctgagccttactcacagtgtgaattccaacaccaaactacaatttgcaattctccctttacattaatgtaaagcaaaaataaaattctaagccccccaaccatctgaagggaccacttctctcggccaagggcattccaaggttaacctgaaaaactagttcaggatatgaaaggaagggggagtcagacataattatactctccgaagggttggaattcaggcacagctgaccagcattaacatcaacaaagaccttaagactgatagaacagactcttttaagtctgataagcaacatttacaatcaactccccctgaagccggctacctgaaggtttcatctgtatgataaaaccttggtttccacagctccttatcttaacccagacattcctttttgttgattccaggtctttaactctttgaaccaactgccaattagaaaatctttaggctgggggtggtggctcaaacctgtaatcccagcactttgagaagccgaggtgggcagatcacatgaggccaggagttcgagaccggcctggccaacatgaggaaagccagtctctactaaaaatacaaaaaaattagctgggtgtggtggtcctcacctgtaatcccagctactcaaaaggctgaggcaagagaatcacttgaacccgggaggcagaggctgcagtgagccgagagatcacaccactgcacccccagcctgggcaacagagaatctgtctcaaaaaaaaaaaaaaaaaaagaaagaaaaagaaagaaaatctttaaatctgcctgtgacctggaagctgcctccacttccagttgtctctcctttctagacagaaccactgtataccttacatgtactgattgacgtcttatgtctccctaaaatgtgtaaaagcaagctgtacctcgatcaccttaggcccatcttctcaggatctcctaagggctgtgtcatgggccactggtcactcatgtttggctcagaataaatctcttcaaatatattacagagtttgaccctttttttgacacaaagaacaactgagctcaatagagacttagtaacctgccagaggtcactttgcccagtaaatggtggagctacaatttgaaactactctaaaatccgtgcttgtaaagcagcatgttccctgtcatcactcttctttctttaataaatctcaagtgttaatttccgatagatacacataaagcccaatgccgatggcagtcgaattcatacattaggtgaattcaacaataacttagcaggccaatcacccatgagaacagctggaggtcatgttttggcactggagaacaatacagaattggccaagaaaagcaagtgactgtacacaaactaacaaagatcttctgtctctggctaggttaaattaaagctggctaaattcatctcccagagaaaaatcttcttttaaaaagcaacccaaaagttaacctcccagagaaaaccttcttttaaaaagtaaggcaaactgctcatcaatttacaaaagtgaatcttcagcaaatcacttgttttgcctttcagagccaacattccaaaaattttgaaaccgtatggtgtatggagcagaaaaggccaggattcaagtgagggctctgagtgtgaatcccaattttactatttaccagctgtgtgagttttaagtgacctcgctgaagtattaaaatgtcgacaacaattgccctgttgttattgggaagagtaaataacaatgtatggaaagcacctgagcgttacagggcccattaaatggcataatataactaaggcacctgagcaaagtgcctgacccagagcaagcactgaataaatatcaattcctttccttttaggttaagtctccactccctttatctcacacactatcatgaacacataacctctgttgtgaggagctacatctagccccgtttcaaataaaaatcaagttccttcttccaaataagaacttttctaaagattcagatacaccctgaccaccaatgagctgtgaggttgcaggcagtctagggattcagtaaactcaaggcctaaggcaggccaaggccaacaaagcaacagtaaaaattaacatccgaccgggcgcgatggctcacgcctgtaatcccagcactttgggaggccaatgtgggcggatcacttgaggtcaggagttcgagaccagcctggccaacgtggtgaaaccccatctctaataaaaatacaaaaaattagccaggcatgtgcacctgtagtcccagctacttgggagaaatgcgtgaacctgggaggcagaggttgcagtgagccgagatcgcgccactgcactccatcctgggtgagagaggagactccatctcaaagaaaaagaaaattaacatccctccagcatggtctcttcgtcaatccagggcagtaagagcctttgagtgctgctgaagtgaccaaccgacattcatgtttcaggaaaacacgcagcaaattcattcagctctctacagtaagtgcaaagccagtggcctatgagggtctgcccagacactttccagtcctccttcccagagacatggaaatgtgcaagaggtaaactagcaaaattagagagcactgtgcttcagacatgatcgtgaaaaaagagtaggccgggggcagtggctcacgcctgtattcccagcactttgggaggccgaggcaggtggatcatgaggtcaagagatcaagaccatcctggacaatatggtgaaacctcgtctctactaaaaatacaaaaattagctggatgtggtggtgcacgcctgtagtcccagctacctgggaggctgaggcaggagaattgcttgaacctgggaggcggaggttgcagtgagccgagatcttgccactgcactccagcctggcgaaagagcaagaacaagactctgccttaaaaaaaaaaaaaaaaaaaaaaaagaaagcaaaaaagaaaaaagagtcccttatgccagttgataagcatatgcgaatatgggacaatctttcaagacttacaaagtatttcatatctaattatgaatcctaacagccagattcctgaggcgaaaagtgctgtttctccaagacatactaggatccatttcaacctgatgattctatccttacctcagtaccacatcgggagcctgaaaaacaggttttcaagctgcacaggggcaacataaccctaagactcaatgcacaaatcaggaaaacttttagtttcaaaattacacaaccaatttaaattcaagacaaatgtcattaaagaaaaagaaactttatgatagagtttttggtagctggggactgacacaccaaaaaaagtctcccataaatcaagagaataaacatcgtgtttctatgtatatctgtaaatgccaaactaagaatgttgattagaattaagagtatgttgtaatttaattttgcaaaaaaattaaaattataaatgatatcggttttctaagtttgacttcaagataacttaaaaactaaatctgagttttgaaacaacggatgaactcattagtttagaaatcactgtggtgtacccttcttccaaatagagaagactggttgttaaagcccaaacatgtctaaactgatgttttagagaatctagaatatcttcggtctttcctaaccttgtcttctaaacggacctgacaattccctcccttgtggtccccatgcaccctgaagacacacctaagtcagcccttctgcacttgctattctatgtgcttcattcctcttgccacgagccctccaagggacaggctgtctgtgtcacacctgcctttctccgctggcacttagctcccttcctggcccagaggacaggcacccaaggacagcctgtctggggctgaaaatacacctaagtccccactgccaaaaatagggctgaggacacatgcccaacgaccaacagtggcctgtcaaatgtttttaaaacccagaaaaccaatttctacacactattctcaaaaacacatgcatgtttaaaggaaaatcacctttacactgcatgtgaattctttattctttaaacagcactctctaggtcccccccaaatattttagacaggcgctatggaaaacatactggtttttcactatacataagtaaaagattttattttatataccaggaattaatatattaaggctgcaagaggcttcacacatccactaggtccaatcctttcatctttgggtctcgaaaaattacttgccaaaaatcattattggccggtcagaggaaaaatcaagaacactcttgctcatacaagagggctctacttcccagagctgcctcctccgcaagagtccaggagttatttttatgttgacatgtttaccagcactcccaagccctttcttaaatgctgtccaatacattttaaagttgacaacccaactttttcagaaaaataaaatataacctgattgtatcaggcacttaaactactaattatactaaaatattaaagtaacttcatttttcagcacactattaaaaggaacggtgatacttgatacaaaatactgaaattgaggatttttttttccatatgcagttttgttgtattgaaacctattaacaccccagtactgacaagacaatgaattaacaactaaatgtaaatctgcccacctggttctgcaatattattgactaatagataactaaatgctaacacatctcagttttctccacagttctctgaagcatgcaaaaaatatatatatattacttaccaaaaacagagaaccatattcaaaagtctcattcataatctcttgtttcagctcttgtttttccatagatgtcccattttctttttcacccttcttttcagggctaatcctatcaatgttgggaacataggtcatttccaaacattctgcactttccattttaacagggagtatgcctttgatcttctgaaacaacgcagaaacggacccggtctcgcatgctgagttagaagaactggctttgtcaacatcttcctgattcgatttcacggcagatgttgttcttggaaccctgtgtgaagcatttttagaatgagttgtaacatgcacagcctggctagtaatgagtttattaaactgctgcttatgtgtcttgttaattagaatttctgcttttttgtctgcattcaagtcagatctcggtgttctgctcaagactgtttgttgtcttgaattcactgatgagggtgatgaggcactggtctgctgaggtctgggcgtgacctttgataaagcagcatctttgggctgcaacactgctctagacataacttttgctttgacattcttgaagtttggtcttgggtaacttataatttcagtttttctaactttgcagcctattggggtattcgttttgattgttgattttcctaaactgggtttacacaggttcacaggtgcctccttcgagtctggtatgtttttaagccctcgattacccttctccactttcttacatttctccgtcgcttcaatcggtgaaacagaaaaggttacttttgtgggttctaggactggtgttgacatgcacatcgttttgtctgtgctaatgaccatatcatttgcatcccaagtcagtccaaatgacgagcccaccttttgtcctggcgggctacttagaatcaattctgaggtatgattttgggttcccaaatcctttcctttggagaccatttgtgtgtcttcagtctcagtgactttatgctctgggttcagcacttgagcttcgctcttatcaaaagctggcaccattaaagggcattcatcatcaataagacaataggacactgtctctctcagattttggcccatttccttgtgcctgtatgagctctgtgaatgtggttcgctattggattcatcatgggataaacaaaagaactcttgtaatgcagaatcattggggacttccatgccatcagaaactggtgttagtgcttgtgtctccttttctccaactagtctttgttgtgatccatctgtgtactcactggtgacctttcctgaagaacatgcacactgatttccaatatctgaaacaaaaacctcactttgcatcaccacatcagaaaatgctgtgtaagtcatgtcttgggcttctgatggtgtgacttgagggttttcaaagctttctctatcataagtagtttctcttgcatgcgtcttatcagaatgggaagatgtccaagtggaataggataaagaagatgtacttccacttctcctaccagttggtggcaggcttccagcagtatggaaggactgactctttccgatggcatgatgtgatataaaggtgcagttaactttatccactgtcatgtcaaatgtttggtttagctccaaggcatcacagtagcctgcacagttcaaattgtcattaggcttccacacaaaaggcaaagatggctcaacactctggccctcaactgcttctagggaatgacaactgtgttgcagatatttgggcttctcagtacctacaagtgcaggacactgacaaatagaatctttatgcatatctaacacctgcttactaatgaaatcactagaagacttttcatgaccaaatacttcaacaccctgaaggcttaaagaaatattttcaccagtaactacagcagggtcagtttcataatcaaccaccatgtcatctgggttggcagaattccagttcacactgctggctgaagagttttgtgtaggtggtgatttcgggttgtatgcatgtgtatttccatctttatcactggtaaagaaggtttgcaattcatcttctattttatcatctgaattatcatcagtcatcctgaatagtaaccttaaacctctgccattttatttcttcttcaattccttttaaatgagagggtgggcaaaatggtctgtcttctaggtttttcagcacagttgaaaggttttcagtctaagatgctctgaagattaaatgatttgttgttccctggaagaaataaaatgtttaactcaagtaactataagaaaaattaacaggccaccccttggtttcaatcactaagtgattagtttcaatcactttatgttcacatttagaccccacaactactgatgtgggtaactgagatataatcaggcaatctatcaccgcttttcaagatacttttttaatttgagggaatagcaaatggggcaaaatggaagatggggtcattgctcgttaaccctgtccctgactttataactgatatgcctctcccccactcccagggacttgtcaaagagaggaggaggtaaatctggcaatagtattttcttcttgttggctgacagagtgacaattcacccaaatttgcttatgacagtcccaaagtatgtctgttgtcccaggatgattagtaaacatgtccctttcattctcagaagggcccccctattatttccatgcagagtgattattagacaggccatgaaagcccagcaaatcagctgaagatcaatcaagaactcacgtttctcctttgtttttattcctatcttaaacatatgctatttccaaattgaaggggaaaaaaaaattgtcgattcttaaaggctccagtggtaccctgttggaagtcccttgaaatgtgagttaccttatgttatacactaaactgttccccacccctctccaattcatatgtcaagcccaaacccccaccccttatgtaactatgttggagacagagcctttaaggaggtgattaaggttaaaagcagtcataagcgtggagtgctgatccaacagagctggtgcccttagaagaagggaaagtgacaccagaatgctctcccactcttggttcatcccctctctctaccaaattagggtacactgagaagagtaggagagctctcaccaaaaaccaaaccctgaaaagaaccttaatcttcaactttccagcctccaaaactgtgagaaagtaagtttttgttgtttaagccatccagtgtatgataatttgttatggtggccgaagaagacttaagtaccacatgccccagcaattctactcctaagaatctactgaagaaaatgaaaacatatgtcaacatgggaacttgcacacaaatgtacatgattctaaatagaagcactattcataatagtcataaagtagaaacccacatgcccatcaactgaagagcagaaagcaaaatgtactcttatgcatttgacaaaatattcctcagcaatagaaaggaatgcaatattgacacatggtacaacacggatataatattacacttgaaatattatatcaaatgaaagaagccagtcatgaaagtctacatactatatgacactatttacatgaaatgtccagaataagaaaacctaaagtggctgctaattgggatgacgtttcttttgcgagtatgttctaaaactatgtactgatgatggctgcacaatgttatatactgaaaactactgaattgtacacttaaaaatgaaaccattaaaacacccacgaaagcatttaaatctaaaactttttgcaaataaattattattgcttttttgagatggagtcttgctctgccacccaggctggagtgcagtgatgcaatctcggctcactgcaacctccacctcccggtttcaggcaatcttcctgcctcagcctcctgagtagcagggactacaggtgtacaccttcatgcgtggctgatttttgtatttttagtagagacagggtttcaccacactggccaggctggtctcgaactcctgacctcaggtaatctgcccacctcggcctcccaaagcactgggattacaggcatgagccaccacgcccggccacttttgggaaataacttaaattttattatgcttttggtcaaactgcagtgccaaagaaaggtccaaatgttcaagctaggactgcaaacaggtcattgtgaatcctaaaatgagggctgtgtgatttatattctgatggaaagtgtaaatttgttaactctttttactactgcaaacagatacgcacacacttgaactaattttctaatcctagtattcaatgtcaatccgatgtcacagtactgttgtaaagaaaaaaaaatatccatgagggagggaaaaaatgccatttcgtgtgttaattcaacttgccgaatgaagagtaggtctcatttttctatcttgcagcgttttctctgcattcaaacttcagtggcctgaataaaaccagaataggaactatgttaaaactgaaacgatcagttttcttcgctaacagtgctctgtgtctttctggccaagcatcctgataccagcctttaatggaataaagaaaggctgcaatgttgatttcaacagcatgtgcacacatacacatccaaaaagcgattttgaatccaaaaatgaaggctgcgtgatttatatactgatggaaagtgtaaatttgtgaaccctttttaccatataactccttagtgaaatcactgaatagtttattggcaagagccttaataaaagcttttatgaaacataaattaacatttttaatcctccagtataaaatacatccaagctaaatgtttaaatcaagaaatatatttattcatttttaggcttacatgcaggggatataatttccaaaagcactaaatatgctacagctttctgcttccctaacagctaatactcagttaacagactgtggcataagcaaatatatgcaaagtgcactgcaaacacgcacttagcatagatcgtgggaactgtctttgtaaataattgttagcttcaattaatggcatttttattactcaagtttcctcttctgaagtgcataaaagatgatttttaaacctcatataaattgaattaagggctcatatgtcaaagttattttttatttatttattttgagacggagtctggcactgtcgcccgggctggagtgcagtggcgcgatctcggctcactgcaacgtccgcctcccgggttcaagcgattaccctgcctcagcctcccgagtagctgggattacaggcgcccgccaccatgcccggctcattttctgtatttttagtagagatggtgttccactgtgttagccagcatggtcttgatctcctgacctcgtgatccgcccgcctcggcctcccaaagtgctgggattacaggcatgagccaccatgcccggccccaaggttattttttaaataagtatgtaagaggataaataattttatcactagtcctatgtttgtttttaccagttgtctttttttatttttcttttttttgagacaaggtctcactttgtcacccaagctgcagtgcagtgatgtgattacagcttactgcagcctcaacctcctaggctcaagcgatcttcccacctcagcctcccgagtagctgtgactacaggtatgtgccagcatgcccagctaatttttttaaaaaactttttgtagaaaaggggtccagcttttctcatttataaataatactaaactgaaatcttcacaatctttgacatctgatcatttgccaaattgctatatttaaaaagggggcaggattctttataatgtgcatgttactatatatgtatattttatatatatatataaaagttctctttctttttatatatttatatataaaaatacgtaatataaaatatatatattatatactgagttttgcttttaagactcatatactgtggtcagcattgtctctgaagcattttcccatgtcattatactataaaaacatttttaacggttgtgaaacgccactaaagttaaggttaaatgttttagatttacaagctagtggtttacaagagtaacagaaaaataaagaagccatcaaccatttaactttcacttaacattttagtacacttgggtttatgatttttttttaattcacaaaaagagattgggtgtggtcgctcatgcctgtaatctcagcactttgggaggctgaggcaggagcatcatttgagcccaggagttcaagactagcctgggcaacatagcaggaccctacctctacgatttcttttctttttttttttttttttagcacggtggtgcatgcctgtagtcccagctgctcagaaggctagggagaaaggatcacctgggcccagtagttcacagctgcagtaagctatgatcatgccaccacacttcagcctgggtgacagggaccctatcactattaaaagaaaacaaaacaaaataaaacaaatttcaaattggtgagcaaagagactaaaaaacccacaaacatgtgttcataaatacttaaggattgtttttatataaaataaatttactgacatctcttctactttgtagacaagagtaaaaaaatagtggtacagggatttggatatcaaaaaggttctgcagttaagctgatcagttccagcaagatggaagatcaacctcaccattcatgaaaagaaaacaatggctttaagtcaccaccaccaccaccatgaagacaaagccaaggacagaaaaggggtgaccggccttcgctcaggagtttgtcaaaagagttaaaagttggccattttgttttactgcctattttatttctccccgactttaagaatgggtcctaagcttgcaccacttgctcgacatatatattctttgccttcatctcacctgactcataagcaaagtcttcatattgctgtagttgctatttgtaaagccttcaaagttgccatcttagaaatattttgattaaacaagatgcagaaagttaaaaaataaaaagacagagagtgtgctggagggaaaaaaaaaaaaaaaacttgaaacaaaccatcctcacccaaagggataatttctcaagttctcttttggtagtactacctaccagaacaaaggtataacaccagaacaaggtataacaccagaacaaaggtataacacttgtgtaacactccagaacaaagcagaatgatcaagtttcctttctaagagaatcatttgggaaaacaaggagatctttttcagagaacattttggaccagagagaacaaattccccacttattaaagagctgggaatgtaacagagcagctcctcttaaacggttaccaaaatatatatttccctaaggatttataaggattaaaaattagtaaatatgtgctgaaagaaatggtcaaagaactactagtacaagctttgaggtataattccaatgcctttggaaaaaaaactttctaaatcttagcttaagaaaagtgattgtttattccccaaagataaaaaattccattatttcttcatgtgaagagacacacctaaagaactgaatcattatattaattacaattattatcatataatagaattcatcatcattaccatattaatgctagaagaaattttaaagatccaattcaaacttcattttacaaatgagaaacctctgagaaatcaactgcatgacgtgaccaaatcagttgtcaatagcagattatacaatagctgtgtgccttatttcaccaactgaactagaaactcaatagaggcttatataagagtagatgtcttctatatctccctattacccacagtgtctagcttaataatttggacctaatatagttaaccttgtaacaccatattataactataaaatcaagaatgtttccaaaagtaaaacataagaactggcttcattactttataaccacacagaatgtaattttactacttatttatgttaatatatggcacgccagtcctttaagatgtgaatacaaatacagttataatttatagcttccaaatcataaagccattatcagtcttcttaaaagtttttaagaactcacaaatcacaatagtagtttagctctgtaagctttaaaacccaaaatattacctgatcttcaacctcccttgaatcaaaaaagatgacattggcacaacatctaagctatcattttatcttactaaaaacgaagcagttgaggcctggtgcagtggctcaggcctataataccaagactttgggaagccgaggtgggcggatcacttgaggccaggagtttgagaccagcctagccaacatggtgaaaccccgtctctactaaaaatacaaaaattgccaggtatggtggcaggtgcctgtaatcccacctactcaggaggctgaggcaggagaatcactggaactcaggaggcggaggtcgcagtgagccgagatcacaccaccacactccagcccaggtgacagagcaagactttgtctcaaaaacaaaacaaaacaaaaacaaaaattaagcagctgaacaaaatgtcatcagcagcatgtattataaaaaatatattcataagactccacctcctgttaaaaccattcaaggtagctaacagttctactctaagcctcaacttcctactatttttcataatgcaagcttacattcttaaatttgctcttgcagcctacctttcatcaaacttaatagccacctcaagcactacgtttaacggagcatgtctaccacctaggaaccgagtagaggagtacttggtggtcaatttcctaaaagcataacgatttcctatgaagttgcttaaatcaacagcaggaaactagagttgatttaatgcatttcaaaatggtggacggctatgaagtaatacaagttataccttaaataatttagaaaacaagtataaatttgaaattacatccttttattctgaaacagtatttctctgactttaatgtgcccacaaatcaactgggcctttggttggtcaactgactgattcagaaggcaaggatggggcctgagattctgcatttctatccttctccctggtgataccaatccttttggtccatgggccaccttggattagcaaagatgcggcaaagagctttgagaaacacctgtccagttgaccagatcaaaaacaacagtggctgtcagggctgactgctttcacatccaatggtaccttttttttttttgagacgaagtcttgctctatcccccaggctggagtgtaatggcgcaatcttggctcactgcaacctccccctcccgtgttcaaacaattctctgcctcagcctcctgagtagctgggattacaggtgcccaccaccacgcccagctaattttttgtgtttttagtagaggcaaggtttcaccatcttggccaggctggtcttgaactcctgtccttgtgatctacacacctcggccttccaaagtgctgggattacaggcgtgagccaccacgcctggccggtaccatttcttaaagtagatacagactttctctacatttggactcttaatttatgcttttgaatgctgctctcaagacagctcatattttgcatctagaaaataactggaaatgcagagaatgttgtttccataccacttcggcttattccttccacgtggagggagtttaatttgtataacactcctggcttttgactcactccatccaggagaagtgaagtgacttagtggatttttgtaaatttagtgagaattagctgcacaaacccagaatggcccgacctctttttttctcttgggaatgagctgcccaccagagccaggacgacggtgcactgagggagatactcgctggaggcactaaggcaacaggattaacagtaccctacccagcctggagccccaggcaaagggaaacacaagtaactgtggctggctggttatctaactcatctcctcttctttctagcacacagatattatgtttctatgtgttttgcaggtaatgctgtgtgttccagacagcagaatgtgagtggacatcatatgtaccacctctgggcctggaccatagaactcacacataatccttcatgttcttatgtgaccacacagatgaacaaagcaagccaagtgtggaaacgtgttaaagatgacggaaccacaagatggaacaagcctggatccctgaatccctccttggaggattagtgcccacaaattgtaaacagccacccagatctcagcgagcaagaaataaattatacctgaatgttttaaagggttttttggtggggaaagaacagtgatgatagatattcttaaatactgtaactactttgaaagaagagaacaacagttaagaactatgtcattttagtcatcttttgttttgtcaaaacaaagatgttacaggcctgtgcttgtttaatatgaaaaaactctatgatctacaaatccttggggatacagagaatcagggtagctggtgacatctgacctatcctcttactcactgatattgttcagaaatccaagctaagaggttctaaaatagcagggaaaaatggtaatttctatgcacttgcatttttatgaaagaaaactgcaaaaaaaaaaaaaaggtaatttctatgtacctgcaattttatgaaagaaaacccattaaacaatagtttataataatgcatcccctacacactgaacaatttccctgttcctgtttcatctttatatcttccccaggtctgcttcttttaagacgtcttcacacgttaatctagtccaagggctggcaagccatttctgaaaaaggccaatataaaatatcttaggctttacaggatgtgcggtctgtgctgcatttattcaagtctgctgttgtagaatcaaagacgccacagacgatatggaaatgaacaagcgcaactgcatcccagtaaaatgatttacaaaaaagaggcagtgggccagacttggccgtggactgtagcttgctgacccctgaactagtctatgccctaatcccgtggtccccaacctttttggcaccagggactggtttcatgggagacaacttttctgcggaccaggaggagggggaggattcaagcatattatgattactgtacactttatttctattagtattacattgtaatacataatcaaataattatataactcatcataacgtagaatcagtgggagccctcagtttgttttcctgtaagtagacagtcccatctggaagtgatgggagacagtgacagatcattaggcattagattctcataagtagctcgcaacctagatacctcgcatgcacagttcacaatagggttcacactcccaggagaatctgatgctgtcgctaacatgacaggaggtggagctcaggcactaatgcaagcgatggggagtggctgtgaacacagacgaagctttgccccctcgcctgaagcctacctcctgctgtgcagccctgttcctaacaggccacagcccaggaattggggaaccttgccgtgatgaatcaaaactagctgtcattggctgggcatggtggctcatgcctgtaatcccagcactttgggaggccgaggcaggcagataacctgaggtcaggagttcaagaccagccttgcaaaactctttctctacaaaatatacaaaaattagccaggcgtggtggtgtgcacctgtaatctcagctactagggaggctgaggcagaagaatcacttgaacccagaggcacaagttgcagtgagctgagattatgccactgcactccagcctaggaaacagagcaagactctgtctcaaaaaaaaaaaaaaaagactagctgtcatctatacttcaccatcattaaaatacagacaccacacacacacacacacacacacacacacacacacacacaaatgcacacacaatttttttggttttatttttatttcttggctctttcagagacaggtcaactcaattcaaggacagtatactctcaattttctcgtaaagtccattactacatctcttcataaaaataaccactcacaaaatcaggtaccatagggcttctaaattacctaacaacaaacagaaatagcaccaaaaattggttcttacttttcacaaatcctctccactaattatcatttaagatatcatttactatatgaaattatatactttacatactataaattatacactacaaattaagagacctttatgctagcattagtttacctttgtttaaataaaaaagcttaattgtcactttagaggcattttaagactggttgacactgggtgccgatttagtgaatttttgtcaccaagttcaagtttgctacagctgtcaaagatcataaaactgaaagcatacggtattagcaaaaacaagtcttatcagtatccatgcaattttaaaaagaacagaaacttggcaactaatgggtaattaaatgtctgcagaccatcacatgtgagtacacccagtacacaagtaatcatcatccttaatgagaatgagaaaatgtttaattcccactcatgccaaaggccacatacaagtctccttcctccatgagatctcctcctactactcaacatggctatcttttttcaagtttaataggcaaacctctctcagcacttgactggaataactgttgcaccatttgggagttatttttcttttagacatttgcagatcttatctgaaggtgactaagagcccagagttaagtatttgtgaggcaatctatgcgaactctgaacttacctagttggcttatatgaaatttgtagaacgcatggcaggagcctgtgtaagaaagtattgtcctggttttctggtggtttgttgttgttgtggggtctgagaatgtacagccaacccctcttttataacagagaattgattttgatacatattttaaaatatgatagtgcagagttaatggatgttaaaattttattttcttgttttggtaggtagattgaattgagaatcatataatcagtatatctgagaattgtatgaccagtatattttaaaatatgatctttcttttaatcatattttaaagtatgatagtgcagagttaatggatgttaaaattttattttcttcttttagtaggtagactgaattgacaatcatatgatcagtatatttgagaattatatgaccagtatataataagactggcacaaccatttgccatcttttcctgttatcatcacatagtgtgggtggggagaatgaatggaaatcactccagaataatgacaaatggtttttaaaactctatgctgaatacattccagctgataatgaccgacttttcttttttcactttggtgatatcatcctcagggtaaaaaaaaaaaaaaaaaaaaaaaaggcatttataaaaaacagtttcataaatcttttagttataaacaggaaagttttatattatgtgtcatttcatttctagactgttgatgatgatgataaggaatttggggccaattttgatatatgaatgtattgtttttccatgtggtgattaaagcttccattagcagtttaaaaaaaaagagtgagaggaggtaaaaggggctgggtacagtggctcatagctgtaatcccaaaacattaggagtccaaggcaggaggattgcttgaggcctggagtttgagactagcctgggcaacacagcaaaaccccatctctttaaaaaaaaaaaaaaatcaaccaggcatgggggtgcacacctatggtcccagctactctgaaggctgagggcaggaggactgcctgagcccaggatttcgaggttacagtgagccatgatcacgctactgcactccagcctgggtgatagagcaagaccctgtctcttaaaaaaaaaaaaaaaaaacggtgtgaaagagactgaagtgcagcaagatgctccaagtttgggggttggggaacatgaagataaagagccaacggtttggtcagctcaagagtttggcttctactctgagagcaatgggagtctgccaaaggagttatgatggagactgatgcttcgaattggctaaaggtggaagatgtcctagtgaggagagactagacgcacgaaactgctagggcagatgggaactcctggcagtggcagcacgaggcaaaggagaggacaagccagacacgcttaaaaggccactgctgtgtcctctgccctgagcagcagagaggctggcacacaatatgtgcccaatacaggtctgttgaattaaacattattttaaaagactacttcacttacattaatatttaaagaaggaagccacagcagatagtatcagagagctgtataaataatgtatcacattctagagagatacacgaaggatttacgctttgagtataaactaggagagttttataatgttctctcttctctttcttcaaataaactaatatgtgagctcaggatattaattcaggattttccagggtcttgaaggtcttttactcaatccaaaataaataaaagagaggttcaaaacatgaataagagatctgggttaaaatgaataatttattaagcatagagacagatactagtttaattatccaaggaaaactaatttgcttctttctaaaacacacacatttaagactttttaaaagaaaatcatatacaacaaagaaagctatgagagaaactctgtttatgccatggtaaaaaaaaaaaattaaaatgacctcaacaaaaatatatcaccccctttccctacccaccctcaaagccacatgaggtttgtatttaaaatatctttaagagcctttttgcagcaattagaacatttttatacaaacagtcaaaaattatcaagtgacttataagaagatagaagtctcctacctccaaaacaaaaaacaaaaacaaaaaaccattacaagaccaccagcagagaagagagagtcctggtgggcagacagcattccaaagtcctctaaaactgatatcaacacaccagaaaagtcaaagaatctcccaaaaaatcatgtttacaccaataaagattaaacaattaatggtattttgtttacacttctggagttttcgggggatttttgtttttgtttttttaatatggttacaatttaaatgggcattggagtggaaaactgacttactcagtcaatagcacagtatagtcagtttgtcttagataactcacactatgcaattaaaaagcctctgcttgggggtggaggagcaagcccctagctggtgatagcaaagacagcaccccgaaggagaagctcccagcaaagcctgcgggaagtataaagattccagacaaaatcaattcactgacctgctaaggttcaagaattctgattcctcaagttcattccaaaaaatgcttttattccttttttttttttttttttggctcaacaacttcctaaaacctccaaaccagcatgtggaagaccttacacattcacaaactcttaaaactgcatttctgaaggcttagtcagtaatttttttttttttttttttgagacagagtctcgctctgtcgcccaggctggagtgcagtggcgcgatctcggctcactgcaagctccgcctcccgggttcacgccattctcctgcctcagcctccccagtagctgggactacaggcgcccgccaccacgcccagataattttttgtatttttagtagagacgggatttcaccgcgttagccaggatggtctcgatctcctgacctcgtgatccacccgcctcggcctcccaaagtgctgggattacaggcgtgagccacccgcgcccggcccttagtcagtaatcttaataaggaaaatggtttaacattttcagggcatcctatattctttaaacatatcataaaagcagcagaaataacaaagttgtgtttccctcaatcctcatctcttgctgtgaagacgacatgaaagccaaattaaaatgctcagatcattttaaatcataagcactcaagcagtttcagttttcttctctctctgacccactgccacactctttgcttacacacacacacacacacacacacacacacacacacacacacacacggggggggttgggggggaagcactacagtcagaatcacaatgcaaaagtgagaaataagcaaggttctagacacttcagatgacatataaagtatataatacataataatttcctgccgcactccatacaattgttggtgtaaccataaaataaccacagtcatttgtaataatatacaacatttttacatgttgcttaatgagagtttttgtacttgatattttaacccaaagcagagccctgcatttgattattatcctttacaaaaagtacataaggggatactcacttttctgcataatcatcttagcattttcaaacgttctagaatttagcctgaagtaggggtaatctaataaagtatgataaataccacaaacaaaatataagcaggtggaaagcatctaagatttaaagagcagcttcaaaaaaaaatcccttttgaaacttgagtggttttaatttaaatgccccaaatcaaccataccaagctaacttacctatattcctcagaatatcaaaaccaactgctatcaacttaagcaagagatgtcttattcgagttatctgtccaaacaaaattttttaatgcctttggttgcacctcagagactgtctttttcatggagcaatgcagaaactgcaaccagactacaggaaatacaaacaccagaccgtacaatgaagcctctctggggactatgattattcaaagacagttcagccttgcagcagtaatagggctgagtgtaacgacttttttattcttccaaactaaagaattttccttggactctctgccaatgaaacatcacagacttttctgaggctttacaggcagaaaacttgtacgcagatgtttcttggttatactgtacacatcacttgcaataaaactgtaaacaaacaaaaacatgacaagttctttaagcaattttcagatcatctctgaaaacagaaggcacttttgcctgtcagattaaatcagcattcactgtggctgggtgactgcttctggattaaagaaactggaatattccagtgatttggataatgaaaaagaaaaaaagttttaaaggtaagatgttaagtatgcatctataatataattggaatttagatgtaaggaataacctacattaatctggctacaattgtacttctcactcccttgactaattacctataccaataagttcttaggagtgttatatcctttaaacttaggaacttcagactgctcaaaaattatcaagttaataataaataaaataatctgtgtaaggaaaagttcctgaaagatacataccttctcattagcagtggttcaccatctcaggtcaatgatgaggaaggggaggcagggggctgcactgtaagtttactttatacatttatataattatttaaatatttgtaattacttttggaattttgaatatcaaaacaaaataaatttatgctccaatggaatcaaatacatgcttcatgcaatgaagttttcaaatcaacgtttctttcacagacattgcaattaaaagatctgcaaatcttttattcagaatcttgggccagcgtatctgctctcagcaatgtgaataactagtgtcatcaaagctgttactttacaaaatagtcagtgtagtccctaaataaatgtctttcaaattccaacaacagattgtctgaatcagacacctgaaatgcatgccaagaagtcttgcaagcaggcagtctacgcatgaaaacaaaccctatgatagattctcttgaaattaaatacaactcttacaacaaagacaattttactattttccgataaacagggtccactcatggaaaagagatcgactaacatggataattcatcgtccagtgtttacagtggctgagttcatttaacccaatctactagttctgtatgtgagaaaactgagatctagagaaaagaagttacgatttctactagtgtctactgcataactctatgagtcaccattcacaccacattctatggacagaaacttcactggtccatttacattaaagatgatggccatggtggcccagaattgtgcagggtagtggcctggatgacttttaagatgacacaatgatttagaagcagaatcaggatcagaattatctccttcctctcctttagtttaccatcatcttgcctcataaatgtatgaaagaaagcaaaatacaagtgcatttaggataaaactctaatttttatccttgaaatggcatgaatactgcagactaatcctaccttcagaacatcgtatgtattaaaaggaatgcctatagaaactagacacacatgtacaaaacaaaataactgaaacatttaaagatgtcctacaccattatactatattaaatactttgtgtcccaaagctacaggtgaaaacaagaataaatatttcactcgcattatccaaacttgaatccctattgttttcaatatccctactgactgtaccacagaggatttaaagagattcataattatgactgtcatattatatctgctaaaacataattatctggtcctgcttcccagtagaagaggccagtgtactctctactgatgtcataccaaggaagcacttatggctacaatcactgatgtcaattaacataagaaaccagtacattcagtactctagtaggttgttgcaaagcagattaagttttcctacaaagagaaactaggcccaaaaccagacaaagtatgttcaacttcttcttataacccactatcattcaatgttagagaaaatctaggcactaagtaaaagcatttcagatcatcactttgtaaacagccagagtagttcttctaatttctgaaacaatcacctgtaattcagcaccaaaaaaacacacaaaggaataaaaggtaaggaaaaaccatatgaacataaggtgcccttgaaaagtactggcatggaaaagacttgaagattatataacaagactaatccatattagagaatcaaaaggagattaaactcccaaagatacgttcagaagaaaaactactatgaactaaattatccttcctttccatattgttcatgcaatatacacacatgcacaactttcccccactttcacctagttgggatgagatgttaatttaggctgaaggactattatttctctttactcctgttatgccagagaggatccaagaggaaaaaagatatacagtaaaataaaaagattaggaatcagagccccaaggaaaataaaagactgtattaaacatcactgcaaatcaatgtctctgaaccgaattttttaaatattttgcaacgtctcagatcaccatacgtagtgcaggagcaggggaagagtcttcaagagtcatgctagccacactgtcattagaggtggcctagagatgctctggggttacctgaaacaagccaaaaagcccagtgtctatatcaatggctttcctacataaaggcaaatctagggtaagatacctcactttgatgtatatgttactatgttttctgttgctacaccatagactgggtaacttataagccatcaaagttcatttagctcagggttctgcaggcttagagtccaagaacacaaaactggtgtctggtaaggaccatcttgctgtgtcataacatggagaagggcatcacatagtgagacagtaagagcctgccagctcaggtctctcttcttaggaagccaccagtcccatcatggggtccacacctgatgaaattatctaaatctaattacctcccaaagactccacctccaaacatataaaatttgggagtcacattcaaatcatagcaatggagcaccaaaatcccacagggtctttccaggaagaactcttgacatgtccctcatcactcctgtctatgtcaaccagcttggacacagatctacacatgcatggatcaatgactagcatttctgaggtggaagccagggcccacagcacactatataaaaataagactaggaggcacacctaaccattccaacgtccatgttcttccccactgtgcagccctcacatctacattctctcctttagctccctcacctcattatatgaccttaacaatcctgctggtaaaggcagtccccaacccacaagcatataatcttccaaagtttgcctggagatttatttaacttaaagctcgttttcctagataaacgctactaacagcatttctctcttaatagcattctgttaagaagctcccaggctggcctccaatctgaaacccatttaaaccacaatgcagctactactagtttgggaaaacactagcccttcacatctgcataaacgccaaacagctgaacaccagttaggactttgtttccatgtgtctaaaagaaacaaaggtgttgcttttcctacttgattctggctagtaccacctcagtctcaaatcagaagaggataaggactggggaagaaaatgaaagtaagtttacccctttctaaaatgtgaagaaaaggaagcggaggtgatgccaccaggcattggggtgaatctcatgagaagatgctcaacatcattagtctttagcgagatgcaaatcaaaaccacaatcagataccacttcatactcgttaggacacctatgatcaaaatgctggtgaggatatggagaaattggaacccccttgcgttgctggtggaaatgtcaagtggtgcagcagctatggaaaacaattctgtggttcctccaagagataaacatagaattgccatatgatcaagcattccactcttatacccccaaaagcagaaaatagagactccaagaaatctgtacatccatgttcacagcagcagtatttacaataaccaaaaagtggacaccatcaaaggtgtcagtggccaccactgacagatgagtggataaacaaaatgtgatctatacatacagtggaatattattcagccataaaaaagaatgaaattctgttacatgctgcaacatggctgaaccctgaaaatattataagtaaaaaaaaaaaaaaaaaaaaaaccagaaaaggacaaatattggatgattccacttacataaagcacctggagtagtcaaatgaatagagacagaaagtcaattcgaggttaccaggggctggggcaggggaacatggggagctattgttaaatgggtacagtttctgtgtgggatgatgaacaagttctgaaaatactggtgatagttacacaactttgtgaatgtactttatgccactgaaccgtacactcaaaaatggttgaaaacgtaaatttcatgttatatatattttaccataattttttttttaaagcaacaccacaaattagaagagtcagagctaatggcttcacctttggatacctcaaccttcccaatctacagaataggagaaaaataccgtaccacctccgggatcctgaaacttcaggctgcatcatgagtatctgagacctcaaatgctaaatcctcaaatgtaaagggtctacacgacagcatgcatcacgccctacacacctgccaggtggaagcttttctaagctagatggtcgcacagaaagcagccatgtgtacatatgaacaagtttcctaagtttgcaagttctttgttaaaatcttcaatgaaattctcactctattaacttaactatcataaaagagacattatatcatagaagagtaaaattatcatagtaaccacagcaagtatgctgacaaagatgttttcgatgtagctgtttagaataaattactaggacaaacatctggacccatggccaccaggcactgggcaaacagagctcaggtacagtctcctggtgaggcagcctggccaacctgggttaccccagtgggggcctaaaaataaaagtgacaagacacacagcccgatactgagtcgcatgactacgcaggcatttcagagtgaagtcaaggtgcttaggttcctactgggccgccaagccattcagcatcagcgccggtcccatctgcaggcaaagaatgacacaactacctcttcatggaatattcccagtcaaagcccacttaataacgaggtccttctgcagggttaaacaaacctcagttagaatgcagcatggtgctgagtggtctttcaaacttgcttgtatttacagtcagccaactgcagattgaacatagtcgggagaaaaaaaaacaacaatacaaaatacactataacataactagtataaatgtatttacatagcacttacattaggtattaaaagtaacctagagatggtttacagtctatggaaggatgtgtttttatatgcaaagactacaatattttatataacgaacttaggcattctcagattttggtattgacggtgggggcgggggtgatcctggtaacaatccctgcagagacctacagacaatacacagaagtctcacatacgaggcccagtgcagtcaggcctgtaatcccagcattttgggatgccaaggtgggcggatcacctgagctcaggagttcaccagcctggccaacgtggtgaaaccccgtctctaccaaaaatacaaaaatgagctgggcattgtggcacatgtctgtagtcccagctacttgggaggctgaggcagcagaatcacttgaactcgggaggtggaggttgtagtgaggtgagactgcaccacggcactccagcctgggtgactgagtgagactctgtctcaaaaaaaaaaaaaaaaaaaaaaaaaaaaatctcagatacaaggcttacataaagaaagcattcaataaatgttgactgtaaattagattttccttgctattaaacattactcataggtgacgatgagtgatatttaatcactattaacaactgttttcctatctaaatacaaatttaaggaaatatatgcgtaatactccctgggctctctcctcttttaagacctaattgtaattgcgctttcggagagcaatttcaacagctgtaagacttgatttcatgatatcttacttaaaatggaaaacctgggtgtgggcttagtccacaacaaccccctttctctgaacacagcccctcctactcactgaggtgggttccactaaatgaactagtgaattagccctcgtgcagacacttaagtctaacagtatgcaattttcccacccccagcatttggatttgaaacaggtggctatggccgggcactgtggctcatgcttgtaaccccagcactttgggaggtcaaggtggttggatcacctgaggtcatgagttcgagaccagcctggccaacgtggcaaaactccatctctactaaaagtacaaaaaaaattagccagacatggtggcgcacaccggtaatcccagctacttggaggctgaggcaagagaatcgcttgaacccaggaggcagaggctgcagtgagttgagatcacaccactgtactccagcttgggtgacagagggagacactgtctcaaaaaaagaaaaagaaaaaaaaaaaaaaagatgtcaggcacagtgtgtccctggaactaaataacataaatccaggcgctgtgcatcagccaccttctccacacacccaaaagcagagaaagcaaatctctacagagacgtggatgggaccaacataccaaggggagcagaaatgaaaaacagtgaaggttagattgcctcactgacttggttcctgagaacctgccagacactaagttcttagaaggactccatatccttatcacacccatccagtttttgtccctatttgcttgaatttttatgactttccattaagagtctcaagaaaactatcgtcagaaatttattataggaaatatttcagcagattttcagtatattttccacatctgtgaagacttagaaatgatgaaaatgttgacaagaaggaattagaaaaccacagtacagtgattcaataaaatgcaactatttataaattatgcagtttacaaaactaggaaaaatatttttgtgttttatgattcctgctatgtaaaatatgtagaaaaagcaacacaggaaaacaaaaacagatgtgggtgggggtatggagctgtgggtcactgatgccattttattatcttgcctgtgttattaaactaggaagaaaaatctaattgccaaaaacttgaaataacccaaatgtccatcacgggtagattatttttttttaattgtggtacattcatctgatgaaataccactccacaacagaaaggtaaaccattgatacacaaaccacacagatgtatctcaaacacatacgctaagcaaaagacgtcacacacaaaagtctccatactctataactccatttatataatattctggaaaggcaaatctaagggaacaggattggtgtttgtctaagaatgggcaaagactgaaaggggcacaaggaaactttgaaataatgaaaatctattttgctgagtgtggttggtggttgcacagctacaggtgtttgtcaaaattcattgtactatacacccgaaaagtgcaaattctgctatatgtaaattatacctcaataaaccagacttaaagaggagggcaggtgtggtggctcacgcctgtaatcccagcactttggagggaggaggcaggcggatcccttgagcccaggagttctagagctgcacggtgaaaccctgtctctaccaaaaaatccaaaaattagccaggtgtggtggtgggtgcctgtagtcccagctacttgggaggctgaagtgggaggatcgtttgggccctggagggggaggttgcagtgagctgagatagcaccactgcattccagcctgggtggccgagtaagactctatctccaaaaatatataaaaataaaaataaagaagacactgagctcagacaccaaaccaaagctactgaggcacctgtaaggtgtctgttttataatattggatgacattcatcattcatcaaatgtactgagtgcccatctaatgccaaatgctctgctatgagctagtacagagtgaacaaaatagacaaaaaaatagacacaactatacaaacaaactacaggtcacataggaaagcatggatgctctgattgctattacgggattaggggtcaaggaaggcctctctgaacaagtcacacaagcttagaccccaggaataagtagtaggtaaggaggcagagactggaaaggtttctaaatgtgtcattacagcagtagttaacagcaactcaactgtttcaacatgtgacgggtggttacagtttactattttgctgtgataaggattatggcctcctacataagaagccctagtaaatgaaggttttaaaacagcctaaagacagtgaccaggagacgtaatgatgtgttttggatttcagggaccatcaaggagtacgttcctccaatccttgtcaatatttcaaaaatgatcaacacatgtatgtatttccctgaaatgaggttgcctatgggtaaactaaaacccatgttctggtgtttaaaagatttgttgtatttgttcttacttctggctgaatttgccattatttatttaacaaggtttcctgaagcttatcaacgtttctaaatgataatgacactcactcactctctctctcaccaaaaattggaaaaaatggtcccagtttgacaaatcgaaacctcttcacaatacgggaatcaaccttaaagaaggcccccttcacttggcttcagaggccctactctatcttggttttcctcctaaactcacagacttctctttggcaaatgcctctaagagattcttctttgatcaacatccaagtgttggagggggggcgggggcagccccttattccttctcttccttcactcactcttgtttcaaatacactccgataacaattcccacatactcatctctagcactgatctttccccaaagctccaggtttgaattctcaactgtcaatgtgacatctccacttacatgtttaacaggaatctctgacatgggttggatgtgtgtcccctccaaatctcatgttgaaatgtgatccccagtggttgaggtggggcctggtgggagatgactgggttatgggggtggatccctcatgaatggcttggggctgtccacaagagggagtcagttcttgcaacatctggttgttgaaactgtgtggcagcggactctgggcacacttcctatggctttgccctgctccacaagggacagccaaaaaaaaaagtgtggtacctcccccgtccccttgctcttgctctcaccatgtgacatgacagattcctgctgccttctgccatgattggaagctgcctgcggcctcatcagaagcacatgccagcaacatgcttcctgcacaaccatgagccaattaaacctcttttctttatacattacccagcctcgggtatttcaatctagcaatgcaagaacagtctgatacaatctcaagcttcaagtctaaaagggaactctgggcttccagacccctgcccatttccttcttgtcctagtgttcctggttttcaacaaaagacaccatgaatatacctcaagccaaaaacctaggagtcagcaataatctgcctctttccctctctccccagtagcaactccgacaggcactgccttcaaaatacatttcaaaagcaagcattcctcaccttcactattatcccaggtccaagccaccactgtctctctctgggactactaactggtcaaatcatgagcctctgcctccttacaatatattctcaaaacagcaaccagagtcatccttctgaattgtactcagttcctgccattcctcagtccaagccttctaatggcctcctatcacatctaatacaaaaaagggacccagtgacctaagacaataattagcaacagactaacctttatgcaaaaggtgacgtgaggcatcatcgaaggtaagggagtgctcactgccatgacaaatcagatgacacagcttacacttcatagtcaatcctgaggggctgtggaagaatctaggaaactcaatgacatttcacccctaaatcaacaggtgtgcaaacagaattatcctcttatctaatcagatctccataagtaccctgaaggcttcaaggaataagagtgtgcctgtttttgaccacggattatttacttgcacaacttctcaagtgatctgtttccacctaaaatggaacaaaggagtctctaaaagaaatactacgtttcaaatatctcatagccaatcagcaaacaactaccattctgaaaagattttgtctgaatttccaatcaaagtttcttccagcccatatgacttcaacatacaatttgtaccacattgtaaccaaagagttattagtaagaatgttaaataatcctcccctaaatttcaacttaaaatgtgtagtctttgtttaaatggcctgttgtctgcaagttttgaaacaaggcttcactttgtgttcaaaggcagtataaggaaacaagacatgttactgtttcgattcctctgaatgacagtgattaatattaaacacaagagtttcttacaaattagaattatccagaaacatatcccagtaagcctagcctcataaaatgactaacttcaatatttactttcatttctaaaattttttaaatcaaccactaagactttaacctccccctacacacgccaagaagaaatgctggctctcccctgcactggccacacctgtctttagacagcacccctttcctgctcgacggcctcctgcccccatcatgtgatcaacctctggcatcaggaaggcagtggtggctctgtgccatgaggtccctctttgtaggctgtggctatttttgggctggcagcccctctgattcctgacttggccctagataatcatgaggccgcctttagagagaaacccttcagaagccaggcaggtccctgtgggattagcaacactccactgctaacacagcaagtctcaggtcctaagtgctataaaggccctccaaggacagcgccctctaacctgatggccctcggttggccagacccaaggctgggctcccatttcaaatgggcaagtccgtggttttatggggctaacaaatcaaagctgacacagatatactactcatacatggattttagccaggaaatttcaaacaactcaatgatgggatttttttccccccttaaatgtcatgtccattcataacagtgagatttcagatgtgtgtaacagctttgggaaaaggtattgataaaaatattcaaagaaaatgttagtcacttttcaaaaaaagcacagcataccaagatgatgtagtaagttaaatattcccttgtgctatttatagacataaccatatactgtatcatttctaattggaaaaggtctaccagagatactatacacctgatcctaaaactatacattatcttctgctacgcctctaggaaacaagactataataacttgaattttaagaactacaaattcaagataaatatttgattggtttttccatctcactattaaaatgaagcataagaccctcaaattaggtttaaatgttttaacagtgaagttttatgggagagtacatccaaaaatacagagaaaatacatttatgtatttcatatcacacctttcctccaaggccatcatgacatcaaaactgatcccttttctttatccctaacttggattttgtaaagaattgtaacatcttttctgaaaccacaagtctacagtgtaaaaaatgtttcattcccaggtttctactggcaacattaaatgaagaccttatgaaacctggccgggcatggtagctcacacctataatcccagcactttgggagacagaggtgggtggatcacctgaagtcaggagttcgggaccagcctggccaacatggtgaaaccccacctttactaaaaatacaaaaattagccgggtgtggtagtgggcgcctgtaatcccagctactcaggaggctgaggcaggagaatcgcttaaacctgggaggcggagtttgcagtgagccaagatcgtgccattgcactccaacctgggcgaagagagtgaaattctgtctcaaaacaaacaaacaaacacacacacgcccttaagaacgcaatgaggataacatgttggcccttgtatttgagaaggcaacctggcttgactctgagctacagctccaagaaataaagacgatttgctcactggtcctagctctgacaataagcacctgcccagtgaagtctctggctgtgaaggtgagtgaggtgttctctccattccatccattctggagttggaattttccaaacactgctaaaggtgggggtgtgccaggaaaacaaaggaacacaacatggaccagccaagttccctctcttgccctcataagcagaacaaagtctcagcactccaggactggccgctatttgcctttcttagatgggagtgtaggaagagggagcataccaggccttagaatctgtcctcactagacatggaggaggagatgatgtaattttttttttaaataaaaagatatgcaatgcgcatgctgttgtgctatgagaagaatgtggaaattcacaagttgggcattgtttagctttgtatccctgtggctactgtgttcaactcagcctgaggctccatgaagacggtccttgagtctgacttccaagggcctgacagcctattggtgacagcctttacaatcactggtatctgaagctcaagcaagacagacaccaactaagtacccccagcagtaatttctcaaaaaacaattcagtaacatgcagactccatccttaacggcaatctgaggctctgctgtggtcaacaaataccactgacagtggcccggaccaccactccaattcccaaagacctatgggccccgatgacatgaaggtcactcagagcttaaaggcagagatgaatgcaatgaagatttccactgaaagatggcagagaaatgttctacccacactcacccaattgagatttgtggaattcaacagcccccaaacgttttaaaagcaaataattcagtatccattcatgcctttctccaaatgatttcaactcttcataaagtaatcataagttaaataaaataacatctctccttttgatactaacttcctatagcttagccgttataggcaaaatggcagtgtggtttaactgaatccacatttacagttgagaatactcctactccctgctgttacatcagtgtaagatgttttagttggcaatctaaaccctgctaattttcttacaactgtttttttttttttttttgagatggaatttcactcttgttgcccaggctagagtgcaatgtcgccatctcggctcactgcaacctccacctcccacattgaagtgattctccagcctcagcctctcaggtagctgggattacaggtgcgcaccaccatgcccggctaattctgtatttttagtggagatgaagtatcaccatattggccaggctggttttgaactcctaatctcaggtgatctgcctgcctcggcctcccaaagtattgggattacaggcatgagccaccatattaagagactttcaagaatgaaatgatccctgtgtaatttttacgattgagttccaactggctacaaagagaggaatgtatacaatagcatgcagaacagtctccgagaagttccgtggctacagaatgggggcatttctcacaccactctgtcagcttccttatccctgttacagagtgacctttttataacaagaagaactttttttttttttgacacagaggcttgctctatcacccaggctggagtacagtggtgcaatcttggctcactgcaacctccgcctcccggcttcaagtgattctcgggcctcagctgcctgagtagctgggattataagtgtgcaccaccatgtccggctaatttttgtattttttgtagaaacggggtttcaccatgttggccaggctggtcttgaactcctggcctcaagtgatccacctgcctcggcctcccaaagtgctgggattacaggtgtgatccactgcgccccacctataacaagaacttttattcatgcaacaaacattcctaggtcctctatcacatgcagcttctttgctaggtgatggggacacaatgctgaacaagatggtcccagccttcaaagagcctccaaagagcctccagttcagccaggaagacaaaaatgtacaagtaaataattacaaaaactgcaaaggtagaagcgactggaggctaaagggacccagagaataggctccactgttacagatatggagaaaacagtgaaatgtcacttccagaagaagataaagcttgagctgagactaaggcataggcaggtgagtgcttctcagcctttcagattttatggacctgtgacatccacactccaaaactctgcagagacagcatggggatgtcagctttaattttgccaagaggggcacttcagacaaaatttgtacgactgccaacacatcataaaaggacattattttaatacaaaaagtgaaaggggtacaaaactgcagcataaagaacattcctttagtttacgtaatatacatttagccttatgaaaatcttggtacactgtatttttattccatctcaccgtgttcaagtcaacattctgtcaccaggtaccccagggtcacagatgcacatttggaacctctgatctagatgacaaaggcagatctggagggcagtttctcacctctgcaaagatcaaagcaacagaccaggagagaaagaaatacaccaagggaagtactgagagggccgatggatcagcaaaggcctaaggccaggtaccatgggtcatgcctgtaatcacggcactttgggaggccaaaacaagagaatctattgaacccagttcaagaccagcccgggcgacacagtgagactctgtccctaaaaaatttaaaaattagccagccatggtggcacatgcccatagtcccagctactcaggaggctgacaccagaggatcacttcagcccagaagttagaggctgccgtgagccaagactgtgccaaagcactccagcctgggtgacagagcgagaccccatctctggaaaaaacaaacaaaaaaaagcagcttagaacacgtcaaggaaggtcagtgtattctgacccttcttgcaatggaagccacatcaccaacacacgcacgagcctaggacagaggcacccaaagaccaagcccgatgagttacttccgtagagaccagagaggtctggaaggcagtgcctggcagcagacagtcctcacccgctgccatgatgctaaaacctcctccaggacccaggcaccatctcagataaaagctcttcaaggacccaggcaccatctcagaagtgggtgagccgctgaggaaggaggaaatccatccttcagaggagagaagagcctcagataggaagcgtgaactgaccacacttaaaatcctcaaggagatatttatctgcaagcgactctttgaaaccaaaaaacactgagttatcttgaggttgccacattatatgttctctacaagtgaggtgaaatgaggatgtgtgaggcagttgggttataaagaaataaagttccatttggggtcacaatgtgaatgtgtaagtgtcccacctgcttccgtagttgagagactggctggggctggaagaaatggatccacccgagcggtatgaaggagctgggtttcatatgtgatattaagagttaaggtgctacgttaacaaccaacatttaacactgcaggggtagcgctttatcacaagagactttcgctcaggccacagtacatcagttcttcggatcccttatgaactcttccacctcaaaccagcatatactgttttgtatcacagctatacatttcagaaagaaaataaaagttgaatttttaaaaaagactctttcctagtacacttgacaagcattgtggagtgaggctgacctcattgctgaaaagcgatcggaagcttcaggacatcataagggctggtgagagaaagcgctgtgtaaacacagtgtttggcaaatccaaggactgccaaggaggggccaccgctccctgacaccctgtcaattccactgctccacgccaggccagcacagtttgtgaggccaggatgaggaacaggccacagcctccagcatgggtaaagataacgacatcagtgcacagctcttcaaagtccacagtgttcccacagtcatcctcccagtagacagtcccatgtgacagacaggtcacatgacagtcacattcccccatccctcctcctctgagatgctaaacctgatgtttccagaagttgagtaccttgctcaaaacacagagttaataaatagcagcaatggacattaaactctactccaatgtgtaatcttgatctatttccaccttccttctcacaataacgaaatcacctaaacacctggtaggtctgcacagctatggaccttatagccacctgatatgagaagcatacgtttatcaaggagctcctaaactgactcaggaactgggttacctgttacaagccaaaaatattcttcgcctcattttcctcatggacaaaaactgattcaacaatccatctcatagggtcgttttagagttaaataaaatttttggaaactttctaatacacaattgtacattgctactgttatgccaacaaccttgtaaaacaagccttattatcatcctcacttttctgatgaccaaagctcaatagtttattcatccagtcacgaagactttctggctgggcacagtggctcacactgtaatcccagcacttcgggaggccgaggcaggcggatcacctgagtaaggagttcaagaccagcctggccaacatggtgaaaccccacctgcactaaaaatacaaaaaattagctgggcgtggtggtgggtgcctgtaatcccagctactccggaggctgaagtaggagaatggctggaacccaggaggcagaggttgcagtgagccgagatcgtgcccttgcactccagcctgggcaacaagagcaaaactccatctcaaaaaaaaaaagacattctaaggtgatggacacattctgtatcttgattggtgtgatcgttacaccaatatgtatttgtcaaaactcatataattgcacacttaagccaggtgcactgcatttcatcacacttaatgttatctcaaaaattgtttcaaagatcatgtggtagtgaacagcagtgtgtattctgagacatattcatgaattcttattggaatctacagattttttccgcattctttttctgtaatctgcttgccaactaatccttcctacccaacagaaacccttaaatgttgacgatagctactagttaccgtttctgtctctttactcagaatttcatgttttactgttacatcctgaacatattcatctagaaccttccactgaagtaggtctctgtccacaacccagtagggtacgacagccacagactaaaccaccaccttgaaaagcaggctaggaaggatcatgtgccagctgcctgcagtcctaactcagccgacttctgagaatctcaactatatttctcaatctaagtcaacattccttcaacagtttattgaacaaaaataaaaagcacaattctaaatactcctcccagaggaaggaacaaaataaagcccttgctctcttagatatcacatcatattgtagatgattttcaaaattccatcagaaagtaacctttgtcatgaaaatcagtaaaaaagaacaagaggcaaaacagtaagtttcaggatagtactgggtccaaagtatttacttttatacaatgagctgtttgtatagaagtaaataattaaaagcaccatctacccccagggcttatcaaaggcactctcaaagactgtacagttatgctaaagaaatgatttgatgtacagactgtgcatgcttttagttgtctttttttttttttgagacggagtttcactcttattgcccaggctggaatgcaatggcacgatctcagctcaccacaacctccgcctcccaggttcaagcgattctcctgcctcagcctgaccagtagctaggattacaggaatgagccacctcacctggctacttttgtaattttagtagatacagggtttctccatttggtcaggctggtctccaactcccaatctcaggtgatctgcccgccttggcctcccaaagtgctgggattacaggtgtcagccactgcccccggccacttttagtttttaaattatatgcagttagtttttaaaaactacctaaaaggtagctcagactgtttgagggacgtgggggtagatcgcgtgggcagggcagagtttacagctgaaatataaaatctttaccccaaagtgttaaatgaccatgaacatttccttgtttagaaacttcagagttgtcctctctctccaaagtccacttggtgaaaaggaaataattttccatttgaatcacgccaacaccaaatggaaaatgtctttatgtgtgtgtagttacgcaagttggcacctcaccttatacctcccaacctttattaaacatcgacttcctgcacccttttcttgaaaatgattacctatgttaggctttctgctagcaagagttctttaacagaaggtgactgtatatacacatttaactcacagcagcagcccaacgatagccaacctccaaccagggcctatttatacagtcctaaccctatatattccttagaagacaatttggaaatagagaactgatgacttttagggctaaaaatcatgactgatattcagctgaaactgtggttttgtgagggcattcgtctcttcccagttctgacactggcctcacctcctacttcagtttccatctgggattacctccatttcctccactaattacctgccgctcagtagcttacaataaggaaacagaattcaagatttctacttttaaaaaaagtttcaactgggcacggtggctcacacctgtaatcccagcactttgggaggttgaggcaggtggatcacaagatcaggaaatcaagaccatcctggctaacatggtgaagccccacctctaataaaaatacaaaaaattagccagacatgatggcacacacctgtagtcccagctactcgggaggctgaggtaggagaactgcttgaacccgggaggcagaggttgccatgagccgagatgaagccattgcactccagcctgggtgacagagcaagattccctttcaaaaaaaaaaaaaaagtttcaggaaaaaaaatagtagttgctatccagcatataagaccacagactgctaatctatgaagtgagatacaaaaaatctaattattcaaatgattgtttctatacagttctattaggacttattgcaaaaagcagtctgaaagctataaagtcctatgtaagtggaattcatgattgtaatgatctctaactgtcaatttttcacttgtgctactaatctgaatggcttacaacatttaacattcggctttacgttctgtgattagaaaatgtgaaaataaaccgtaattctcagctatgtcatttgaaattttacatatcataactactgcatgacttggcctggcacagtggcttactcctataatcccagcacttcgggaggccaaggcaggtggatcacttgaggtcaagagttcgagaccagcgtggcctacatggtgaaactccatctctatcaaaaatacaaaaattagccgggcatgatggcaggcacctgtaatcccagctacccaggaagctgaggcaggagaatcgcttgaatccgggaggtggaggttgcagtcagccggatcgtaccactgcactccaacctgggtgacaaagcaaactatcggtgggggcggggagaagttttatcccatttcagcaccaatgtatagaaaatcctggcaacagaaacttattacttccactcgcattaaaactagtcaaataacagcatcatactgggtgtgggaaatggaccggtacaagtccagtcccagttccataacttactcgccataagacaaaacatttatccaaatagttctggtccccagtctccttcagtataaaagaaagcactcatgacctgctctgcccaaccgcagggctgatgtgatcagttcttaatatcatatttacaatgtgcttgccacaaacatagggaattaatatttcactatgcttaaaagatgaaaatacaaaattgcttttatatttaaatactgtatattaatagtaacattttacaattgaaactctaaaatacaaatattctggactatgttacaggtgaaaaatcagaacagggaaccttagtactgtaatatccacaagtccaagattagttcaaagtgatgactcaattgtctttcgaatgtgctgactgatagcaaagaggcaacataatttacagactttaccaaagataaaagtatctacattgattttttgaaaacacagttcaaatggagtatcagcagctcactagacttaaactttcaagaaaaacaagaggtgacaaagctggagtctgagaataaacaatctccaatgtttgctacaaatcaattcctcctaaggaagagggaaagttatcagcctcctgagcctagaatttaactcccaaccgacagcaccagcagatccaagcaacacctccaaggctaagcagcagaaattaaatgaaacacctatctatgaatcagaagatttaatttaaaactagagactaaggaaggttattagcacccattgatcattttctatatacctggcacctgtgtcagaataaccccaggagacaaggtactacccccaccttccagcgtcctgatgagccaactggggagcaaaggtaatgaaatttcactcaaggtcacatggctaataggaaaatctcagacatgaacccaattttgcctgttaagtctgtgcactctctatgacattactgcaccaaatgtcctggatacccattacatttttccaattctataataaagtatgtccccagggtttcataatggatgtcatggtgggcaaaatctagctaaatggtgaaatacctctatttattatttgaaattcaataaaaacaggaggaaggagagaagaaaagcagtccctagcactgaaggatggagggctaatcattcaagatcaaaacaactcacaccatataaggagaaaatagttttcatttgattatatatctacaaggttatacatttttaaatgttcagcctaataagctgtaaccagaactttccaacaaaatagtcttatctgcaatataaaatggtttaggttttctcatagaaacagaaatgtaggatttttcttacctcccttttcattaactgaccctactcttttaaattcaaattaagagtaagtaaatccctttgcagaggtgccatcaaaaacactataaagcaacatcagaaggctgggcatggtggcttacgcctgtaatcccagcactttggaaggacaaggtggacagatcgcctgaggccaggagattgccaccagcctggccaacatggggaaattctgtctctaccaaaaatacaaaaattatccaggcgcggtggcgcatacctgtagtgccaggtactcagaaggctatggcatgagaatcacttaaacctgggaggcggaggttgcagtgagccgagatcacaccactgtcctccagcctgtgacacagcaagactctgtctcaaaaaaaatctgaaagcaaaacaattttttaacccttaaacagaaaatacttcttcacagcattaaatcaagttcaataaccagcaagtctagagaactattgaaaagttttacataaatgcaaaactactctgaaacacaaatcttattagatgtaatgagaaaaaagaatcctagactgcaaagttatctgaattcctaagttgtacatacatttttctctaaacagaaaacagcccaagtccctagtcaaaagaaattgtcaacttgcgattgtctgcacgaatagggaatgtcataaatcatgagtggaatcaattacgtacatgtatttgcacatgggtatgccagatgttctcaaactgactcttcataataaaacagtaactcagaagcatcaggaaacttggcaccttccagctctgatgctctgctcccaaagccatggccgttcagtcggacacaagactgagggtaaactaccttccctctgcttgctgagtatgaaacaatggatgagggggtgagggcaagaggagagggcaaggagcaaggcacagaaaagcaataaggaaattaatacctgtggtttaaaagaccttccagtagctgtgactatctgacaaaagaatttcaaattcccatgccatcagagctctagatgatttattccagaccacatctgggagaaataattataaaagtaaaaatgtacccagcatccgaacatttagaccctatccttaaggagcttacaagatgtagcaaaaatatactggaaaaggtaactaaagattctcattgagagaaattaagagacgccaaagagtacagtgctaagtattttccttcttaatccttttggtgagaaggaaaagggtaagcatgattaatgacaaggatgctttatataaccaagaatgtcaatacaacctacgtgaccaaactttggtcaagtcagcaggtggaatttttaatgcaaagcccaacgttaacaacctgggagaatatttcgaacaacacaaacacttactaacatctccaaaactgcacttttcacaatgattggggtttctctgactcctccaagaaaagaggtcaaattcttttttttctcttctacctcagtgtttggcccatagaaagtgctcaaaaatggctgaggctgaggaaaaccaaacacaggccgggcacagtggctcacgtctgtagtcccagcactttgggaggccaaggccggtggatcacctgaggtcaggagttcgagaccagcctgatcaacatggtgaaaccctgtctctactaaaaataaaaaatgaagacgggcgtggtggtgcatgcctgtaatcccagctactcagaaagctgaggcaggagaatcgcttgaacccaggaggcggacactgcagtgagccaagatcacgccactgcactccagcctgggcaacaagagcaaaactctgtctcaaaaaaaaagataaaagaaaaaaaaatcaaacataatattctaacagcaaggatttttactcatgctttttatttatcattttacatgaaatataagcctaactatacactacgtataaatgacttggttctgtatgtggggcctagattggggatctaatacaacacgtgaatttttcttggtagctaggtcttggcatggctcagcccttttaaatccatttctcattctccaatatccttctaccctatcctgacccaccagcaaggaggacttctgcaatcctcacttcaattaaagcctgttggcttagggtcacagtaataagcaaatatggttcaattctgtaatttgattaacaacgaaatgattaacagtatagcagtttacagtataataaaaaataagattttaacagtgcaaggtgacttaatcagaattctgggaaatatgactcaaccaccttgacacagaggtcaggggaagggggtaggtctatgtttcaatgtcatctcagaaactgctcatatctatgctggcttctattttcattccgtaaagctagccaagggagctatgttttacgaggacatgcagtttcaacttcgtatcattcatagctaacaatcatgcaaaaatctacaaaataaacattaaggaaaataaatttcttatttgtcactgaacactgctgaatacctcctatgaactgcttatctgaaataaggtgaagaaatattgattcttttcatccagattggtatatgtgtaaataacacctgagttaaatattaccatgtttccaatgtacaaaaagcataaaagataagctaactacccaacagtcaagacttaatgaacactgtcacaaacattatttacacaagaatgtatgttacgcctcttcttcctagtctcctgataagtatgagtctttcccaagattcccttttcaatgtcattttaggacacaaaatgtccttaaatgttttagttaacagtagaagatcagaataattatatttgattagtcctcaaatttaaatactaattttcttttcttctgcatcatgcttaagacacaatttacttataaggtacacatttatgcatttaaaagaataaggtcatttaatggtttaaaaacctcttccaatacatcttacctgaaagactgatccattcctagtctgttcttccctttagatgagttcacactgtgtcctagcaataaagcttctaggttagaatgagggtaaaatgtgtgtttttcttacttttatttatgtagctaatgtgtatacaagaatattccttttattcctttttagacagagtcttactctgtcacccaggctagagggcagtgatgcgatctcggctcactgcaacctccgcctcccgggttcaagtgattctcctgcctcagcctcccacgtagcggggatataagcacccaccaccacaccagctacttttgtatttttagtagagtcgggtttcaccatgttagccaagctggtctcaaactcctgacctcaggtgatccacctgccttggcctcccaaattgctgggattacaggtgtgagccactgagccaggcccaagaacattctttttttctgtttttcttttggagacaaagtctcactctgttggccaggctggagggcagtggagcgatctcagctcactgcaacctccgcctcctggattcaaggaattctcctgcctcagcctcctgagtagctgggattacaggcgcccaccaccacacccagctaattttttgtatttttagtagagatggggtttcactatgttggccagggtagtctagaactcctgacctgaagtgatccgcttggcttggcctcccaaagtgctgggattacaatgagccaccacgcccagccccaagaacattcttactttagatatgggcctgctagcaagatttaaatgcagtttatctttgaataaatacatttttattactttacaatatacagcttgaagtctaaactttaatgaacaaagttattttgtaatcaagatttatatgcaaatacgtacttctaaagtacctgaaagctatttacttaagtgaagcacttccaagttcgaccttgttcacactctaaacttgttgagaaaacccaccctttcttccttgattgtgtaacatttatatatcagagcaatcacaagttgccaatctgcttctagggtatgaaaaggaagttttatcttatgtatccacatggcaaagagcccccaaatctgtcacctccaaaatggaagtctcttttaccatttctaaggccaagtgagcaagaaaaagtcatgattaatgtcatcatggaaaattgccccatatccaagagtaaattcaaagattactgagggatttttctctaagaaaataaataaataaccatcatcagggcaatcatctacaaaacttggtttagaaataaatttttaggccggacttttaggccagacacagcggctcacgcttgtaatcccagcatttgggaggctgacgtaggcaatcacttgaggtcaggaattcgagaccaagttggccaacatggtgaaaccctgtctccactaaaaatacaaaaattagccaggcatggtggcgcacacctgtaatcccagctactcaggaggctgaggcaggagaatcacttgaacctgagaggtgggggttgcagtgagctgagatcgcacgcaccactgcactccaacctgggccacagagtgagactccatctcaaaataaatttttaggctgagggcggtggctcatgcctctaatcctagcactctgggaggctgaagtgggaggatttgcttgagcccagcagttcaaatccagcctgggcaacatggcaaaaccttgtctctacaaaaaatacaaaaattagccaggcatggcggcacatgactgtagtcccagatactcaggaggctgaggcgggaggatagcttgagcctgggacgtgaaggctgcagtaagctatgatcatgctactgtattccagcctgggtgacacagcaatatcccgtctcaaaaaataaaataaaataaaataaaataaaaagttagaagaaattacaagtcaaattcaactcctggttatactggaccatccaaaaccaggtataaagtctccctggtcaaagtaggcttttcggggccagatttcaagctagctgagttcataccatcccatctagtccttcatttcctgtgggtgggatcgctcatcctccttctcaggaggccacagtcaccactgtatccgctgctaagtggtcacctccctccggggcctgccttcttccagagaaagtctgaggccatttttaagtgcccctaagcacgcagatcctgaactccaatttcatccttatggctcaaatatggtcctatcgcttactcttacgctctaagcttggggaataaaagggactcaggctctcatggagaacacacttcctttagtgaggactttcagggtatattcaagctttcacaacacagagaaagaacccaactttgagatatcaggaagacgtgttcccccgcccccccaaataaatactttgctgagtagcagtattggaaattaatccaggaaattttttaactacgtatgcagtacatttgtctggacatcaacaagtccgtatgaaaccacaataatgactataaaaagaagaatctggcaaaatgatactacaaatagattactgacaataaatggagtgtgagcctactttgtataatcacagaataacagatctgaaaaacattcagtcttagggatttaaaactttctgctctgatttcaaaggatgttgttcctaatagtatataccaggcccagtggcttctcatcaacaaatgcaattagttttgcaacagtctctaacccaagatatggaagttcttgcaatgaatttgaaaagattctaatttagaatttggggaattttttttttttaagatggagttttgccctgttgcccaggctggagtgcactggagtgatctcggctcactgcaacctccacctcccgggttcaagcgcttctcctgcctcagcgtcccaagtagctgagattacagatccatgccaacacaattgactaattttttgtatctttagtagagacggggtttcaccatgttgcccaggctggtctcgaacccctgacctcctgatccgcccgccttggcttcccaaagtgctgggattagaggcgtgagccaccgcacccggctggaaaattttttttaaatcttctaccacagtcacatatagttctgaagctacgatttagaagtgttaaaaattctgttttgagaaagtcaacagatttatcaacattaaagaaatttgtgtatgtcaaaactactgtaaatatataaagcaaagataaaatgggaaaagtatctgcaatatgaatggcaaagatttactatcaatccataaaaggctcttatgaattaatggaaaaatactaatatcccaggagaaaaatctggcactacatcaaatttcaaaatggaaaacaactagatttctttggtgttcaaatcatctgtaatcaaagaaattgaagtttaaatatagagaaagcactgttcacctataaacctgggaagaattttttttttttccctttaaggatgattctacatgttgacaagaatacggtaacaccagtattctcacagagagctggtgggaacataatttggttaaacattttttggaaagcaaatggtcaatatgtatgaggagatcttccaaccatcaactgtatttcaagggcactaaggatattaaccctgcacataaagttttaaaaacgtatttgttgcaaaagtatatttagtaagtggaaataaatgaaaaccagtttgatacatctatgtaatgtaatattaagtagccactaagatttctgaagatttcatgacatggaaaatttttcatgatacattaatcaggaaaaaacctccacgcaatagtatatttagataaactatataactataaaaaatttttctatatattaacaagtattttcttaaatattaactgtgattatctttgctgaaattgcttaactcacttttctcaatctacctatttttatacagcaagcacggattacttttgaaatcaaaacaaacagggttaacagaacagggctattaagtaacaggctttttaaatgcttgagtgtaataactgcaggttagtttccaaaaaatataagatattatctagaatcttataatcctattatactccaaaatgtaaccttgacttattgacataattaaaaggtcttgttccaagcatgattttctaccaagcagatttaccaagaattattttctcttcataaacctgattttaaaaagaacaggtgaaaaaacgtggtgcaagttacataaataactacatattattttaaactaaattccacttctaaggttttttagctttggttttaaggataagcatgtagttctaatcttttctttgtatagctttcctaatggaatatattgcctatgaaaaaaaaaaaatctgtaacagcactttctacactgtaaagcactgtactaacaggacatcaccattttaagttgtgtatcatttcctgccctaaccatccctgaaaaagcaaactgtctacagaattgcaattccgtttatgcaattccttttaaagttgtccatgcactgttatcttgtatataccctccttaaagaggtcactggttcccaggaagcaatgactctcttttttaatcccctccctcctgcattgcctcccttcctcctgaaattcactggtaacacccctactcccaccctccagccccagcgctgtgatttagtgatgattgactttcgatcacctgcacctggcaaaacttgaaagcttccacgcaccgttttgcctaagactttggtttcattgaaacaaacaaaacacactggatttcctttcttagaacactgactacttcaaacaaacagtatttaacagagtatgtgtaactacgcaggctaaatgaattaacctcttccttcctagtcccaaattactccaagtcaaaaatcaacaaacaacttggtagaaaggagtacgtcttcaaaaaagaacaaaaacgttcctcagtgaacacctaagtccactaagcactatagagtagtcaataaggtcaccttaattaagatgagatttttctagagcgtgaaaaagtgcaaacaagctgcagaaagtagcgaggcgccacgaggggtctttgggacctgcagcaaccctattccacccgctttctcggccccgcttgcttctgctgagaaggggccctgcgagaaggctgggaccgccgggcccgggtgggcggcgtaaggagtccacagtcaagcccctcggtcactttcaaggtgacagcgacgagatccgcatccgtcccttccgcaggctctgcgctggcccacgtgagacccgcctccgctccgccggcgctgccgcccccttt

SEQ ID NO: 932 - DNA, 157125 bp, Homo sapiens; identical to SEQ ID NO: 931

SEQ ID NO: 933 - DNA, 31149 bp, Homo sapiens
attaacacagtctacatttatttggtgaatattgcatatctgctgtactgaaagcacattaagtaacaaaggcaagtgagaagaatgaaaagcactactcacaacagttatcatgattgcgcatggatatgttcagaatgagtatttttcaaatcactttaaacaaagctgaattgcagaaacgaaagcccaacagcagcaattaaattacatttggaataaaatcatttggcctaattttcataaccacagatttcagagaataccaccacccatgccaggtgtaccagacaatcccattgtctgttttagccgtgtaggggccgctgtagtatacaccattcaggtttgcagagtgacacctagtggaagggagaaaaaaaaagaaaacaacaatcagactggaaaaatattgttcagaatcccttttattttgctacaaatgctcaaaatttttgaactatgaattctgccatttttcagacaagtaaatatttactagtttccaaaagctgagaaatttctacaacagatggctattgtattttattttttattttttaatttttttttaataatagagacagtgtctcactgtgttgccctggctggtctccaactcctgagctcaagcaatcctcctgcctcagccttccaaactgctgggataacaggtgtgagccactgcgcctggcctcagagatgggtattttaaaatggtgagttttactgccattacaaatctgaaaatacaacccaggccactcacagtgcattgaaaaataagcatttcaatttttgattttctttaaacaaaaaattaaaacaagcaaacaaaaacgcatccttgtaacctccagccttacaacctcctgactcagaacagtgttaatttcatacttaacaagagctaaggtgagtgtcagcaaagcaagtcgtgggcaaggtgctctactactggctttcctggataatttgcactcacacgttcattcctctgctgctaagacttagctttcataattcaaactccgtatgtccccttctttaaattgctagcctatcagttatttcaatctcaagggtaagcaaacaaacctaaatcaccatttaaagttttgccacccatcaaccaataatcattttttcctagttgctgagttaattttttacatatattgcaccaatctagataagctggttaggttatcgacaatataaaaatgtttctttcctcctttggagtctgtaaattttgtccttgatatgtataatttacatgtaacagtatgcaataagtttatgtgtgttgttatgaaattaattgccatatacttctttattgataaaattaatgaaaagatgtcagaattaggatagaaggagaacattcacaagaggtagttctgaacatctatggaaaaacccaaattattgaatcaaaaaagcatataatctacccgtaaaggctgagtggctggcttgaatcacttatcagcttaatgattcactcctactgagcgttctcgaagtcctcctaacttaaatggacgtaattaattgaaaatatgtatgtcaagtctgcaaatgtcaaagcctactgtgtttttaaaacagcatggaaagtaatgttaaaaaaagaaaatactgtaaattgagtctccagaatatatattttggcatatatttgtctatctagagacatctgctaactatatttttatatttggtctatcatttgaatcccattaggaaactgactctgtgatgaacataagaaaccttcactattctgagaccagttttctagcatcgtttagtttttagaacagcctggatttgaaactaggttaggggatgattgggtcttccttggtgaagaagtggctgtgaacactcacgtgaaatgctacactaacaaagaaaagacatcaactcgcagtgattggtttgctatgtggaaaaaaacattttataggtgggtaatatttatgaagtgccaacatttcatgtaaattagaagaactatgggacagaaaaaaagcaacagtaagaaggaagaaaagatgatagtcgaactcactgatagtaggcatggtagaagtagcaccaagtttctaaaacaatctactttctctcccttaatgcctactgattttccaattgcacagccttatcaacccctttgattccaaggataatgtgggctctgtggcaggctccacctaatgaatggcctttctttgtgctccctgaacccatttctttaaagtcaggtaaatcgttcctttgcccacattaatatacatggtagttttcattcagatgccttagaagccagtcagctggataaagtacatggttttgatctcaggatactattagtaattatttctgtatatggaattgttttcaaaatcaaacattggtgatgcttgcagatgacttcatgaattacacgttaagttttatgtcatgctgacttagaagaacaagggggaaagaaaggagtaggaacaggtgaagaagacggtttttaaaataacaggaaaaccactaaggaaaacaccatcatcaccttcaatttgcaaagcaggagagtgaaatttgtttctctccttcacactgctggaaatactccagttcctttataaatgatcaaatcttaaatggactcaaatgtttttttaaaaaagcaaaatatagaaaagatgactatttttacaacagcagtagtactcccttatctgcaggggatacgttctaagacccctagtggatgcctgaaactacagataataccaaattctatatattgatactatgctttttcagtctgataaccgaaacagctacgaagtgagtaacgagcagataaagaaaataaaatttaccaaactgaaagacatgatatagattcaaaagaaccactgagtacccactgcagtaaaccaaaagaagaccacgacagtgtatgtcactgtaaaatttcagaacgctagggggaaaaatcttttgggtgtaggaaggaaaaaaaccatctatagtagttctctgttttttcctataatatacatacctatgacaaagttaatttataaattagacacagtaagagattaacaacaactaataataaaagattatgattatataacaatatgtcagcattacagctcttgtgctttgggaccattattaaatcaaataagcatgattcgaacacgagcactatgaaactccaacactggatctgataactcagacttctactaagtgtcttggggcagggagggctttcagcgtggatacgctagacagaggggtgacccacctcctgggcagaaagaatccaatggtgcgaatctctgctcagaatgacatgcaatttaaaacttatgaattcggcagggtgcggtggctcacgcccaacactttgggaggccggggtaggtggatcacatgaggccaggagttcgagacctgcctgggcaacatggcaaaaccccatctctaccaaaaatgcaaaaattagcccatgtaccccagaaatatataaaatattttgtatcagtaaaaaaagaagcaactatatacaatcaaaaacggaatgaatttgctgataaagtaacatgaatgtattcagtcagagggtagaattaggtttctggattattgtaaaggaaatttctgtattgggagaggcttagactcaatgaattaatgaaagccatagtgattgaaaagtagtactatacagaagcattacagcaataacggtggctcttttgtgtgatatggtcaggtgaagaactagttggttattaggatgccaaatagtctccatatatatacatgctctctctttctttgtgtgaatttgtggccttctatttataactcatccataattcagtttgcaaatgatctttgtaaaagtaataatttatttctatgacatttacactttactaatgtacacaatgaacaaatcctcaaaacgacttcattgctgaagaattctaatgagaatgattacttaataatactaatattataaataaagactaacattaccatacatattatattgataattaatgtctatcagtgagatatcatcaactccattacaactatgctcataagacatcaaacctgttaaaccaccagccagactgatcttcttctgcgcagttcccttcatagttgtcatgatctctgtcccacgtgctgaatttcattctttggtgactagcccaccactgcacctcaggatgaaaattccccgcaagggaatctccagctgttccagaatattccccaatattcaactcgtagaaattctaaagaaaaagggcatttctgctgtcagtggagttcctctatgaccattttaaaattaagtttatttcataaacaaaagaacaggttctattgtatatttttatttccactgactccagggttatattgcacattttaagcatttattcacggttttacttcttagaaaattgtagtaccttttcatctccaactttgaaattcttatattgtgcataacggctatttttttcaaaatctgcaaggtcgatttttaaagtgtagtcttctaaaaaagaaacaagcaattataatttttaaaaatgtgtgacatgacacggactactgcggtttaaaaataattcacagctctattttaattttaccatttcccttggccaagaatcagttttcaaagattaaacagtgactcctttgtatatataacatgaacattttatcgtgtaatttatttgaaaaaaaatgatggatacaatattaaatttaaaaaatgtctactagatctcttagaggtaaaacctagtgcaattcactgaataatgaacaacagaaaaaataagtgattacttaaagcaatctaacaatgaaagggtcgacgttttacctttaatagtttgacctctttttcttgatttcagtaagaatgttgatcttgaatataaatggtggctattaatgacattgtgtaatctctagtagctgagccactaggtttgtaaaatgtagttgccattgcctgcatatgcctgaacttggttattttcctgatagcataaaagatcagccaggaaaccctttaagaataatttgaggaagaaatatgaatcctaattgttatccgaaaaccttcgtttgatactggctcataagatcaagagactcttagcatcaaagtatgtagagtggatgtcattggaagagaatttcagaggcaataaggaaacattctggagaaatgctgtaccaccaacattctcaatggcagagatgatgataattactggaaaatatactaacatcaatgactctgagtaaaaaggtatttctgaagaactgatatctacatgtgaaagcattttaagaatgcaatggggccggggcggtggctcacgcctgtaatcccagcactttgggaggccgaggcgggcggatcacgaggtcaggagatagagaccatcctggctaacactgtgaaaccccgtctctactaaaaaatacaaaaaattagccgggcatggtggcgggcacctgtagtcccagctacttgggaggctgaggcaggagaatggcgtgaacccagaaggcagagcttgcagtgagccgagattgctccactgcactccagcctgggcgacagagcgagactccgtcgcaaaaaacaacaaaaaaacaaaaaaaagaatacaatgtattgggtacatattatcttttatatatgctaaagaatgatatatgatgacaaaaaatctctaaacattaaagatatactttaatgactgtaaaaattctaggcgatataagagcattatgtttttaaaatgattaaaataattgctaccttcaagtaatcttttttttcccattgtttggaaataacaaagactattcctttttcagaaacagaactcttgtcaggggcaccaaatgttataaatcaaattattagatcacatgtgttctatcctcctactttgataaataagatataacaatgacctgtaaggtcgggttagaatttagagcctcactttccttggagtttcaagccagaccatggaggcactgggaaagagagtccctgaatagtcctatcacctaggccccatctctggttggcctcttctctctttccatccccatctccatcacttatagcaaggggctttggatccacttgtggacatcccaggctgcatatccaagttctattcacacccaagttgggtggattacaaggtcaggagatcgagaccatcctggccaacatggtgaaaccctgtctctattaaaaatacaaaaattagctgggcatggtggcacgtgcctgtaatcccagctactcaggaggctgaggcaggagaattgcttgaatccgggaggcagaggttgcagtgagccgagatcgcgccactgcactccagcctggctacagagtgagactctgtctcaaaaaaaaaaagccattttttagcctcccctcaagcttaagggtgcacacaccaggacgagaacatcctgaaggagtcctataaacaaactcaaggctgttggggcagggaatgctggattcctcaagactggagtccctttaagaggtgatgcgggcctctcttgggcttgttgatttagcaccacaatttccttgccccagggagctctctcaaggtagtaaaggtcacaggagaaaagactgtagagtgtataagagcagcaaggcaggctaagtcaactgtctttaaaaatattctattacagacgagatgcggtggttcatacctgtaattcaagcactttgggaggctaaggcacgcagatgacttgaagccaggagtttgagaccatcctggtcagcatggtgagaccaccgtctctactaaaaatacaaaaattagctgggtgtggtggtgtgcgcctataatcccagctactcaggaggctgaggcatgagaattgcttgagccaagagtcagcggttttagtgagccaaggctgtgccactgcactccagcttgggcaacaggcaaaaatctgtctcaaaaaaaaaaacaaaaaaaaaaaacttctattataacagagacataaagactcaattttttggctaacattgaaatgtctctttgttcaataagtaaacaaattatatttaccatttctaaatcaattttattgccactacttctagttgagatttatgtagtggggataaagctattctcagaggtaattcattaattcattagccgtaatgctctcataattaaagaatgcagagacaaaaacactggctattgtctggattgatgggatacgtgggtgggggcccaggaactgaaaaacacgttttttctccaacgagattagccagcctgagtaccaagttgatatatgaaaaggaacaggtttgttggcaaagttcctctgggaaaatatgtacatcataataacttaaaaaataatacgtttgaatttcatatatttagaaagagccaagggttactgctctggggttttcatagtttcaataagaaaccagataaatatcaatgtgcaaatgaaacagaagttggtatggcaaattttatatatctggcataaaacacttaaaactagaataatagatatgttgaaggaaaggaagcgttatgtaaatttagagagcactgatcataagaaggacatacaaagaaagtataaggtttctaggattactcatcctgtctaatgtttatcattctagtgtctcaaagaactttataaccataagcctactactataaatatagaaacaccaatagctttccagaacttggatggaacaaaggaacttttgttttatcttaattactttattattattattatttgagacagagtcttgctctgtcacccaggctggagtggattggcgcaatcttggctcactgcaacctccgcctcttgggttcaagcaattctcctgcctcagcctcccaagtggctgggattacagtgctgtgccaccatgcctggctaatttttgtatttttagtagagatggggtttcaccatgttggccaggctggtctcgaaatcctggccccaaggggtccacccacctcagcatcccaaagtgctgggattacaggcatgagccaccatgcccagctgtttatttttaatgcaattgcagtgtaacttagcatgcttttttgggcattacagttgccttttatgaaggattcaggatcagacttgagtgggactgatgataatctcagactacaacagaggtagggaagacaatggattggagcaaaagaacatgggagatagaagctgggaaaagtcgttatcaaaacaatgatattttagacaaatattaaactctaaagataagaatttaaaagtatatagggagacatccagatgtctgctatttactttgaaatatatatacagaaaagatggattgatggacggattgagtaatgggcaaacggatagatacgtaacaaaaacaagcaaagtaaaatgttaatgtaggatacaggtggtaggttgaaacttctttcaaattggttgcagctttgaaaaaatttcagcattaaagatgagatgtatgtggaaacatggacatttcatatattatagtgttttattggaaaaatagcaccaattgcccaattgttcacctctctctcataatatgtcttcatagctcctcctattgtttacttccttttaaaaaaaagtctgagctgctcctgtgatttgctttcaccaatagaagaaaaatgactccatgccaattctgggcctagatctcaagagacttatatacatccactcttttttgtggaaccctgcctgtgctacaaaaacaagtccaggctagctagctggaagatgagagaccctatggagccaggttgaatccttccatcccagagcagcaacttcagtgaggaagttgatggcagactcataagcaagcccagccatgatcagcagagcccagccctgatcagcaaaatcacccagccaacctgcagatttgtgagaagtaataaatggttgttgattttaagccactaagctttggaagaggattgttacacgttattattgtgacattaggtaactgatacagcatatataatctccaggaactcaaggcatcaaaaaggaataattatgacattatatatccttttcagaagtagaatatatatatattctatatatatctatagatacatatagcgacttatattctatatatctatatatagctacatatatactatgtatagaatgtatatatatctataaatatatttagatatttctcataaatatatatgtgaaaacaattccccgcaacccaattctagcttttttttctgtttctaattttaggcagccacattttacatttgggattattgcccaaaagttatcactgccatctgcaaatcatagcaattattgaattagttccattgcctataatttggttaaaaaaaaattttagtgttgtttttattatatttcaaataaatctgacatcattcaaaccttaccttgagtggtcaagaagtgaagatttttattgcccagccaatattcaccatgtttttggacaaaatttccaaagccattttcatagtctttccatcctctaaaaaaggtaaagtggaagccgattagagcaaactccatttgtggtaccaaagcgaccaccacccaccccctgctaccaccacctccaatattttcttgattagttaattcattttcagtattcttctttagagagattgaaattctgtctaattaataggcttcaggatatgatcaaaatatttgacttataaatctcacatttgctgctacatataaagtcttacatcataattagcacacctgttaaagttttcactgccatcagatcgtctctgaattacagtccatcctcctccatcggacatgtcacaataaacagaaaattctgctgggctctggagaggtttgattttgtaaaatccactgagcttatacccatcattgaaaatctctgaacaatctgtttttaaaacaaggtaatgtaacattcattatgtgtctttttctccccccgccttagggagcctctgaatgagactactcagtatcactggagacagataacacatggtatagaaatcagcgttttaaaattgcatcttgtacatcttccagtggatattaggaaagttttatttcctttgctaaaatttgccacctgaatccttgatataatcatcgaggaaaaaaggggagtgaaataagaatctagttttttgtttctttcttcttttttcttttacattttttttaagaaatgggggcgtgtcactatattgcccaggctggtctcgaactcctggcttcaaacaatcctatcctcccaccacagactcccaaagggctgggattacaggtgtgagcttagtttctaatttctgagttttgtagaaaacaatcttaaaaaaaacaagttatgagtagtctgttaataacagtatatttaggtggaacttacagttttatcagacggaatagtaaaatttatctcacccatgaagctaaaatgaaagcagaaatgttaacaccaaagttactacaggttatcctgacttagagcatgataaatcattctggacatctgaaaatgaacccaaaatagtaatcttgtaaaaatctttattattatactttaagttctagggtacatgtgcacaacatgcaggtttgttacatatgtatatgtgtgccatgttggtgtgctgcacccataatcttgtcaaaatcttataatctcttagccttattagattttttactaacccactgaagtttctaaaagtccatacattcttagatgtttttgctaaaaactgcaagcttctgctattcttttcatcccttaattcttttttgctgtggtatttctttgaacactgaagcaaatgtagctacccctttgtcaccaaaaagtgatatctctttctttctttctttctttctttctttctttctttctttctttctttctttctctttctttctttctttctttctttctttctttctttctttctttctttctttctttctttctttctttctttctttcttttcctttgagacagagtcttgctctttcgcccaggctggagtgcaatggtgctatttcggctcactacaacctccgcctcccgggttcaagcgattctcctgcctcagcctcctgagtagctgggatcacagccacgcacctacacacctggctaatttttttgtatttttagtacagactggattttgccatgttggccagactggtctcaaactcctgaggtcaggccatccgcccgcctcggcctccaaagtgaaaggatgacaggtgtgagccaccacaccctgccaaatggtgatgtctgttccttaagccacttgagggtgatgtaaattaatacccattgggtctcacctaggttgatctgtacagacttagagaacgtggcaaatggggacctctctattgttcagatgcatagaaagctaggttttaggatgattgaagtagtggtcactataaacaatctcaagaagagccgtctacaaacatttgaataaaaatactataacatcatcaactttcacttttacccttatcgctttgttaatttccttaacaaaaaatttttttcttattggataattccattcttgtagcatattttaaagatgtttaaagatttaaaaacaaatgttcattgttttgatactagattgccaaatttacaactctcttgttttgttacagataaaatatattgcacattaagtaggtgaataggccatagacatcagaagagaaaagaaaagaaagaaccttagtcattttataaagccttcacatggttgggaccaaccatatactcctgctttggtgagatgtttacctttgtaatgatttaggctttattcatatatttattttcaagattcagaagcacatgcgttcatatacatgctaaattataaaaaggatcctgttttggcaattaaacaagaagcaaaacaatgagaaaatgattatctaaaattagttcaatgttgttataaagtttacatcttgtagtcaagtatatagtacaacacttttattaaagtaagcagattttagccctatttggaaagaagctttttgcttacattaaatttcctaccaaagagctgaatactaaagactcacaaggatcaaactattttccaggcaaatatggaagtgattagctataacatttgcctctggaaaacttagtgaatatagaggtttcagccaaaattttctacttgttattattttatgctaactgcgagtttgttatttctttggtcttgtttttgaaattttccttctccccagaagaaaatgccaaacacaacttaagaaaagcttttaactgaaataaacagtaacacaacaacaaaacccccaacaaataaataaacattaaaaaagcaaaaaagcaccagtagttcaatttgcttatagctaacaagttaagaagcctgctttgggaaatgagacttaaatcgtaacagcagaaagtatgaaaaatgtagaatttaaaatatgaacttgatatttaaaacgatgattttcaaaatgttctgacccactcaactccctggagaataggtagaagaaaggcaaggttaaagagctttgtgttcatgggagttttttttttaaaaaagaaaaagaattttgaatatttacataatactagacagaggccaaggcatcctgccttctgttttgacaaacactgtattaaactgggttatgtgtgtcctttctctgatcatgcagaaagtaagccatgttggaaggctgaatgtttaagctcataaagtgacatgacagcctgccaaatgggctttttcctcttgtctcaggatggtggctgaggcacaaagctgagaaccaaaggcacaaagtaccccacattctaaacacaaaaagaggtaagcaacagaggtcagctgccactccccagagcatgttgggatatgcgagaactggccctgctaccgccatcttcacccccaggcaacataaggaaaaaaaaaaaaggataaaggaaggtgggtacatagtaggtgtatgtatttgttggggtacatgtgatattttgataaaggcatgcaatgcataataatcacatcatggaaaatgaggtgtccatcccttcaagcatttatcctttgtgttacaaacaatccaattttgctctctttgttatttttaaatgtgcaattaaattaatattgagagaatgcgatactcttgtagggtagagtgagtaggctttcttccttgaaaacaaggctataataatgtccatagatagctggcattcactgagtacttcttttgctctacgatgttaaatatattaactcattttattttgtttatttatttatttgagacgggtctcactctgttacccaggcaggttgtagtgcagtggcacagtcagctcactgcagccccaaacttctgcaatcctcctgcctcagcctcctgagtagctgggcctgcatgcatgcaccaccaagcctggcaattttttttttatagtgttagagtctcactatgttgcccaggctgttcttgaaatcctggcctcaagtgttcctcccacctcggcctctcaaagtgcagggattacaggcatgattcatggcacctggccaaaatattttcactcatttgaatatattttaatccttacaacaaatacacagcattcttattctcattcttcagatggggaatatgggacacacagaggttatgtaatgtccccaaaggccacagctagcaagatgggcagctggactttgaaatcaaactccagagtcaacaccttaggccactttgtaacctgcctcaagacactcacatgcagactgggggctcctgaagaaggggagatgctggagccagtggtgttgtcaagtgaacggcggtggtgacgccagatttttgttcttgccaccagttaatgtgaatttgacacagtaaccttttaattcataatccgctagcacccaaattctttaaaaaaagatacagcttaatagtatgctgtagaaaatcatgtgcctagtgcattgtttgcacaaattgctaggttgtatgtaattgggtgttttctaccatcagataaattagaattcagaaaataactaatttagtaataataaagtaacttgtaaataagaagaaaagatttatatttctacagattatatgtatgaatatttaattgttttcaatttaaggacaccaaaaacataaactttgaggtgaacaagttcttatatattttataccatattatatatatataaaacactatactttattggaatttttatgttatatattttatttattgagtatctgttcttagtagcctctccagtactatctccctatatgctaaaatataaagaacaattgaactgtgtttatattttatttcccctttttcttcttcatgcttgtaattaatatatgaaaaatattgttttaatctactgaattctgatttttttggcttttatatcaaaaaacagtcatctagaattcctatcatctgtcttattattataacagtattatatttataataattataatgttttttctgaagcatctctatatgactcttctaactcctgcttgtacagttaatcctgctctgaccttggcatcgtaatttccaagtaactgatttcttgccttattccttggtgaccccttacttcccaaagtctgctccccagcagtgtcaacacaaggactggatcttcagctcttgatatgatttggatgtgtgtccccaccaaatctcatgttgagttgtagttcccagtgtgggagggaaggcctagtgggaggcgattggctcatgggggtggagttgtcatgaatgttttagcaccatctctcttggtactctacagtgagtggtgagttctcatgagatctggtttttgaaacagtgtcgcacctcctccctctctttctcctgttcccaccatgtgagatgtgcctgcttctgctttgccgtctgccatgattgtaagttccctgaggcctccccagaagcagatgctgctatgcttcctttacagcctgcagaaccatgagccaattaaacctcttttctttataaacgacccagcctcattcatttcgttatagcggtatgagaacggactaatacagcacttaagcctcagtcttcccatgactggttgtagaggcctgggaacaaacatctgattagctgccccctgccatgattgacccttgagtctgtgccaataacctgctcagaatgtgttcaaatagaaaccccaagtcttgggcttggtttgaaatttggagtaatgatgatccactggcatctacgagttcctcgcccttgagatcagctttgtatgttcttttgggatcacttatctgtatgctcatcccttaaacgatagtccgtttgcttcccaagcccatttttacccgaactgtccctggttcctcttggctccagaggcactggccatcttcaggctatagccatccccactactgcagaccactggctctggcctctttctgatctctaagggccagagggagggcagttggatcaagatgctggccataagagaagcaggagcccagggcgaggagtctgagcagagggagataaggatcttggtagaaaaaaagggagcattttaagagtctcatgcgctacagtgtgagccagccaggtgccctgaagcattttatggaagcatagactctcacaactcctatatcctacacttgtatgattagaagcagaaaataaacatgtttctattcccataagattggcaactctttgacctctacagtctttcaattctagtcaaataggtgtccgaatttatatttgcttatcttgctattcctctccctatgaactaccttcctttcattcctgaatatgaggatctactatgtttcaggcactctaatagccaacagggagataaaagtacattaaatatcattctagacctcacagagtgcccagttaattgacctcaatagactcataaacagaaattacaatgtagcatggtagtgctagaatagacatatggacaaagtgctttcgctagcattctttttgtttctgacaatcgtcgtttactctaaaagataccttttacttctggaggaattcaagtgaacagttttccatagagaataatgatttgtgcagcaatgtgtgtaatgtgttgccagtttaaaatcatttagtttctggggagaaatacctcattgaaaggaacattatgaaatcagaaaatatacatataaaaaactactcttttattttccttagtaattctggttctttttcctttttctgctcctttattttttaccttatttgccaccctaatgcacattaggatttcagaagggaaaactgcatacatgcaacaaggaaagatacacaaacacaaagctcaaatgcaaaaattcccaattgtaatctgccatgtgtacacggattttttttttttttttgagacagagtcttattgtgttgcccaggctggagtgcagtggcacgatcttggctcactgcaacctgcgactcctgggttcaagtgattctcctgcctcagcctcccaggtagctgggactacaggcacctgccaccacgcccagctaatttttgtatttttagtagagatggggtttcaccatattggccaggctggtctagatctcctgaccttgtaatccgcccacctaggcctcccaacgtgctgggattacaggcgtgagccaccgcacttggctgtgtccatcagtatttaaacaatctattgtcctgatttcttattaaatgatataaattctcagatatttagcattcacattaaatgccctggcagagatagaaaaaagtaaagtgtcggctgggcacggtggctcacgcctgtaatcccagcactttgggaggccgaggcaggcgaatcacaaggtcaggtgatcgagaccatcctggctaacatggtgaaaccctgcctctactaaaaatacaaaaaaagtagccgggcctggtggtgggcacctgtagtcccagctactcgggagactgaggcaggagaatggtgtgaacctggtagacggagcttgcagtgagccaaaattgcaccactgcactcctgcctgggcgacagagcaagactccgcctcaaaaaaaaaaaaaaaagtaaagtgtgaaagaagacatttacaatagatataatgcttcatattgcttgttactgaaataggaaaagcctgaaataactagcaccatcactgtacatgggtgcataatgtaagttatagaaacacttaagaaaagtccattctgacctgcatactgcctcttgcttccaagatcaatgacagtattctcatctcctttatcaaggaactggacttcattctcctgcaaaagctgcttgatcttgacctgttgctgtttgacccgggtctcaagcaggcgcacctgggctctgagccgcatctgctcctgggcacagtcctcgagcgcctgcaaaacaggtgagatgagatgagtatgcacctcattttcatggaaaacaagtgctttttaaacatttggataaatcagtgattccattttgtctccagttcccatttcagaatattattccaaagagaaagtggcttgaaaagttctaatactgcctactatttgaagaattggaaattatggcttatgcgaaaactcctggactcaaaagatcaaataatataaaataattggaatcgctatgctaggagctttatagttgtctcctttgatcctcataacaattccatgcggtaggaaagggctcagtcttgatgcccagtgggtaagcggaggtgggattcaaattcagttcaaggactgtgctctcaatctctatatgacattgcttatgtgttttctaaacagtaatgtggtttatagaagttaattgtactgttggcatgtaaatctccataataaatgaggtttttgaatggctgtctggtataaatacttttaaatatgtatatttaatgtatattatatattatatatattatatatgcatataaataatatataatatatataatatataatatattaaacaatatataatatatagtatataatatattaaacaatatataatatatcatatataatatattaaataatatataatatatatcatatataatatattaaataatatataatatatctcatatataatatattaaataatatataatatatctcatatataatatattaaataatatataatatatatcatatataatatattaaatatataatatatatcatatgtaatatattaaatatataatatatatcatatgtaatatattaaatatataatatatatcatatgtaatatattaaatatataatatatatcatatgtaatatattaaataatatatatcatatataatatattaaataatatataatatatatcatatataatatattaaataatatataatatatatcatatataatatattaaataatatataatatatatcatatataatatattaaataatatataatatatatcatatataatatattaaataatatatcatatatatcatatataatatattaaataacatataataatatataatatattaaataatatataatataataataatatataatatataaaataatatacaatataataataatatataatatatattacaaaatatataatatgaatatatatgaatataaatgaatagatattatataatatataaatataaataatatataatatattaaatatatttatatataatataatgtaatataattgtatttattatattatagtctactttatataatatattatatttatacataatatacgtatatataaaattacataatggatttatatagtatatattatatcaaatacatatgcatatataatacatttatatttatatagtctataatatatatatattttttatatatatatatatgtagtacatctcccctccctcccatctctaggtccaagtcatggaacctctcccagccatttttctaggatggtttctcccttttccttccccttcccctttcccttcctcttcccttacgtttcctttctcagaacctctcccagatatcttttctaggatgatttctttctcctcttttctttttcttttcttttgttcttttcctctctttctccttccctccttccctcccttccttccttcctttcttttctttcctttcttcccatccctaggtccaagtcacagaacctctcccagccatttttctaaaatgatttctttctcctcttctttttcttttcttttgttcttttcctttctttctccttccctccctccctcccttccttcttttcttttctttctttcctttcttcccatccctaggtccaagtcacagaacctctcccagccatttttctaggatgattccttctctctctctctctctttctttcaacagagtcttgctctgttgcccaggctggagtgcagtggtgcgatctcggctccctgcaacctctgcctctctggttcaagcgattcttgtgcttcatcctggcaagtagctgggactatacaggttgtgtgccataacacccagctaatttttgtatttttagtagagatggggttttgccatgttgcccagtctggtctcaaacttctggcttcaagcgatccacccacctcggcccctcaaagtgctgggattacaggcgtgagccactgcaccaggcctctctaggattacttcttatttgttcttgttactctatccctaacactcagatttatcccttctgagatagttatttgcttagcaccttgagtcacataggctaaaaaatgaacagcaagaacattttatggtgtctgggtcctgagttgttttacaacagtgggggatcggttgtgatattgttaaacatagtgcactatgcaattttaaaataattgaagacatcacaggtcaagtatgcccaatctttatgagattgcatacgcatatttagtaagcttatttaaaacctaggagttttctttctccaagaactttgaatgaatgttttgtcttttttattcacaaatgaaggacaacacaagttcgatgtaattactttcaaataatctggttagttttacacttttcaatattgaaaagctcaaggttaattttaattactatggacagtttcaaatttctaatattccaaccaaataactccagtgaatttttaaaaattacttatttattatgaatactttttatttaaaaaaatgtaaagcactttttttttttttgagatggagtctcactctgtcgcccaggctggagtgaagtggcatgatctcagttcactgcaatctccgcctcctgggttcaagggattctcctgcctcagcctcacgagtagctaggactacagatgcgtgccatcacgcccggctaattttttgtattttttttagtaaagatggggtttcaccatattggccaggctggttgcgaactcctgaccttgtgatccacccatctcggcctcccctgcaaaaatgtaaagcgctttaaagtgctgctttactatgtgtccagtatttctaccagcctctttgcttttcccacatagttaagttttttcaatgacaagtcactataggtttaatgcaaaatgaaagaaaattcagataaaagcaggcattataaatatgacaatagttttcccaagaagcttaccgaaatttccctgcccattgtcagagcggtggtaacaaggatgaaactgaacacctttgccatgttcccccttgaaaaaactgcaagaacaaaaagaattttataaatgtatcaaccttgaatttttcatgagaccagagttcagacttcagtagctccaggaagtcggatgcagccgcaggccatccctaatcttagagtcgccgaggaaattctcccagactttcccagcctctcaccacacagaatgacactgagtgttaactagaattgaatctgtttcatcacaaaaacagaggaaggactctggttcttttcgctatcctaatgtgctgtttgtgttatgctgtggaaaggcacaggagcattttaatcagttatttaatgttacacatcaaggaagtggcgtagtcaaaatctgcacgctggtctctgcttatggagcttgtgtctttttctccctatgttgtgaggctggtctcaaactcctgggcttgagtgatcctcccgccttggcctcccaaagtgctgggattacaggcgtgagccactgcctagagtaagatttttgaaagcaaaggtcacaccttgctaattttggtatccctagcatttaattcttgtggtgaccccaataactgttgttgcttctacggaattattcctcaggaggcaaaatcgttctcagagggaaaaatgtaatttccttgctttaaactacagtctgtttatactgacatactttcctcttttactggaaaacaatgggctaagtatagttttgaaggtaagagttaagaaggagttggggacttttggtttgattgaacacatgaatttaattttttccttctcacaaagcccactagaaaatgagtgaagaaaaagtttaaaagatgcgaactgacaaagtcaaagagaaagggaaagaacagctagtgtgcaatgtcagcaagttggtagatgataaaaaggcatgtggggggcctggtgcggtggctcacgcctgtaatcccagcactttgggaggtcgaggtgggcagatcactcgaggtcaggagctcgagaccagcctggtcaacatggcgaaaccctgtctctactaaaaatacaaaaattagccaggcgtggtggtgggcgcctgtactcccagccactcgggaggctgaggcaggagaattgcttgaacccgggagatggaggttgcagtgagccgagatcgtgccaatgcactccagcctgggtgacagagtgagtccctgtctagaaagaaacgaaatgagaggagaagagaggagaggagaggagaggagaggagagaagagaagtaggggaattggcaaagcagcagtagagaggagcaccatgagaagcgagagaagtcacagtgtagcaccctaggggattctggattggaggcactgctagcttggaagtgaaggtagaggcaaatgggctaacagtcagatcctcatctaaatcctgtgcagccaggtgaatgctgcttctcgtaccctttcagaatatggaagatttactttctattaagattgcccagagatgctccaggtgacatgacagcagaagtgctggaggggaggagagagaccctgttcaaaaagggtgaggctttcccaggcttcttctcttgcagccaggcaaccggctctacactcttcctaccactttccaggccaaagaacataggattcctcgctggaggaacagcagagcttcaccgaaaagatcttcagagactgacattggaggattctccatcaaaggaggcttttccttgactgatcgctctccaaagaatcccaccagttgggaagcctccttcatgcacctgggagaggtataaaaggtataggcacactattctgcttatttctttcaacgtaagtcttctttctgaagagaggcatattttacatttcattctctgtccacatcaaatggtctaaagagaaacaccaaatttctgtattacaacactgggcagaaattcatatgatagcaattagtcatgacttaaccctttcacccaacactgtgaacaaaataaccaagatgggccgggcgtgttggctcacacctgtaatcccagcacttcgagaggccgaggcgggcggatcactgaggccagcatggccaacatagtgaaaccctgtctctataaaaatacaaaaaattagctaggtgtggtggtgggtgcctgtaatcccagcaaattgggaggctgaggcaggagaattgcttgaacctgggaggtggaggttgcagtgagccgagatcacgccactgcactccagcccaggtgacagtgcgagactccatctcaaaaaaaaaaaaaagtatctctagacccatttttccattaaagttatccttttaaacatatgatataatttgtagcaacaatttataagaactctggcatttcactctttattttatcttagtaaatattttttctttaaaattcaattgtatattgagtatgtacctatcttaggcccagtgatagaaatagtagtcttaggcccagtgatagaaatagtaatcttaggcccagtaatagaaatagtagatgtttttatatgtaatgtattaaatataattgattatattaaaatatttgcttatgttaaaaatagagaaaattaactttctgatatttaaaacatttaccaatgtgaaaaagagacaccctctgtgtatttttataaaagataaaatggggtgagaataggattgcaaaggaacagaagtcgtgaccaaattagaagaaaagatgattaggtttgctatcaattaatattcgctaattaatataataagcttggaattatttaaggaacacttttctaggtcacatttattattgtcatgaaaggtaaaatcattttctttaagataaaaacattgactgcactaaagagtcatcatttgcaatgcagtagtgtcctaaatctcttattcccagatgtcaagattatgtctacaaattaagaaaatttcaagttgaaataagtattctaaaccgaagacatctgatgttaggagcaaatacattttcattccgatcctgggggtagtttcatgttttcttttgtttttctttttttgtctgagggtccttgggaacactccttattcattgtggctgaattttttcaacatcagcattgaatactacaaaggattgtatcagatataaatcaatagtcaataattttattaagaagtaaaaaccatccatttaaactgaattacagtgggaaaatatatttgtaaagaaggcttagaaaataaacaataacaataaactagaatgagattatttcaagcatatattttctaactattcgtaggtaaagttttaaaaattgaatggattctagtcctctaatccctgtcactagaaaatgactgacctacagcatgctttagtatcttttcttcacaataagagaataatattttaataatgacacacaataattgctaaacaggcttgatgggacagtaagcgtagttccacaaagatgccaagcagcctgcgtggcctggggcattatataaaaatgagctagccattcaagtagaatgtacctctgcaaggctgcaatattacttacattaaagggcccatcatcaaggggacaagggctatttccccaagtctaacgtggattggaaaaataaggaatactcatctgaaaccatattgtgtttgtgtttgggcatcactaaacactctgccgaactttggctgggcgtggtggcttacgcctgtaatctcagcactttgggaggacgaagtgggaggatcgccagaggccaggagttcaagaccagcctggccaacatgataaaactccatcgctactaaaaatacaaaaattagccaggtgtggtggtgcacacctgtaatcccagctactcgggaggctgaagcatgagaatcacttgaacctgggaggcggaggttgcagtgagctgagattgtctcactgtagttaagcctgggtgacagagcgacactccacctcaaacaacaacaacactatcaaaacactatcaaattttaattggccattttattttatttcattagcctcacagtgaaaataagaaaacaagcacaaggatgcttatgatttctccaggaccattcagcctctggggatatcccctgggaatatctcccaaatctcctgaacctctttctttattgcctggttaatcctttcttactgtattatgttgaactataagaaatggcagatgtttgaacatttctgacttagaaaaatggcaatttcattgtttcaaattaatgcatattgtttagataggaagaacacacttgaaaatcattataaccatttatactacaatgaataccaaaaaaataggttcaaaatatactgtttgcagcttacttgatcagagagagaacaaattggcaagaacctgtttttatatcaatgctgcctcccatgttaatacattaatgtgtgccatttaaaatatgtttacaaaattgctaatacatcatcaacacatgaaatctcacgatgtctttagaagacacattatgtttactttttactaaaggaagctcaaatagtgaagcaaagtaactttcctaaggaaagactctacgttcaaaatttatacaacatccaatcatttctcaccacctctattgctaatgtctggcccaagctaccaatggaagattccaaacaattttttagaattacaatgagacaacattctatactgagcctttcctgggcaaaccgggatatttggtcattcaccgacaaagctttacataatctgtgagcatccacctcctcaacacatctcttttcccatcatttttgcctgttctggctacattggcctctttggcatttttggaaaaccctgaaatacacagacttctcagggcgattgcacttgctgttctctctacctggaatgctcttctgaaaatctctgtggtttgctccatgacatccttcaggtctttgctcaggtattcccttcccagagataccttccctgactaccacatataaaataacagctgtcccctactgtcttagtccattctcattttataaatttacccagtaaagatctgcctgagactgggtaatttataaaggaaaaaggtttaattgactcacagtttgccatgactggggaggccccaggaaacttacagtcgtggtggaaggggaagcaaacatgtccttcttcacatgatggcaggaaggggaagagccaagcaaaagccccttataaaaccatcagatctcaggagaactcactatcacgaaaacagcagcatgggggtagctgcccccatgattcaattaccttccactgggtccatcccataacatgtgggattacgagaactacaattcaagatgagatttgggtggagacacacgcaaacaacatcacccacacacttcatatctctatcacaatggattcagtttctccttagcacttatcaccaaatataatgaaatattataatatatgtgtttattgtctacctactccaaccgccctgtacaatgtaagcacgaagaggtgagtggctacatctattatgtatactgccctaatgctaggtggatagttaggtactgtactagtttcttgaggccaccataacaaattaccataaactgagtggcctaaaacaacaggagtttattatctcacagttctggaggatacaagtccaaaatcaagaagaacagggccatacttccttcaaaggctctaagagaaaatcctttctggactcttctagcatttggtggttgccagcaattcttgacatcctttgacttgtggcagtatcactctattctctgataccatcttcacatagctgtctttcctctgtgtgtctctgtgtctaatttccctcttcatataaggacatcggtcattggattagggtctgccctaatccagtatgacctcatcttaactcagttacatgtacaaagaccctatttgcaaatgagatcacattcacaggtaataaaagttaggaatgtacatgttttgggggcacagctgaacctagcacaggtactcgacaaaatatctactgaatagatgagaagaaaacttgtaaacctgaattagaattgtagaacttcccaggatctgttattgtaatttcacagttgcttatgggagatcaaattcttttgtgtctgttgaatttataagatgtctttatcagattccctccatcttcacccttccagcaacaacaaaaataactactcttaatgaattatgcttttcataaacttttttgtgatttgcaaatatgtcatgtcaatatgtaacagcttattttggttttaaaagagacatttggatttataaaatcccaaaagaaaatatatacctgaaaacataatacctaagatatttgaaagttggctctctcactgggccaaggtcattaccatagctatctcataataagtttttagtttgactcgtgttttcagttggcaataaatatgttttttgagcaaaattataatagctatgttgctttttaaatttgtacccttgtgtctttaactatctaattttaaaatttatcacaaaactcaagtagcataaaggaaaaaaataaatgcccttatgcaaatggcaatttcttaaacataaacaattgcatagtcacagacatacagtcataaagtatttttcatgttacagaaaataagaaacaaaaacattttattataaggaagcaaaagaaaataaagatggaaaacaaaatatttaaaaaatataaagagattttagaaatagccttgttccccgagactagaacatgcagagaaaatataattagaggaagtgacatcattcagtcaaatatcatcaacactagaggctcagagagggaaaattgtttgcctaaagaaataaaagagactttcactaagtatatttacactagtctgggaaatcagcataacgacatgacataaataccatttatttgtgactccaactcaaattgttcttctgactgaaaataaccaatgtatttaatagattactgattaggatttttccttgataaatgaaactgctaaggattagtagtaaaaataatgtcctctttttttatgtgacaggaaacaaattttcattattttaatccgctcccagataatattcaggagtcaaaaattaaaaatcatgaaatgtctgtatcttctagactttgctttaatgttatttgttgaaaaatttttttatttgattaaagttttcttatgcatttgtgggatcaagtactttatttcagaagtgaataaattagcttaaaaagttagagcttagccaggcgtggtggctcatgcctgtaatcccagcacgttgagaggctgaggcaggcagatcacttgggtcaggagtttgagaccagcatggccaacatggcaaaaccccgtccctactaaaaatacaaagaaattagccaggtgtggtggcacacaccttttatcccagctactgtgttggttgaggcatgagaattgcttgaacctgggagacagaggttgcagtgagccaagatcacaccactgcactccagcctgggtgacagagtgagactccatctcaaaaaacaaacaaacaaacaacaacaacaaaaaacacctagagcttaaaaaagaaattttctcattccaatgtttgattctggctcttgcataaatggaagtatgttttgaaaatgctctgaatgatgcacctatatatcatataattttacctacgcacactgtatatatacgtatatgtatgaacataacattattatacataatatgtatatattatagattatattatatatacattatataaggtatataaatattgcttagcattagatttagtaaaaaataaagggctaatgaaatttttttgacaggcctctgtctcttgatgtcctgaaatgtttatctcactaccattaagataatccaataatcaaaaaggcaccccctagtctggtagcatataaacaataaagcatttcaaaatgtaattatttacatttagaaagtcattatattactttgattagctttagaataattcctgagaatatcttaagttctctaaaattttccattttcctcctttgcaattctaaccaacattctctgtaatattgaagaaatgctaagcattaagaaacttgctttgaaattctggtctccatcattcattatagtaaaccattatttcttctgcacatctggcttacagtaaagttgtatcaaattattctgttcatttattgcacaattagttgtatttcttttataatatttttgccttaggcagtatcaaaacttttaattattataaaattaaaattgttatcaaatggctgttctttggtggactatattattttacataattttaatgctataaattctaattccttccccactatatttaaaaaaaatttaattaattacgctgcattaaatttaaagatgaagacattaaatttgtaaatgaaaagttctaaaaataatatataatttttaaaaacaattacaaaacagaagtacattagtagcatgcaaacatttcaaaactggtatgttttaagcaagcattgtaaaaggatatataaaagaaataaaaaggaaggaaaaagttattgaacgaagtatgtttaataagttagcattcacaaacgctataggactataatgcttaggactataacctaagtcagtgagttaaaaatgtacccataaacacaagcttagagactccttttaagctatttccttccaaattttttcctctttctgaaaatggaatataactgtgcttttgtatttttcttaagaatccatactcactgaaagccttacaaagctaaatatagttgatccctcaagaaatgcaataaagaaaaatgtttctgaagttttttgacttctgaagtgaaaattgtcatatagtccattttatttttaattttttatactgaaactgtaaacctatcatttacgtcaaactcccatgcaattcattcaaaatgtaaaggaaattatacaaagtgagactccatctcaaaaaaccaacaaacaaacgacaacaacaaaaaacgcctagagcttaaaaaagaaattttcttattccaatgtttgattctggctcttgcataaatggaagtatgttttgaaaatgctctgggtgatgcacctatatatcatataattttacctgcgcacactgtatatatatgtatatgtatgtacgtaacattattatacataattatgtatatattatagattatatatacattatataaggtatataaatattgcttagcattagatttagtaaaaaataaagggctaatgaaatttttttgacaggcctctgtctcttgatgtcctgaaatgttcatctcattaccattaagataatccaataatcaaaaaggcaccccctagtctggtagcatataaacaataaagcatttcaaaatgtaattatacatatttagaaagtcattatattactttgattagctttagaataattcctgagaatatcttaagttctctaaaattttccattttcctcatttgtaattctaacataccttatttgtatatctgtatatttgtatatctgtatatctgtaacaaaagatacataattctaaatctcttctccaagtagcagaagcagactccttgctagtcaacctgacttcttgcaaaagctaatggttgttacctgagttttggttactatcatacctgtgaaataaattagcattattacaagcatgtcaaaaatgcagagacattaaataacttgcctaaagtcagaagtgagtcagagacccagctcaggttccatccagacactctgcttcccaggatcctgtaactgcattgggaatttgtaatt

SEQ ID NO: 934 - DNA, 31015 bp, Homo sapiens
attaacacagtctacatttatttggtgaatattgcatatctgctgtactgaaagcacattaagtaacaaaggcaagtgagaagaatgaaaagcactactcacaacagttatcatgattgcgcatggatatgttcagaatgagtatttttcaaatcactttaaacaaagctgaattgcagaaacgaaagcccaacagcagcaattaaattacatttggaataaaatcatttggcctaattttcataaccacagatttcagagaataccaccacccatgccaggtgtaccagacaatcccattgtctgttttagccgtgtaggggccgctgtagtatacaccattcaggtttgcagagtgacacctagtggaagggagaaaaaaaaagaaaacaacaatcagactggaaaaatattgttcagaatcccttttattttgctacaaatgctcaaaatttttgaactatgaattctgccatttttcagacaagtaaatatttactagtttccaaaagctgagaaatttctacaacagatggctattgtattttattttttattttttaatttttttttaataatagagacagtgtctcactgtgttgccctggctggtctccaactcctgagctcaagcaatcctcctgcctcagccttccaaactgctgggataacaggtgtgagccactgcgcctggcctcagagatgggtattttaaaatggtgagttttactgccattacaaatctgaaaatacaacccaggccactcacagtgcattgaaaaataagcatttcaatttttgattttctttaaacaaaaaattaaaacaagcaaacaaaaacgcatccttgtaacctccagccttacaacctcctgactcagaacagtgttaatttcatacttaacaagagctaaggtgagtgtcagcaaagcaagtcgtgggcaaggtgctctactactggctttcctggataatttgcactcacacgttcattcctctgctgctaagacttagctttcataattcaaactccgtatgtccccttctttaaattgctagcctatcagttatttcaatctcaagggtaagcaaacaaacctaaatcaccatttaaagttttgccacccatcaaccaataatcattttttcctagttgctgagttaattttttacatatattgcaccaatctagataagctggttaggttatcgacaatataaaaatgtttctttcctcctttggagtctgtaaattttgtccttgatatgtataatttacatgtaacagtatgcaataagtttatgtgtgttgttatgaaattaattgccatatacttctttattgataaaattaatgaaaagatgtcagaattaggatagaaggagaacattcacaagaggtagttctgaacatctatggaaaaacccaaattattgaatcaaaaaagcatataatctacccgtaaaggctgagtggctggcttgaatcacttatcagcttaatgattcactcctactgagcgttctcgaagtcctcctaacttaaatggacgtaattaattgaaaatatgtatgtcaagtctgcaaatgtcaaagcctactgtgtttttaaaacagcatggaaagtaatgttaaaaaaagaaaatactgtaaattgagtctccagaatatatattttggcatatatttgtctatctagagacatctgctaactatatttttatatttggtctatcatttgaatcccattaggaaactgactctgtgatgaacataagaaaccttcactattctgagaccagttttctagcatcgtttagtttttagaacagcctggatttgaaactaggttaggggatgattgggtcttccttggtgaagaagtggctgtgaacactcacgtgaaatgctacactaacaaagaaaagacatcaactcgcagtgattggtttgctatgtggaaaaaaacattttataggtgggtaatatttatgaagtgccaacatttcatgtaaattagaagaactatgggacagaaaaaaagcaacagtaagaaggaagaaaagatgatagtcgaactcactgatagtaggcatggtagaagtagcaccaagtttctaaaacaatctactttctctcccttaatgcctactgattttccaattgcacagccttatcaacccctttgattccaaggataatgtgggctctgtggcaggctccacctaatgaatggcctttctttgtgctccctgaacccatttctttaaagtcaggtaaatcgttcctttgcccacattaatatacatggtagttttcattcagatgccttagaagccagtcagctggataaagtacatggttttgatctcaggatactattagtaattatttctgtatatggaattgttttcaaaatcaaacattggtgatgcttgcagatgacttcatgaattacacgttaagttttatgtcatgctgacttagaagaacaagggggaaagaaaggagtaggaacaggtgaagaagacggtttttaaaataacaggaaaaccactaaggaaaacaccatcatcaccttcaatttgcaaagcaggagagtgaaatttgtttctctccttcacactgctggaaatactccagttcctttataaatgatcaaatcttaaatggactcaaatgtttttttaaaaaagcaaaatatagaaaagatgactatttttacaacagcagtagtactcccttatctgcaggggatacgttctaagacccctagtggatgcctgaaactacagataataccaaattctatatattgatactatgctttttcagtctgataaccgaaacagctacgaagtgagtaacgagcagataaagaaaataaaatttaccaaactgaaagacatgatatagattcaaaagaaccactgagtacccactgcagtaaaccaaaagaagaccacgacagtgtatgtcactgtaaaatttcagaacgctagggggaaaaatcttttgggtgtaggaaggaaaaaaaccatctatagtagttctctgttttttcctataatatacatacctatgacaaagttaatttataaattagacacagtaagagattaacaacaactaataataaaagattatgattatataacaatatgtcagcattacagctcttgtgctttgggaccattattaaatcaaataagcatgattcgaacacgagcactatgaaactccaacactggatctgataactcagacttctactaagtgtcttggggcagggagggctttcagcgtggatacgctagacagaggggtgacccacctcctgggcagaaagaatccaatggtgcgaatctctgctcagaatgacatgcaatttaaaacttatgaattcggcagggtgcggtggctcacgcccaacactttgggaggccggggtaggtggatcacatgaggccaggagttcgagacctgcctgggcaacatggcaaaaccccatctctaccaaaaatgcaaaaattagcccatgtaccccagaaatatataaaatattttgtatcagtaaaaaaagaagcaactatatacaatcaaaaacggaatgaatttgctgataaagtaacatgaatgtattcagtcagagggtagaattaggtttctggattattgtaaaggaaatttctgtattgggagaggcttagactcaatgaattaatgaaagccatagtgattgaaaagtagtactatacagaagcattacagcaataacggtggctcttttgtgtgatatggtcaggtgaagaactagttggttattaggatgccaaatagtctccatatatatacatgctctctctttctttgtgtgaatttgtggccttctatttataactcatccataattcagtttgcaaatgatctttgtaaaagtaataatttatttctatgacatttacactttactaatgtacacaatgaacaaatcctcaaaacgacttcattgctgaagaattctaatgagaatgattacttaataatactaatattataaataaagactaacattaccatacatattatattgataattaatgtctatcagtgagatatcatcaactccattacaactatgctcataagacatcaaacctgttaaaccaccagccagactgatcttcttctgcgcagttcccttcatagttgtcatgatctctgtcccacgtgctgaatttcattctttggtgactagcccaccactgcacctcaggatgaaaattccccgcaagggaatctccagctgttccagaatattccccaatattcaactcgtagaaattctaaagaaaaagggcatttctgctgtcagtggagttcctctatgaccattttaaaattaagtttatttcataaacaaaagaacaggttctattgtatatttttatttccactgactccagggttatattgcacattttaagcatttattcacggttttacttcttagaaaattgtagtaccttttcatctccaactttgaaattcttatattgtgcataacggctatttttttcaaaatctgcaaggtcgatttttaaagtgtagtcttctaaaaaagaaacaagcaattataatttttaaaaatgtgtgacatgacacggactactgcggtttaaaaataattcacagctctattttaattttaccatttcccttggccaagaatcagttttcaaagattaaacagtgactcctttgtatatataacatgaacattttatcgtgtaatttatttgaaaaaaaatgatggatacaatattaaatttaaaaaatgtctactagatctcttagaggtaaaacctagtgcaattcactgaataatgaacaacagaaaaaataagtgattacttaaagcaatctaacaatgaaagggtcgacgttttacctttaatagtttgacctctttttcttgatttcagtaagaatgttgatcttgaatataaatggtggctattaatgacattgtgtaatctctagtagctgagccactaggtttgtaaaatgtagttgccattgcctgcatatgcctgaacttggttattttcctgatagcataaaagatcagccaggaaaccctttaagaataatttgaggaagaaatatgaatcctaattgttatccgaaaaccttcgtttgatactggctcataagatcaagagactcttagcatcaaagtatgtagagtggatgtcattggaagagaatttcagaggcaataaggaaacattctggagaaatgctgtaccaccaacattctcaatggcagagatgatgataattactggaaaatatactaacatcaatgactctgagtaaaaaggtatttctgaagaactgatatctacatgtgaaagcattttaagaatgcaatggggccggggcggtggctcacgcctgtaatcccagcactttgggaggccgaggcgggcggatcacgaggtcaggagatagagaccatcctggctaacactgtgaaaccccgtctctactaaaaaatacaaaaaattagccgggcatggtggcgggcacctgtagtcccagctacttgggaggctgaggcaggagaatggcgtgaacccagaaggcagagcttgcagtgagccgagattgctccactgcactccagcctgggcgacagagcgagactccgtcgcaaaaaacaacaaaaaaacaaaaaaaagaatacaatgtattgggtacatattatcttttatatatgctaaagaatgatatatgatgacaaaaaatctctaaacattaaagatatactttaatgactgtaaaaattctaggcgatataagagcattatgtttttaaaatgattaaaataattgctaccttcaagtaatcttttttttcccattgtttggaaataacaaagactattcctttttcagaaacagaactcttgtcaggggcaccaaatgttataaatcaaattattagatcacatgtgttctatcctcctactttgataaataagatataacaatgacctgtaaggtcgggttagaatttagagcctcactttccttggagtttcaagccagaccatggaggcactgggaaagagagtccctgaatagtcctatcacctaggccccatctctggttggcctcttctctctttccatccccatctccatcacttatagcaaggggctttggatccacttgtggacatcccaggctgcatatccaagttctattcacacccaagttgggtggattacaaggtcaggagatcgagaccatcctggccaacatggtgaaaccctgtctctattaaaaatacaaaaattagctgggcatggtggcacgtgcctgtaatcccagctactcaggaggctgaggcaggagaattgcttgaatccgggaggcagaggttgcagtgagccgagatcgcgccactgcactccagcctggctacagagtgagactctgtctcaaaaaaaaaaagccattttttagcctcccctcaagcttaagggtgcacacaccaggacgagaacatcctgaaggagtcctataaacaaactcaaggctgttggggcagggaatgctggattcctcaagactggagtccctttaagaggtgatgcgggcctctcttgggcttgttgatttagcaccacaatttccttgccccagggagctctctcaaggtagtaaaggtcacaggagaaaagactgtagagtgtataagagcagcaaggcaggctaagtcaactgtctttaaaaatattctattacagacgagatgcggtggttcatacctgtaattcaagcactttgggaggctaaggcacgcagatgacttgaagccaggagtttgagaccatcctggtcagcatggtgagaccaccgtctctactaaaaatacaaaaattagctgggtgtggtggtgtgcgcctataatcccagctactcaggaggctgaggcatgagaattgcttgagccaagagtcagcggttttagtgagccaaggctgtgccactgcactccagcttgggcaacaggcaaaaatctgtctcaaaaaaaaaaacaaaaaaaaaaaacttctattataacagagacataaagactcaattttttggctaacattgaaatgtctctttgttcaataagtaaacaaattatatttaccatttctaaatcaattttattgccactacttctagttgagatttatgtagtggggataaagctattctcagaggtaattcattaattcattagccgtaatgctctcataattaaagaatgcagagacaaaaacactggctattgtctggattgatgggatacgtgggtgggggcccaggaactgaaaaacacgttttttctccaacgagattagccagcctgagtaccaagttgatatatgaaaaggaacaggtttgttggcaaagttcctctgggaaaatatgtacatcataataacttaaaaaataatacgtttgaatttcatatatttagaaagagccaagggttactgctctggggttttcatagtttcaataagaaaccagataaatatcaatgtgcaaatgaaacagaagttggtatggcaaattttatatatctggcataaaacacttaaaactagaataatagatatgttgaaggaaaggaagcgttatgtaaatttagagagcactgatcataagaaggacatacaaagaaagtataaggtttctaggattactcatcctgtctaatgtttatcattctagtgtctcaaagaactttataaccataagcctactactataaatatagaaacaccaatagctttccagaacttggatggaacaaaggaacttttgttttatcttaattactttattattattattatttgagacagagtcttgctctgtcacccaggctggagtggattggcgcaatcttggctcactgcaacctccgcctcttgggttcaagcaattctcctgcctcagcctcccaagtggctgggattacagtgctgtgccaccatgcctggctaatttttgtatttttagtagagatggggtttcaccatgttggccaggctggtctcgaaatcctggccccaaggggtccacccacctcagcatcccaaagtgctgggattacaggcatgagccaccatgcccagctgtttatttttaatgcaattgcagtgtaacttagcatgcttttttgggcattacagttgccttttatgaaggattcaggatcagacttgagtgggactgatgataatctcagactacaacagaggtagggaagacaatggattggagcaaaagaacatgggagatagaagctgggaaaagtcgttatcaaaacaatgatattttagacaaatattaaactctaaagataagaatttaaaagtatatagggagacatccagatgtctgctatttactttgaaatatatatacagaaaagatggattgatggacggattgagtaatgggcaaacggatagatacgtaacaaaaacaagcaaagtaaaatgttaatgtaggatacaggtggtaggttgaaacttctttcaaattggttgcagctttgaaaaaatttcagcattaaagatgagatgtatgtggaaacatggacatttcatatattatagtgttttattggaaaaatagcaccaattgcccaattgttcacctctctctcataatatgtcttcatagctcctcctattgtttacttccttttaaaaaaaagtctgagctgctcctgtgatttgctttcaccaatagaagaaaaatgactccatgccaattctgggcctagatctcaagagacttatatacatccactcttttttgtggaaccctgcctgtgctacaaaaacaagtccaggctagctagctggaagatgagagaccctatggagccaggttgaatccttccatcccagagcagcaacttcagtgaggaagttgatggcagactcataagcaagcccagccatgatcagcagagcccagccctgatcagcaaaatcacccagccaacctgcagatttgtgagaagtaataaatggttgttgattttaagccactaagctttggaagaggattgttacacgttattattgtgacattaggtaactgatacagcatatataatctccaggaactcaaggcatcaaaaaggaataattatgacattatatatccttttcagaagtagaatatatatatattctatatatatctatagatacatatagcgacttatattctatatatctatatatagctacatatatactatgtatagaatgtatatatatctataaatatatttagatatttctcataaatatatatgtgaaaacaattccccgcaacccaattctagcttttttttctgtttctaattttaggcagccacattttacatttgggattattgcccaaaagttatcactgccatctgcaaatcatagcaattattgaattagttccattgcctataatttggttaaaaaaaaattttagtgttgtttttattatatttcaaataaatctgacatcattcaaaccttaccttgagtggtcaagaagtgaagatttttattgcccagccaatattcaccatgtttttggacaaaatttccaaagccattttcatagtctttccatcctctaaaaaaggtaaagtggaagccgattagagcaaactccatttgtggtaccaaagcgaccaccacccaccccctgctaccaccacctccaatattttcttgattagttaattcattttcagtattcttctttagagagattgaaattctgtctaattaataggcttcaggatatgatcaaaatatttgacttataaatctcacatttgctgctacatataaagtcttacatcataattagcacacctgttaaagttttcactgccatcagatcgtctctgaattacagtccatcctcctccatcggacatgtcacaataaacagaaaattctgctgggctctggagaggtttgattttgtaaaatccactgagcttatacccatcattgaaaatctctgaacaatctgtttttaaaacaaggtaatgtaacattcattatgtgtctttttctccccccgccttagggagcctctgaatgagactactcagtatcactggagacagataacacatggtatagaaatcagcgttttaaaattgcatcttgtacatcttccagtggatattaggaaagttttatttcctttgctaaaatttgccacctgaatccttgatataatcatcgaggaaaaaaggggagtgaaataagaatctagttttttgtttctttcttcttttttcttttacattttttttaagaaatgggggcgtgtcactatattgcccaggctggtctcgaactcctggcttcaaacaatcctatcctcccaccacagactcccaaagggctgggattacaggtgtgagcttagtttctaatttctgagttttgtagaaaacaatcttaaaaaaaacaagttatgagtagtctgttaataacagtatatttaggtggaacttacagttttatcagacggaatagtaaaatttatctcacccatgaagctaaaatgaaagcagaaatgttaacaccaaagttactacaggttatcctgacttagagcatgataaatcattctggacatctgaaaatgaacccaaaatagtaatcttgtaaaaatctttattattatactttaagttctagggtacatgtgcacaacatgcaggtttgttacatatgtatatgtgtgccatgttggtgtgctgcacccataatcttgtcaaaatcttataatctcttagccttattagattttttactaacccactgaagtttctaaaagtccatacattcttagatgtttttgctaaaaactgcaagcttctgctattcttttcatcccttaattcttttttgctgtggtatttctttgaacactgaagcaaatgtagctacccctttgtcaccaaaaagtgatatctctttctttctttctttctttctttctttctttctttctttctttctttctttctctttctttctttctttctttctttctttctttctttctttctttctttctttctttctttctttctttctttctttcttttcctttgagacagagtcttgctctttcgcccaggctggagtgcaatggtgctatttcggctcactacaacctccgcctcccgggttcaagcgattctcctgcctcagcctcctgagtagctgggatcacagccacgcacctacacacctggctaatttttttgtatttttagtacagactggattttgccatgttggccagactggtctcaaactcctgaggtcaggccatccgcccgcctcggcctccaaagtgaaaggatgacaggtgtgagccaccacaccctgccaaatggtgatgtctgttccttaagccacttgagggtgatgtaaattaatacccattgggtctcacctaggttgatctgtacagacttagagaacgtggcaaatggggacctctctattgttcagatgcatagaaagctaggttttaggatgattgaagtagtggtcactataaacaatctcaagaagagccgtctacaaacatttgaataaaaatactataacatcatcaactttcacttttacccttatcgctttgttaatttccttaacaaaaaatttttttcttattggataattccattcttgtagcatattttaaagatgtttaaagatttaaaaacaaatgttcattgttttgatactagattgccaaatttacaactctcttgttttgttacagataaaatatattgcacattaagtaggtgaataggccatagacatcagaagagaaaagaaaagaaagaaccttagtcattttataaagccttcacatggttgggaccaaccatatactcctgctttggtgagatgtttacctttgtaatgatttaggctttattcatatatttattttcaagattcagaagcacatgcgttcatatacatgctaaattataaaaaggatcctgttttggcaattaaacaagaagcaaaacaatgagaaaatgattatctaaaattagttcaatgttgttataaagtttacatcttgtagtcaagtatatagtacaacacttttattaaagtaagcagattttagccctatttggaaagaagctttttgcttacattaaatttcctaccaaagagctgaatactaaagactcacaaggatcaaactattttccaggcaaatatggaagtgattagctataacatttgcctctggaaaacttagtgaatatagaggtttcagccaaaattttctacttgttattattttatgctaactgcgagtttgttatttctttggtcttgtttttgaaattttccttctccccagaagaaaatgccaaacacaacttaagaaaagcttttaactgaaataaacagtaacacaacaacaaaacccccaacaaataaataaacattaaaaaagcaaaaaagcaccagtagttcaatttgcttatagctaacaagttaagaagcctgctttgggaaatgagacttaaatcgtaacagcagaaagtatgaaaaatgtagaatttaaaatatgaacttgatatttaaaacgatgattttcaaaatgttctgacccactcaactccctggagaataggtagaagaaaggcaaggttaaagagctttgtgttcatgggagttttttttttaaaaaagaaaaagaattttgaatatttacataatactagacagaggccaaggcatcctgccttctgttttgacaaacactgtattaaactgggttatgtgtgtcctttctctgatcatgcagaaagtaagccatgttggaaggctgaatgtttaagctcataaagtgacatgacagcctgccaaatgggctttttcctcttgtctcaggatggtggctgaggcacaaagctgagaaccaaaggcacaaagtaccccacattctaaacacaaaaagaggtaagcaacagaggtcagctgccactccccagagcatgttgggatatgcgagaactggccctgctaccgccatcttcacccccaggcaacataaggaaaaaaaaaaaaggataaaggaaggtgggtacatagtaggtgtatgtatttgttggggtacatgtgatattttgataaaggcatgcaatgcataataatcacatcatggaaaatgaggtgtccatcccttcaagcatttatcctttgtgttacaaacaatccaattttgctctctttgttatttttaaatgtgcaattaaattaatattgagagaatgcgatactcttgtagggtagagtgagtaggctttcttccttgaaaacaaggctataataatgtccatagatagctggcattcactgagtacttcttttgctctacgatgttaaatatattaactcattttattttgtttatttatttatttgagacgggtctcactctgttacccaggcaggttgtagtgcagtggcacagtcagctcactgcagccccaaacttctgcaatcctcctgcctcagcctcctgagtagctgggcctgcatgcatgcaccaccaagcctggcaattttttttttatagtgttagagtctcactatgttgcccaggctgttcttgaaatcctggcctcaagtgttcctcccacctcggcctctcaaagtgcagggattacaggcatgattcatggcacctggccaaaatattttcactcatttgaatatattttaatccttacaacaaatacacagcattcttattctcattcttcagatggggaatatgggacacacagaggttatgtaatgtccccaaaggccacagctagcaagatgggcagctggactttgaaatcaaactccagagtcaacaccttaggccactttgtaacctgcctcaagacactcacatgcagactgggggctcctgaagaaggggagatgctggagccagtggtgttgtcaagtgaacggcggtggtgacgccagatttttgttcttgccaccagttaatgtgaatttgacacagtaaccttttaattcataatccgctagcacccaaattctttaaaaaaagatacagcttaatagtatgctgtagaaaatcatgtgcctagtgcattgtttgcacaaattgctaggttgtatgtaattgggtgttttctaccatcagataaattagaattcagaaaataactaatttagtaataataaagtaacttgtaaataagaagaaaagatttatatttctacagattatatgtatgaatatttaattgttttcaatttaaggacaccaaaaacataaactttgaggtgaacaagttcttatatattttataccatattatatatatataaaacactatactttattggaatttttatgttatatattttatttattgagtatctgttcttagtagcctctccagtactatctccctatatgctaaaatataaagaacaattgaactgtgtttatattttatttcccctttttcttcttcatgcttgtaattaatatatgaaaaatattgttttaatctactgaattctgatttttttggcttttatatcaaaaaacagtcatctagaattcctatcatctgtcttattattataacagtattatatttataataattataatgttttttctgaagcatctctatatgactcttctaactcctgcttgtacagttaatcctgctctgaccttggcatcgtaatttccaagtaactgatttcttgccttattccttggtgaccccttacttcccaaagtctgctccccagcagtgtcaacacaaggactggatcttcagctcttgatatgatttggatgtgtgtccccaccaaatctcatgttgagttgtagttcccagtgtgggagggaaggcctagtgggaggcgattggctcatgggggtggagttgtcatgaatgttttagcaccatctctcttggtactctacagtgagtggtgagttctcatgagatctggtttttgaaacagtgtcgcacctcctccctctctttctcctgttcccaccatgtgagatgtgcctgcttctgctttgccgtctgccatgattgtaagttccctgaggcctccccagaagcagatgctgctatgcttcctttacagcctgcagaaccatgagccaattaaacctcttttctttataaacgacccagcctcattcatttcgttatagcggtatgagaacggactaatacagcacttaagcctcagtcttcccatgactggttgtagaggcctgggaacaaacatctgattagctgccccctgccatgattgacccttgagtctgtgccaataacctgctcagaatgtgttcaaatagaaaccccaagtcttgggcttggtttgaaatttggagtaatgatgatccactggcatctacgagttcctcgcccttgagatcagctttgtatgttcttttgggatcacttatctgtatgctcatcccttaaacgatagtccgtttgcttcccaagcccatttttacccgaactgtccctggttcctcttggctccagaggcactggccatcttcaggctatagccatccccactactgcagaccactggctctggcctctttctgatctctaagggccagagggagggcagttggatcaagatgctggccataagagaagcaggagcccagggcgaggagtctgagcagagggagataaggatcttggtagaaaaaaagggagcattttaagagtctcatgcgctacagtgtgagccagccaggtgccctgaagcattttatggaagcatagactctcacaactcctatatcctacacttgtatgattagaagcagaaaataaacatgtttctattcccataagattggcaactctttgacctctacagtctttcaattctagtcaaataggtgtccgaatttatatttgcttatcttgctattcctctccctatgaactaccttcctttcattcctgaatatgaggatctactatgtttcaggcactctaatagccaacagggagataaaagtacattaaatatcattctagacctcacagagtgcccagttaattgacctcaatagactcataaacagaaattacaatgtagcatggtagtgctagaatagacatatggacaaagtgctttcgctagcattctttttgtttctgacaatcgtcgtttactctaaaagataccttttacttctggaggaattcaagtgaacagttttccatagagaataatgatttgtgcagcaatgtgtgtaatgtgttgccagtttaaaatcatttagtttctggggagaaatacctcattgaaaggaacattatgaaatcagaaaatatacatataaaaaactactcttttattttccttagtaattctggttctttttcctttttctgctcctttattttttaccttatttgccaccctaatgcacattaggatttcagaagggaaaactgcatacatgcaacaaggaaagatacacaaacacaaagctcaaatgcaaaaattcccaattgtaatctgccatgtgtacacggattttttttttttttttgagacagagtcttattgtgttgcccaggctggagtgcagtggcacgatcttggctcactgcaacctgcgactcctgggttcaagtgattctcctgcctcagcctcccaggtagctgggactacaggcacctgccaccacgcccagctaatttttgtatttttagtagagatggggtttcaccatattggccaggctggtctagatctcctgaccttgtaatccgcccacctaggcctcccaacgtgctgggattacaggcgtgagccaccgcacttggctgtgtccatcagtatttaaacaatctattgtcctgatttcttattaaatgatataaattctcagatatttagcattcacattaaatgccctggcagagatagaaaaaagtaaagtgtcggctgggcacggtggctcacgcctgtaatcccagcactttgggaggccgaggcaggcgaatcacaaggtcaggtgatcgagaccatcctggctaacatggtgaaaccctgcctctactaaaaatacaaaaaaagtagccgggcctggtggtgggcacctgtagtcccagctactcgggagactgaggcaggagaatggtgtgaacctggtagacggagcttgcagtgagccaaaattgcaccactgcactcctgcctgggcgacagagcaagactccgcctcaaaaaaaaaaaaaaaagtaaagtgtgaaagaagacatttacaatagatataatgcttcatattgcttgttactgaaataggaaaagcctgaaataactagcaccatcactgtacatgggtgcataatgtaagttatagaaacacttaagaaaagtccattctgacctgcatactgcctcttgcttccaagatcaatgacagtattctcatctcctttatcaaggaactggacttcattctcctgcaaaagctgcttgatcttgacctgttgctgtttgacccgggtctcaagcaggcgcacctgggctctgagccgcatctgctcctgggcacagtcctcgagcgcctgcaaaacaggtgagatgagatgagtatgcacctcattttcatggaaaacaagtgctttttaaacatttggataaatcagtgattccattttgtctccagttcccatttcagaatattattccaaagagaaagtggcttgaaaagttctaatactgcctactatttgaagaattggaaattatggcttatgcgaaaactcctggactcaaaagatcaaataatataaaataattggaatcgctatgctaggagctttatagttgtctcctttgatcctcataacaattccatgcggtaggaaagggctcagtcttgatgcccagtgggtaagcggaggtgggattcaaattcagttcaaggactgtgctctcaatctctatatgacattgcttatgtgttttctaaacagtaatgtggtttatagaagttaattgtactgttggcatgtaaatctccataataaatgaggtttttgaatggctgtctggtataaatacttttaaatatgtatatttaatgtatattatatattatatatattatatatgcatataaataatatataatatatataatatataatatattaaacaatatataatatatagtatataatatattaaacaatatataatatatcatatataatatattaaataatatataatatatatcatatataatatattaaataatatataatatatctcatatataatatattaaataatatataatatatctcatatataatatattaaataatatataatatatatcatatataatatattaaatatataatatatatcatatgtaatatattaaatatataatatatatcatatgtaatatattaaatatataatatatatcatatgtaatatattaaatatataatatatatcatatgtaatatattaaataatatatatcatatataatatattaaataatatataatatatatcatatataatatattaaataatatataatatatatcatatataatatattaaataatatataatatatatcatatataatatattaaataatatataatatatatcatatataatatattaaataatatatcatatatatcatatataatatattaaataacatataataatatataatatattaaataatatataatataataataatatataatatataaaataatatacaatataataataatatataatatatattacaaaatatataatatgaatatatatgaatataaatgaatagatattatataatatataaatataaataatatataatatattaaatatatttatatataatataatgtaatataattgtatttattatattatagtctactttatataatatattatatttatacataatatacgtatatataaaattacataatggatttatatagtatatattatatcaaatacatatgcatatataatacatttatatttatatagtctataatatatatatattttttatatatatatatatgtagtacatctcccctccctcccatctctaggtccaagtcatggaacctctcccagccatttttctaggatggtttctcccttttccttccccttcccctttcccttcctcttcccttacgtttcctttctcagaacctctcccagatatcttttctaggatgatttctttctcctcttttctttttcttttcttttgttcttttcctctctttctccttccctccttccctcccttccttccttcctttcttttctttcctttcttcccatccctaggtccaagtcacagaacctctcccagccatttttctaaaatgatttctttctcctcttctttttcttttcttttgttcttttcctttctttctccttccctccctccctcccttccttcttttcttttctttctttcctttcttcccatccctaggtccaagtcacagaacctctcccagccatttttctaggatgattccttctctctctctctctctttctttcaacagagtcttgctctgttgcccaggctggagtgcagtggtgcgatctcggctccctgcaacctctgcctctctggttcaagcgattcttgtgcttcatcctggcaagtagctgggactatacaggttgtgtgccataacacccagctaatttttgtatttttagtagagatggggttttgccatgttgcccagtctggtctcaaacttctggcttcaagcgatccacccacctcggcccctcaaagtgctgggattacaggcgtgagccactgcaccaggcctctctaggattacttcttatttgttcttgttactctatccctaacactcagatttatcccttctgagatagttatttgcttagcaccttgagtcacataggctaaaaaatgaacagcaagaacattttatggtgtctgggtcctgagttgttttacaacagtgggggatcggttgtgatattgttaaacatagtgcactatgcaattttaaaataattgaagacatcacaggtcaagtatgcccaatctttatgagattgcatacgcatatttagtaagcttatttaaaacctaggagttttctttctccaagaactttgaatgaatgttttgtcttttttattcacaaatgaaggacaacacaagttcgatgtaattactttcaaataatctggttagttttacacttttcaatattgaaaagctcaaggttaattttaattactatggacagtttcaaatttctaatattccaaccaaataactccagtgaatttttaaaaattacttatttattatgaatactttttatttaaaaaaatgtaaagcactttttttttttttgagatggagtctcactctgtcgcccaggctggagtgaagtggcatgatctcagttcactgcaatctccgcctcctgggttcaagggattctcctgcctcagcctcacgagtagctaggactacagatgcgtgccatcacgcccggctaattttttgtattttttttagtaaagatggggtttcaccatattggccaggctggttgcgaactcctgaccttgtgatccacccatctcggcctcccctgcaaaaatgtaaagcgctttaaagtgctgctttactatgtgtccagtatttctaccagcctctttgcttttcccacatagttaagttttttcaatgacaagtcactataggtttaatgcaaaatgaaagaaaattcagataaaagcaggcattataaatatgacaatagttttcccaagaagcttaccgaaatttccctgcccattgtcagagcggtggtaacaaggatgaaactgaacacctttgccatgttcccccttgaaaaaactgcaagaacaaaaagaattttataaatgtatcaaccttgaatttttcatgagaccagagttcagacttcagtagctccaggaagtcggatgcagccgcaggccatccctaatcttagagtcgccgaggaaattctcccagactttcccagcctctcaccacacagaatgacactgagtgttaactagaattgaatctgtttcatcacaaaaacagaggaaggactctggttcttttcgctatcctaatgtgctgtttgtgttatgctgtggaaaggcacaggagcattttaatcagttatttaatgttacacatcaaggaagtggcgtagtcaaaatctgcacgctggtctctgcttatggagcttgtgtctttttctccctatgttgtgaggctggtctcaaactcctgggcttgagtgatcctcccgccttggcctcccaaagtgctgggattacaggcgtgagccactgcctagagtaagatttttgaaagcaaaggtcacaccttgctaattttggtatccctagcatttaattcttgtggtgaccccaataactgttgttgcttctacggaattattcctcaggaggcaaaatcgttctcagagggaaaaatgtaatttccttgctttaaactacagtctgtttatactgacatactttcctcttttactggaaaacaatgggctaagtatagttttgaaggtaagagttaagaaggagttggggacttttggtttgattgaacacatgaatttaattttttccttctcacaaagcccactagaaaatgagtgaagaaaaagtttaaaagatgcgaactgacaaagtcaaagagaaagggaaagaacagctagtgtgcaatgtcagcaagttggtagatgataaaaaggcatgtggggggcctggtgcggtggctcacgcctgtaatcccagcactttgggaggtcgaggtgggcagatcactcgaggtcaggagctcgagaccagcctggtcaacatggcgaaaccctgtctctactaaaaatacaaaaattagccaggcgtggtggtgggcgcctgtactcccagccactcgggaggctgaggcaggagaattgcttgaacccgggagatggaggttgcagtgagccgagatcgtgccaatgcactccagcctgggtgacagagtgagtccctgtctagaaagaaacgaaatgagaggagaagagaggagaggagaggagaggagaggagagaagagaagtaggggaattggcaaagcagcagtagagaggagcaccatgagaagcgagagaagtcacagtgtagcaccctaggggattctggattggaggcactgctagcttggaagtgaaggtagaggcaaatgggctaacagtcagatcctcatctaaatcctgtgcagccaggtgaatgctgcttctcgtaccctttcagaatatggaagatttactttctattaagattgcccagagatgctccaggtgacatgacagcagaagtgctggaggggaggagagagaccctgttcaaaaagggtgaggctttcccaggcttcttctcttgcagccaggcaaccggctctacactcttcctaccactttccaggccaaagaacataggattcctcgctggaggaacagcagagcttcaccgaaaagatcttcagagactgacattggaggattctccatcaaaggaggcttttccttgactgatcgctctccaaagaatcccaccagttgggaagcctccttcatgcacctgggagaggtataaaaggtataggcacactattctgcttatttctttcaacgtaagtcttctttctgaagagaggcatattttacatttcattctctgtccacatcaaatggtctaaagagaaacaccaaatttctgtattacaacactgggcagaaattcatatgatagcaattagtcatgacttaaccctttcacccaacactgtgaacaaaataaccaagatgggccgggcgtgttggctcacacctgtaatcccagcacttcgagaggccgaggcgggcggatcactgaggccagcatggccaacatagtgaaaccctgtctctataaaaatacaaaaaattagctaggtgtggtggtgggtgcctgtaatcccagcaaattgggaggctgaggcaggagaattgcttgaacctgggaggtggaggttgcagtgagccgagatcacgccactgcactccagcccaggtgacagtgcgagactccatctcaaaaaaaaaaaaaagtatctctagacccatttttccattaaagttatccttttaaacatatgatataatttgtagcaacaatttataagaactctggcatttcactctttattttatcttagtaaatattttttctttaaaattcaattgtatattgagtatgtacctatcttaggcccagtgatagaaatagtagtcttaggcccagtgatagaaatagtaatcttaggcccagtaatagaaatagtagatgtttttatatgtaatgtattaaatataattgattatattaaaatatttgcttatgttaaaaatagagaaaattaactttctgatatttaaaacatttaccaatgtgaaaaagagacaccctctgtgtatttttataaaagataaaatggggtgagaataggattgcaaaggaacagaagtcgtgaccaaattagaagaaaagatgattaggtttgctatcaattaatattcgctaattaatataataagcttggaattatttaaggaacacttttctaggtcacatttattattgtcatgaaaggtaaaatcattttctttaagataaaaacattgactgcactaaagagtcatcatttgcaatgcagtagtgtcctaaatctcttattcccagatgtcaagattatgtctacaaattaagaaaatttcaagttgaaataagtattctaaaccgaagacatctgatgttaggagcaaatacattttcattccgatcctgggggtagtttcatgttttcttttgtttttctttttttgtctgagggtccttgggaacactccttattcattgtggctgaattttttcaacatcagcattgaatactacaaaggattgtatcagatataaatcaatagtcaataattttattaagaagtaaaaaccatccatttaaactgaattacagtgggaaaatatatttgtaaagaaggcttagaaaataaacaataacaataaactagaatgagattatttcaagcatatattttctaactattcgtaggtaaagttttaaaaattgaatggattctagtcctctaatccctgtcactagaaaatgactgacctacagcatgctttagtatcttttcttcacaataagagaataatattttaataatgacacacaataattgctaaacaggcttgatgggacagtaagcgtagttccacaaagatgccaagcagcctgcgtggcctggggcattatataaaaatgagctagccattcaagtagaatgtacctctgcaaggctgcaatattacttacattaaagggcccatcatcaaggggacaagggctatttccccaagtctaacgtggattggaaaaataaggaatactcatctgaaaccatattgtgtttgtgtttgggcatcactaaacactctgccgaactttggctgggcgtggtggcttacgcctgtaatctcagcactttgggaggacgaagtgggaggatcgccagaggccaggagttcaagaccagcctggccaacatgataaaactccatcgctactaaaaatacaaaaattagccaggtgtggtggtgcacacctgtaatcccagctactcgggaggctgaagcatgagaatcacttgaacctgggaggcggaggttgcagtgagctgagattgtctcactgtagttaagcctgggtgacagagcgacactccacctcaaacaacaacaacactatcaaaacactatcaaattttaattggccattttattttatttcattagcctcacagtgaaaataagaaaacaagcacaaggatgcttatgatttctccaggaccattcagcctctggggatatcccctgggaatatctcccaaatctcctgaacctctttctttattgcctggttaatcctttcttactgtattatgttgaactataagaaatggcagatgtttgaacatttctgacttagaaaaatggcaatttcattgtttcaaattaatgcatattgtttagataggaagaacacacttgaaaatcattataaccatttatactacaatgaataccaaaaaaataggttcaaaatatactgtttgcagcttacttgatcagagagagaacaaattggcaagaacctgtttttatatcaatgctgcctcccatgttaatacattaatgtgtgccatttaaaatatgtttacaaaattgctaatacatcatcaacacatgaaatctcacgatgtctttagaagacacattatgtttactttttactaaaggaagctcaaatagtgaagcaaagtaactttcctaaggaaagactctacgttcaaaatttatacaacatccaatcatttctcaccacctctattgctaatgtctggcccaagctaccaatggaagattccaaacaattttttagaattacaatgagacaacattctatactgagcctttcctgggcaaaccgggatatttggtcattcaccgacaaagctttacataatctgtgagcatccacctcctcaacacatctcttttcccatcatttttgcctgttctggctacattggcctctttggcatttttggaaaaccctgaaatacacagacttctcagggcgattgcacttgctgttctctctacctggaatgctcttctgaaaatctctgtggtttgctccatgacatccttcaggtctttgctcaggtattcccttcccagagataccttccctgactaccacatataaaataacagctgtcccctactgtcttagtccattctcattttataaatttacccagtaaagatctgcctgagactgggtaatttataaaggaaaaaggtttaattgactcacagtttgccatgactggggaggccccaggaaacttacagtcgtggtggaaggggaagcaaacatgtccttcttcacatgatggcaggaaggggaagagccaagcaaaagccccttataaaaccatcagatctcaggagaactcactatcacgaaaacagcagcatgggggtagctgcccccatgattcaattaccttccactgggtccatcccataacatgtgggattacgagaactacaattcaagatgagatttgggtggagacacacgcaaacaacatcacccacacacttcatatctctatcacaatggattcagtttctccttagcacttatcaccaaatataatgaaatattataatatatgtgtttattgtctacctactccaaccgccctgtacaatgtaagcacgaagaggtgagtggctacatctattatgtatactgccctaatgctaggtggatagttaggtactgtactagtttcttgaggccaccataacaaattaccataaactgagtggcctaaaacaacaggagtttattatctcacagttctggaggatacaagtccaaaatcaagaagaacagggccatacttccttcaaaggctctaagagaaaatcctttctggactcttctagcatttggtggttgccagcaattcttgacatcctttgacttgtggcagtatcactctattctctgataccatcttcacatagctgtctttcctctgtgtgtctctgtgtctaatttccctcttcatataaggacatcggtcattggattagggtctgccctaatccagtatgacctcatcttaactcagttacatgtacaaagaccctatttgcaaatgagatcacattcacaggtaataaaagttaggaatgtacatgttttgggggcacagctgaacctagcacaggtactcgacaaaatatctactgaatagatgagaagaaaacttgtaaacctgaattagaattgtagaacttcccaggatctgttattgtaatttcacagttgcttatgggagatcaaattcttttgtgtctgttgaatttataagatgtctttatcagattccctccatcttcacccttccagcaacaacaaaaataactactcttaatgaattatgcttttcataaacttttttgtgatttgcaaatatgtcatgtcaatatgtaacagcttattttggttttaaaagagacatttggatttataaaatcccaaaagaaaatatatacctgaaaacataatacctaagatatttgaaagttggctctctcactgggccaaggtcattaccatagctatctcataataagtttttagtttgactcgtgttttcagttggcaataaatatgttttttgagcaaaattataatagctatgttgctttttaaatttgtacccttgtgtctttaactatctaattttaaaatttatcacaaaactcaagtagcataaaggaaaaaaataaatgcccttatgcaaatggcaatttcttaaacataaacaattgcatagtcacagacatacagtcataaagtatttttcatgttacagaaaataagaaacaaaaacattttattataaggaagcaaaagaaaataaagatggaaaacaaaatatttaaaaaatataaagagattttagaaatagccttgttccccgagactagaacatgcagagaaaatataattagaggaagtgacatcattcagtcaaatatcatcaacactagaggctcagagagggaaaattgtttgcctaaagaaataaaagagactttcactaagtatatttacactagtctgggaaatcagcataacgacatgacataaataccatttatttgtgactccaactcaaattgttcttctgactgaaaataaccaatgtatttaatagattactgattaggatttttccttgataaatgaaactgctaaggattagtagtaaaaataatgtcctctttttttatgtgacaggaaacaaattttcattattttaatccgctcccagataatattcaggagtcaaaaattaaaaatcatgaaatgtctgtatcttctagactttgctttaatgttatttgttgaaaaatttttttatttgattaaagttttcttatgcatttgtgggatcaagtactttatttcagaagtgaataaattagcttaaaaagttagagcttagccaggcgtggtggctcatgcctgtaatcccagcacgttgagaggctgaggcaggcagatcacttgggtcaggagtttgagaccagcatggccaacatggcaaaaccccgtccctactaaaaatacaaagaaattagccaggtgtggtggcacacaccttttatcccagctactgtgttggttgaggcatgagaattgcttgaacctgggagacagaggttgcagtgagccaagatcacaccactgcactccagcctgggtgacagagtgagactccatctcaaaaaacaaacaaacaaacaacaacaacaaaaaacacctagagcttaaaaaagaaattttctcattccaatgtttgattctggctcttgcataaatggaagtatgttttgaaaatgctctgaatgatgcacctatatatcatataattttacctacgcacactgtatatatacgtatatgtatgaacataacattattatacataatatgtatatattatagattatattatatatacattatataaggtatataaatattgcttagcattagatttagtaaaaaataaagggctaatgaaatttttttgacaggcctctgtctcttgatgtcctgaaatgtttatctcactaccattaagataatccaataatcaaaaaggcaccccctagtctggtagcatataaacaataaagcatttcaaaatgtaattatttacatttagaaagtcattatattactttgattagctttagaataattcctgagaatatcttaagttctctaaaattttccattttcctcctttgcaattctaaccaacattctctgtaatattgaagaaatgctaagcattaagaaacttgctttgaaattctggtctccatcattcattatagtaaaccattatttcttctgcacatctggcttacagtaaagttgtatcaaattattctgttcatttattgcacaattagttgtatttcttttataatatttttgccttaggcagtatcaaaacttttaattattataaaattaaaattgttatcaaatggctgttctttggtggactatattattttacataattttaatgctataaattctaattccttccccactatatttaaaaaaaatttaattaattacgctgcattaaatttaaagatgaagacattaaatttgtaaatgaaaagttctaaaaataatatataatttttaaaaacaattacaaaacagaagtacattagtagcatgcaaacatttcaaaactggtatgttttaagcaagcattgtaaaaggatatataaaagaaataaaaaggaaggaaaaagttattgaacgaagtatgtttaataagttagcattcacaaacgctataggactataatgcttaggactataacctaagtcagtgagttaaaaatgtacccataaacacaagcttagagactccttttaagctatttccttccaaattttttcctctttctgaaaatggaatataactgtgcttttgtatttttcttaagaatccatactcactgaaagccttacaaagctaaatatagttgatccctcaagaaatgcaataaagaaaaatgtttctgaagttttttgacttctgaagtgaaaattgtcatatagtccattttatttttaattttttatactgaaactgtaaacctatcatttacgtcaaactcccatgcaattcattcaaaatgtaaaggaaattatacaaagtgagactccatctcaaaaaaccaacaaacaaacgacaacaacaaaaaacgcctagagcttaaaaaagaaattttcttattccaatgtttgattctggctcttgcataaatggaagtatgttttgaaaatgctctgggtgatgcacctatatatcatataattttacctgcgcacactgtatatatatgtatatgtatgtacgtaacattattatacataattatgtatatattatagattatatatacattatataaggtatataaatattgcttagcattagatttagtaaaaaataaagggctaatgaaatttttttgacaggcctctgtctcttgatgtcctgaaatgttcatctcattaccattaagataatccaataatcaaaaaggcaccccctagtctggtagcatataaacaataaagcatttcaaaatgtaattatacatatttagaaagtcattatattactttgattagctttagaataattcctgagaatatcttaagttctctaaaattttccattttcctcatttgtaattctaacataccttatttgtatatctgtatatttgtatatctgtatatctgtaacaaaagatacataattctaaatctcttctccaagtagcagaagcagactccttgctagtcaacctgacttcttgcaaaagctaatggttgttacctgagttttggttactatcatacctgtgaaataaattagcatt

SEQ ID NO: 935 - DNA, 31149 bp, Homo sapiens; identical to SEQ ID NO: 933

SEQ ID NO: 936 - DNA, 31015 bp, Homo sapiens; identical to SEQ ID NO: 934
